United States Patent 10,407,724 (METHODS AND COMPOSITIONS FOR SCREENING AND TREATING DEVELOPMENTAL DISORDERS) - sequence listing, part 24

SEQ ID NO: 612 - DNA, 388980 bp, Homo sapiens
tcattcgtaacctacaaaagacaactttcagaattaaagcatcattcctttctatccccggagcctaactccttgagtgtttccaaagaaagaactttactggaattcagaaattatatcttgaaaaagtaaaaacttaaaaaaaatttttaaaaactcttctaagaataaatcaataccaaattaaagaaataaaatgcacaatagaatgatgatacctgatctccccactcattgattattggcatattcacatcatcaataaaaacagtcatcttctttcccgcaggagggccatatgttgtacccattcgtttatccacatagctctctatcgtcctctgtgaaaaaaaaatcaactgaaacatctgtgaaaatatcccctaaaacctggtcaattattttaaaaaacaacaaaaactggtaacctttgaactgatatgaattatttctaaaaagccaaatttcccccttaattctaacaaattctaaagtacctaaattatcttgtataacattcacaaaatttgaaaatccagtttaatttagaaggaaatgaaattctaaccaatgtgaatttgaatgggatgagactcgtctgtccatttctaaaaatttacttttgtcttcttctgttggtgacactatgttccccattattcaaagtcttgctaatagtttccctataaccagcaacaaagttaaacaaggctactgtgtgagaagcttctgaggtctgcactccgagctgcacagcccatcatggtctgaaggctgaaactgactgctgtcacctggcacagctcatacccactcttttgggcagatgcagttacacggattcaattctcattccctgacacagagtgaacaaagctcacttatgtcttctctctcatttttacattctgagcttaggcagtgcaagagaagaccacgctgcactctgtaaaaaaccttccttgaggccgggcacggtggctgatgcctgtaatcccagcactttgggaggcagaggcgggcagatcacgaggtcaggagatcgagaccatcctggctaacacggtgaaaccctgtctctactaaaaatacaaaaaaaattagccgggtgtggtggcagatgcctgtagtcccagctattcgggaggctgaggcaggacaatggtgtgaacccgggaggcagagcttgcagtgagccaagataacgccactgcactccagcctgggcgacagagcgagactccgtctcaaaataaataaataaataaataaaccttcattgcagtacacaaaaagatattaaaactgaaagaactgggacacatttaaagcagcgtgtagagggaaatttatagcactaaacacccacaagagaaagcaggaaagatccaaaattgacaccctaacatcacaactaaaagaactagaaaagcaagagcaaacaaattcaaaagctagcagaaggcaagaaataactaagatcagagcacaactgaaagagacagacacacaaaaaacccttcagaaatcaatgaatctaggagctggttttttgaaaagatcaacaaaattgatagacggctagcaagattaataaagaagaaaagagagaaaaatcaaatagatgcaataaaaaatgataaaggggatatcaccaccgatcccacagaaataaaaactaccatcagagaatactataaacacctctacacaaataaactagaaaatctagaagaaatggataaattcctggacacatacaccctcccaagactaaaccaggaagaagctgaatctctgaatagaccaataacaggctctgcaattgaggcaataattaatagcctaccaaccaaaaaaagtccaggaccagacggattcacagccaaattctaccagaggtacgaagaggagctgttaccattctttctgaaactattccaatcaatagaaaaagagggaatcctccctaagtcattttatgaggccagcgtcatcctgataccaaagcctggcagagtcacaacaaaaaaagagagttttagaccaatatccctgatgaacattgatgcgaaaatcctcaataaaatactggcaaactgaatccagcagcacatcaaaaaacttatccaccatgatcaagttggcttcatccctgggatgcaaggctggttcaacatatgcaatcaataaatgtaatccagcatataaacagaaccaacaacaaaaaccacatgattatctcaatagatgcagaaaaggccttcgacaaaattcaacagctctttatgctaaaaactctcaataaactaggtattgatggaacgtatctcaaaataataagagctatgtatgacaaacccacagccaatatcatactgaatgggcaaaaactggaagcattccctttgaaaactggcacaagacagggatgccctctctcaccactcatattcaacatagtgttggaagttctggccagggcaatcaggaaagagaaagaaataaagggtattcgattaggaaatgaggaagtcaaattgtccctgtttgcagatgacatggttgtatatttagaaaacaccattgtctcagcccaaaatctccttaagctgataagcaacttcagcaaagtctcaggatacaaaagcaatgtgcgaaaatcacaagcattcctatacaccattaacagacaaacagagagccaaatcatgagtgaactcccattcacaatggctacaaagagaataaaatacctaggaatccaacttacaagggatgtgatggacctcttcaaggagaactacaaaccactgcgccacgaaataaaagaggacacgaaaaaatggaagaatattccatgctcatggatagaaggaatcaatagcatgaaaatggccatactgcccaaagtaatttatagattcaatgccatccccatcaagctaccaatgactttcttcacagaattggaaaaaactactttaaatttcatatggaaccaaaaaagagcccacattgccaagaaaatcctaagccaaaagaacaaagctggaggcatcacactacctgacttcaaactatactacaaggctacagtaaccaaaacagcatggtactggtaccaaaacagagagatagaccaatggaacagaacagaggcctcagaaataacaccacacatctacaaccatctgatctttgacaaacctgagaaaaacaagaaatgaggaaaggattccctatttaataaatggtgctgggaaaactggctagccatacatagaaagctgaaactggatcccttccttacaccttatacaaaaattaattcaagatggattaaagacttaaatgttagacctgaaactataaaaaccctagaggaaaacttaggcaataccattcaggatacaggcatgggcaaggacttcatgactaaaacaccaaaagcaatggcaacaaaagccaaaatagacaaacgggatctaattaaactaacaagcttctgcacagcaaaagaaactactatcagagtgaacaggcaacctacagaatgggagaaaatttttgcaatctacccatctgaaaaagggctaatatccagaatctacagagaactcaaacaaatttacaagaaaaaacaaacaaacaaccccatcaatagtgggcaaaggatatggatagacacttctcaaaagaagacatctatgcagccaacaggtacatgaaaaaatgctcatcatcactggtcatcagagaaatgcaaatcaaaaccacaatgagataccatctcatgccaatcagaatggcaatcattaaaaagtcaggaaacaacagatgctggaaaggatgtggagaaataggaacgtttttacactgttggtgggagtgtaaattagttcaaccattgtggaagacagtgtggtgattcctcaaggacctagaactagaattaccatttgacccagcaatcccattactgggcatataccaaaaggattataaatcatgctactataaagacacatgcacacgtatgtttactgcagcactattcacaatagcaaagacttggaaccaacccaaatgtccatcaatgatagactggattaagaaaatgtggcacatatacaccatggaatactatgtagccataaaaaaggatgagttaatgttctttgcagggacatggatgaagctggaaaccaccattctcagcaaactatcacaaggacagaaaaccaaacactgcatgttctcactcataggtgggaattgaacaatgagatcacttgcacacagggcgaggaacatcacacactggggcctgtctgggggtggggggctgggggagggatagcattaggagaaatacctaatgtaaatgatgagttgatgggtgcagcaaaccaacatggcacatgtatacctatgtatcaaacctgcacactgtgcacatgtatcctagaacaacttaaagtataataaaataaataaataaataactgaaagaagggacactggaaggggtaggaagaggatctgaggagaggactccaggctcttgactggtgttctcacgtccatggtagtgcaatgtggcttgggaatcaattgtctttcaaaatgtatgcatgagtaaccagagtctggcactgcaaagcaaacagaaagggctttgaagttctcaaactccagaagcttcaaaactcaaaagctcatttcatttatataactgtaggaatccactaatgcatgattttaaatcatgttaaagatgttgtataaatacagaagaaagtggaggtatgtaaagataaaataaattctccttctcttatccaaaagatgttttatttcatgacaaagaacaaaccagttaaaagtgaattttatgaacaagatataaccacaaaatgagacaaaatataagacaaaaaaaagcaaaactctatacaactgtccttgagaatcttcacagtaattgcacagtgtacattttcatcatgattttatttattttatttatttatttatttatttatttatttatttatttatttatttattttgagacagtgtcttgctctgttacccaggctggagtgcaatgttggctaactgcagcctttgcctcccgggttcaagcgattctcctgcctcagcctcccagtagttgggattacaggtgcacaccaccacaccctgctaatttttgtatttttagtagagatgggatttcactatgttggccaagctagtctcaaactcctgacctcaggtgatccacctgcctcagcttcccaatgtgctgggattacaggcatgagccactgtgcctggcctcatcattttaatgaataatagcaagcaatgtgaaaatttttcactatttttaaatagaatgagatataaatatattacaactcattcaattacaaaacaaatctcccatgacattgtacaatagcaaaaagaatttcatacccccccccacaaaaatgcaaaattgtttgcatttgctaaatttgctcttcttttcaatgaattgaaatgcacctccttatggccaactaggacttccagacattcccatgtctattaatgagaacactttttggcacatgaagattttatgtattgggaagctttctcaagagctaaatgtactaggtgggatagtcagagtaatacagagtaatagccacacacctatattttcttcccctccactgtaaccctaatttttttgaaatgataggaaatcatccctatcaccactaagctatacatgtcataaaagagttaaattgacaaaagcacaacaaaatagggagaaaaattaagcaacctgagaacctagaagttgagatttctttccatttttagaattgttgcagattcaatagttacctgagtgttgaagtttggtaagacctcctgaaggcctgaaacacaacacaggttggttatgccttctctgaaatgcttggaaccagaagtgttttgtatattgaatgttttcagatttgggaatatttgcatatacataatgagatatcttggggatggaacccaaatctaaacataaaagccatttgtgtttcctatatacactttatatatataaccaggaagtagttatatatgctatgtatgtatgtgtgtatttattaaaatgtgtatttatatgtttacttacattttattttaaaatatttaaaattaaatatttcatatttatacaattttgtgcatgaaacaacattcgtgtatattgaacaatatatgttggacatgcttgcatgggggaatctggtagtgtgctgaaaagatatgaaagcaggagggtgctgggagggtctttcttcccttggggatgctgaataaactgtgtgttgtgcacctgcattttgactacaacctgtcacttgaggtgaggtgtgaaatattttgagcttgccaatgctcaaaaagttttggattttggagcaacttgaatttcagattttcagattaggcatgttcctcctgtattgcatgctctactcctttggatagctatccatttggggctgttcgaaaaaactgtatacttggacatctgatctgtccaagctggaggttccataacatcacaaaaataagcatattcaaacataaactccacttccttactcagcacaaagtctgcacccctttggggtgctcaattcagaaagtggcaccaactacctattgccccatccaaaaatttccacatctaacaacactgagtttttctattataatttcaacaccctttctaaagtatctcttcctacctaaacaacagtaggcccccattccattatgtctttctttctcacagggattaatgtcatgaccccttaaattgccttccctgactgcagtcaatcctggaaacttccttatgactcatacacaatggctatattgcatgatttgtaattttacctagaatttttttgtctcccccaaagaaatccgtctaaagaatcacggatcatctgtgtagtattctgccacccacattccttccaatctctttgattggtgttcccacctcatccactgttttgctgttatgaactgcggtccagttaataaaaccaagtagatatgttcgcttattagattattgcctgtctcctccactagaaggtaaggagggaaggcaccttgttttccttactttactcattatttcatcctcagtgtctagaagggtgtctggtactatgtgtttgttgttaaatattttttacataaataaatacaagaaacctggagtcatctttgacttttctcactgtctcctatgcctctcctccaacaaccttgatatggtttggctctgtgtccccacccaaatctcatgtggaattgtcatccccaatgttggaggtgaggcctggtgggaggtgactggatcatggaggtggtttctaacggtttagcactatccccccagtgctgtctcatgagtgagttctcacgagatctggttgcttaaaggtgtgtagcacctccacctttgctctctcactcctgctccggccacgtgagaagtgtctacttccccttccaacataactgaaagtttcctgaggcctccccagccacgtttcccgtatagtctgtggaatcatgagccaattaaacctcttttctttataaattacccagtctcaggtcattctttatagtagtgcaagaacagactaacataaacccctactcaaccaatcacaagttctggtagttccacttcctaaccaaggttgaatgcatccttgttctgtttcctttctcattttaccatcttggtccagcccaacctccctcctgagaaatgactgcgactgtctcctctcaggtctctctgagtgcagccatgtctcttgcatcttgttctccactctacagccagaatgagctttctaaagggcaatgcaatcctcctcaggactccagggggttcctcgtcagtgacttacagggaactctatggtacccactacttactcctccagtctcacttccagacagtccttctcactgtctttgttctggaccctcagggtcttagttcatttacatacagttaaaaaaaaacacatagactgtgaagtgatgttcaccttataggctggcttacagtattccttatgggatccttatttatatatttctagagtagccatttctaagccaaaaaaaaatctctcaggattatcattagccaaattcacattgtgaaatattgatttagatgagtgatcttctaaaaatgtcacttctgtcaatccagttactgatttttaaaaaaaaaaaattaagtctctagcaaggacttgcactaaggacatatactgttctttgagaatagacaatcactttactctgaaattggggaatcgtagtcagcatgacagcatcttatgcaatttatgaaacctaaacaagattccaatctcattgtctgtctacacacataggatatcattaacccaagctgtgacagcagcattttaagacatgaaaaccagatggtcagaaaaccaggtaggctgaggaatggagctcccttctggctcttttctgagctagaagccctaaacctagggacaattcaattactgaattaatttctcaatagacaactcagcttttataattcctagaaattaatataaataataaactcccccaaggaatgatcaactctttcattatgctgatttctgtaatcccctatggaaactaatcggctcctcctccggactccacagtacagcattgagattctgccataagtagcacttatcttgtcaactacacttggttatgcacatgtctgtttccccaacaagacaaagggaggaaagcaacattggaaggggtattggaaggatcatgtgcagctgaggcgacggtgcattgcctagttcttaggtacaacattcacgcaatcatctttgtgaatgagacacagtgcaaaatctgcacgacctgcaaggtcttacataacagctctgactaggctgaaagtcaggaaaaacgaactaaactactgcttctcacatttatcaactctatgatttcaggtaagccacttaatatttctgggtataatacaacccagaaatgagagtgtgtatagatacgtaaatcatatgtacgtacataaatatgcatatgaatatgcatatatgcattatgcattaatgatataatatatatgaaagcaattcatgagcttgctacagagtattatgcattaatgatatataatatatatgaaagcaattcatgagcttaatgtagtataaaatgtaaagctattttattatttctatgtgtagctctatacactagcacctaaatcatttttcatgcatgttacatacaattaaacagaaatataaaatataattaattttaggttttcatatgtgtgctattagctaaaacataaaaatggagagttatgctctttattaagaaatctactgcctaataacatcttcccattttattgtaattcaaacaaaaatagtcttacattaggaaagtttaaaatgctcaatagtacattgtaaaaagtaaaatatgtcaaaaatcacatgaaaatacaataatgcataactgaagctaaaaataaaacaagtgcactaagtgataaaccagccctttagatattaatatagataaagaaaggccattggaaggaagcatgtgggtgcacagcacagcagagcacatggaccctggtttccagctgtttccagcttaggttctgccaccaactaagtgaattcagacaatgcttgaatctccttccacccaagtacatcagtcttaaccgtaaaacctgacattttaagagagctttatgatacaaatatactttcacatattatctcttaggaaactagtcttcaaactgtgctctgaggagccaaaaggattttctgcaaacacagggatcccttgcaggaagaaaagatgaggctggaatgggctgcaggaccccagctccaattccaccaaagcaaatccatggttacttattttatagattaatctactgcacaagatgtcacttggaaaagtggttctgggtccaaaaaacactgtggaatttccttccaggtctaggagtcttattttttaaaaaataaaacctattgctatgcaaccatttgtaagatggtagctatattcaaaaaactttataattatttttagaaatcttttcagaaattatcttaatttttgctttcttcttttcaccttcttgtattgcttaaatttctacttctatgtatgaattactttcaaaaataaaaaaattaatattagttcggggggaaaaatgaggaatctttcttaaaaaatggactaaattcccttagccaaaaaatggagtgactgtataatttttgtccaaacttttgatagtggcaaaggatgctattaattattaatctgagacaatgaaagtaacctggattgtccgaggcaaaaagtgacagtcccctctactgatgaaagatgtgaaagttacatcaagatgaaaacaacctgtgaagtaacagatacgcgcccttcgttggacagtgtgccatcttggtaacagctgagaaatggacagtatctattttctcatctacaatttcagtttggttgggatccagatacgtgggagatgcagagacaaatgctctgctccatcagccctgtttagcatgaatgactgaaaattacagtgagaaagttaattacaacagtttggctaattgaaagctttctaaaactaatgagtcttgcttaatagaaatccctgatgctccacagtcaaaacagtctctggcacgaaacagagtggatgatcctgtgatgcttctgaacagaaaaaagaaatagtgatgtgttaactccaccttaacactgaagaacagtggggaatctggctaaagccatgtgtatcagataatgggagcctaaggaatacttcactcttcttctatttattatatttgaatatggtaccacttctagaaatttattatatggtttatgaatttgtatatcaaacaacaggttttctagataacatatggctttttccaggaaacgagtacatatttcatgttaaagagacagaaaccacagatctttaatacctggcagagataaatgtcacagagttggtaacaaaaacgcaatgacaaggcctcattgcataataaaagattggactggcctttgttcctggctcctgggatggagtctttaaaccctggaaatttcctgagtgatagaaaggactcacatgggcccctcataccactcatgccaaccactcatcaccagccatgtgatgagaaggttgaagttttaagtcacatgatatcagttgacctgggaggggagctgatggagatttgagttcagtcttaaagatcttggctgggcacagtgactcacgcctgtaatcccagcactttgagaggcccaggagggcagatcatgaggtcaagagatcaagaccatcctggacatcatggtgaaaccccatctctactaaaaatacaaaaattagcggggtgtggtagcccatgcctataatcccagctactcagaaggctggggcaggagaattgcttgaacccaggaggtggaggttgcagtgagccaagatcacacgactgcactccagcctggtgacagagcgaggctccgtttcaaaaaaaataaaaagatctgagtctcgtcctatggccaatgatgtaatcaagtatgcctatgtaataaaaccccaataaaaacccaggacaccaaggctcaggtgagtgtccaggttggtgatatacatgatatgcctggaaggtagcacatcctgaggacagggaaggtttgcatttgagaccctcccaaacctcgccctctttatcttttcttttgactgacacttacttgtatctttgcaagaaagctgtaatgataagcatagcatttctccgagttctgtaagtcattctagtgaattatggaaactgagagggctgagggaatggcctaatttgtagccacttggtcagaggtatgggtctcttgagaacccctgagcttgtggctggtgtctgagtgagggcagtcttgtggggactcggcccttaacttctgaagtctgcattagctctgccatagttacaatcagaactacactgtaggcctaaagagttcatacagtctcatgaagtgtggatcattagaaaatcaccccacataatgaaaaaataatcacactctgatctgatttttttaaaacctttatcctcaaataatgttataattataacctttaaagagaatgtcctcctaaggtaaaactaacaaaagctctttaattgtaaagcggtattaaaggaacacatataacgttagcatcttgccagcctagggtaatttaatgtgtcctttcccaaacacgaaaatgccactgctaagtcactgcaatttggggttgaccatccatccagatctgcccacccagacactatatgaatggtatttatttgatagaaagatagcccatactggaaatcctgtctcctccagaagagtataatgaagctgacagtcttatttagaagtttaatcaatgatcttagtgtattggcactccgctgtcaccaattaaattaagtgataaaaagtggtgatttaaccatgccttcaacaagtttcattgctctgatattttcattccaacagctaaagaacaacaaagttcattaaaagcaaagttctttggatttgtgttcccctaaaaatttcccttctatttgcaatttatgacatgtatcttctggtgatatattaatgttctaataaaaatatgagagataatttgcaaatcactgaagcatgtactgacatttaggatttcctcctcagtttcaataaggtcttgtacaatttaggaccaggagaaaaagaactatttaagccactgcaaatctaggtcattcctggtggtttcattgggaaaaaaaaataaacaacgcaaacttgaggggttttttttctctcacacttctgtgatacatagagcaaaatatttcatatctaagggtctaagattttataccttgttgcaattgagcatgggagctagggtggaatgttaagtcggggaacaagattaaagtggcattctaggaagtaaggagtggaaggtataaaagctagactgaaagagaattcaacttgaaccaatcatagctggggattcttccatgccaataacctggtacgcaatcatgcagaagtggattacctagaggtaaaccaggagcatgaagataaagaaatagatgtgaaatgcatttcttttggtactgtaacagcctttgagacctgagcaacagggacgcattaaagattattacaaagtgcctagcctaaaagagtattaggaacaccttcaggcaagcagactctagggaaaggaagtaggtttaggtggggaataaatgattttctttcagttttggattttgcgtgttcacagtattttctacatagatattttaaaccgcattgaggcctatagcaccttatataagcttttaatgtttccataatttaagatgttatattctaactagggaaactattgcagttgaataattgaaagaatggaagacgtacgtgggtgatttatcatggctatgaaaattcagatgagattcaattgaagcagaatagtagagatttgagcctccaaagtttatcacaaaattgggcttactgagccataccaaagagccagtacctggaacatcagtggggtggttgcagaagaaaaattcagactcttgatcatgtgacattcaggatcatattttgacataaatcctttaattattactgttttggctgttccttgttcaccaattaatagcacagcctaaaatagagggaattgaaaaaaaaagaaatgaaataaatgagtgtgatgggctgaatttgtccccccaaaattcatatgctgaatcttcaacccctagtaccttaaaatgtgattctatttggagataaggtctttaaagaggtgactaaggtaaaataaagctgttggatgaggcttattccaccctaactcgtgtccttataagaagaagaaatttgtggccaggtgtggtagctcacacctgtaatcccagcactttgggaggctgaggtaggcagatcacctgaggtcaggagttcgagaccagcctggccaacatggtgaaaccccatctgtactaaaaatacaaaaattagccaggtgtggtggtgtgcacctgtaatcccagctacttgggaggctgaggcaggagaattgcttgaacccgagaggcagacgtagcagtgagcccagattacactattgcactctaacctgggtgacagagactccatctcaaaaaaaaaaaaaaaaaaaaaaagaggaaatttgtatacacaaagaaacaccatgggaagaacacagtgagaaggcagccatctaccagccaaggagaggcgcctctgaagaaccccagcctgccaacaccttcatcctggactttcagcctccagaacagagagaaaagaaactgctgttgtttaggccacctaggctgcggtatttggttacagcagccctagcaaactagctcagcgatcaaagcagaaggaatcctttggggaaaagcaagtcaaaatttactttctgtcaactcatacataagaaataattactgacttatgaattagaactattcaactcatattttagtggggaataataaaggaatagtaggttaggtgacattttcgtgtattctaaactgcaacataaaacattttataataaatgcaggatgcttcatgttggctgggcacggtggctcacgcctgtaatcccagcactttgggaggccgaggcgggcggatcacgaggtcaggagatcgagaccatgctggctaacatggtgaaaccctgtctctactaataaatacaaaaaattagccaggcatggtggtgggcacctgtagtcccagctactcaggaggctgaggcaggagaatggcgtgaacccgggaggtggagcctgcagtgagccgagatcgcgccactgcactccagcctgggcgacagagtgagactccgtctcagtaaataactaaataaataaatgcaggatgcttcatgtctccccttaaaatatgctacagttaataaaaattaaaagtcataccttgccctgtttagcaatggtttgaattagaaagtcagtcctcacattgtcaacatttggcaccagaatagaaccatactctggggtggtatcagacggatacaggtattcctgggtacgcgtgttccagtgcgtccatgtacctaaggtgagcagaggacatttccatctccatattaataattcaactccgaactgtaatgagcagacatccttgaaatcttatgaggtcaccttccaaattctccccataaaatgaagatcattaaaattagagatctaagtacacaagtatgtgttagctgagtcaaaacgtcccaaggaacaatttcaaggtggtaaacctaggaaatactaggaagtattttggaattttttaaaaatatatattagttttcaatagcatgaaatatgtataaaaatacagaacagagtgagagtagtgtgtatctaaaatcattagtcactttcgaatgtctaatctcacacttttcattaggcaaaagatcctaggctgatgcatatgtatattaaatagttaatacattattatacacccacatatatgtacttcattttctgtataaatgtactttatatatttatacatacaccaataaccttaaagtatatatacatacagagataaagatatacagctatagatacacacgtatttggcaaaaatatactttaaactttgtgacttttatacaaattgctgattatattgaatgagtgacagaaatggatctgatttggttttttaaatgtttcttaattcattgaaagtttagtgcacaagatatttaacaagaggaaaatgtgcatttgaaatacaaagtagattttttaaaaagaaaccactgttcactttcttcacacacgaacgttttcatatcttacagccaataattataaatctcatttagaaaaaatatatatggtgtaaatattggccatgtaggaaagaacggcccccatgggttccgtctggacgggcaggtgtcctcaccatcgggcgccacatagtagtcgaaggcggtgtccccgggccccgctggcggcggcagctccagcgtccctgtgggccgagagcgcagccagagctccaggcggcgccgtccgtccagctccagcgccgcccccgcgctccacagcagcgcgaacacgaacagccgccccaggtgagcctggctcacctccccgccttgctcctgagaaggaaagacacttttttttaataacttgattctgaaacccaaacgttgctctagggtttcaatgggaacagtaaacatagaaacaagacactagttgccctccaagaacaagggaaaggatgaatacaactggagaacaaatgaagaactgatctctgagaatagcaagctgcctttaaacataatagggttggccgggcacggtggctcatgcctgtactcccaccactttgggaggccgaggcgggcggatcatgaggtcaggagctcgagaccatcctggctaacatggtgaaaccccgtctctactaaaaatacaaaaaaaaaaaaaaaaaaaattagccgagggtggtggcgggcgcctgtagtcccagctacccgggaggctgaggcaggagaatggcgtgaacttgggaggcggagcttgcagtgagccaagatggcgctactgcactccagcctgggcgacagtgcgagactccatgtcaaaaaacaaaacaaacaaacaaaaaaacagggtttatcgcagcactgttcaccacagtcaagacttggagacaacctaagtgtccatcaacagatgaatggataaagaaaagtgctacatacacacaagggagtactattcagccataaaaaagaatgagagcctgtcatttgaacaacatgaatggaactggaggttattatgttaagtgaaataagccagacgcagaaagacaaacttggtatattctcatgcatctgtgggagctaaaaattaaaacaattgaagtcatggagatagagtagaaggatggttaccagaggctaggaaggggagtggggaggggtgaggaaatggggatgatgaatgggtgcaaaaatacacagtgattgcagtcagcaataatttgttgtgcattttagagtaactgagggagtccaattgtaatgttcataacacaaagaaatgaagaatgaggtgatagataccccattcaccttgatgtggttattacacatagcataccagtatcaaaatatctcatgtaccccataagtatgtatacctactatgtacccacaaaaattaaaaattaaaacacacacacagtaataattttgggatacccgttgcatgactttgttaacctgcaactaaattccaaatccatggttagctgtattttttgttaaagggatatgaaaaaataagtatatatgtgggatccatgtttgaaatattccccctccccaacagctctaaccaaatctaatttcaaatatagtactctctgtatagcatggctacattaataagagagaaaatatagtactctctgtgcagcatggctaagttgataagagagaatttctctagaaagttgagcaatttaccttcagaggaatcaggccttgaagcatgttaatgctctgtgtgatgacaaaggcctccagcacctccatcttgtattctaagttctggatacagaagcgatacaagtctgggaaagactcggtgtacagctgacgaagaatttctgcttcttgaggtgagcgtttcttaagaaaaccctgtcagttcacagacaagtgtattcatgaaacttattagcacactaggaaaatggtcatttggggacaaaaattttaaaagtatctgttaataatgataatatctaatgattataccacacactatgttccaggctttgttacaaactcttccacgtattaattcacttaatcttcaaaacaaccctacaaggtaagaactgttattatcctccttttacacatgaggaaacagaggcccaggaagtgtaggtagcctgctcaggagcccactgcaagcaggtggcaagggcagaattcagacccagaaagcctgggcctacatgttcagctactacactatccatatgctcacagatggagaaatagtcttcaactcttgattaaaatatgctgggagaaaatgagaaggcacatatatggaaataactcaggggggaaaagtaaagaataaaagatgaacaaaggaaatccatacccaggtttttttttctttttttgagacaggatcttactctgtcactcaggctggaatacagtggcatgatctcagttcactacaacctccacctcccaggctcaggtgatcctctggcctcagcccctcaagcagctgggaccacaagtgcatgccactacacccagctaatttttgtaatttttgtcgagacagggttttgccatattgcccaggctagtctcaaactccttgcctcaagcaatctgcctgcctcggcctcccaaagcgctgggattacaggcatgagccactgtgcctggcccccagatttttttttaacagaaaacaaagatttactacaattagttgtttctttttatttcttctaatttaattaataaacaatgtagaaaaatatcaaggatattcatgaaaatggagaatttagtcatttgagaaacctagtattaagaaactgcatctcataaataccacttaacacacagcgtttccttaagatgaggcaagttctcttaaggtcaagagatcagctcattcttcacctcagtattccaagaaacaattagagactctgaacagaagcaataaaatgttgattctgaattattcattagttcatgaatttaccatgattctacctcgacaaaaacataacatagcacttttgagttgatggaaccgaaagacgacattcactagggcaggtaaccaggttggctccctgaagctgacagattgtcagcaacacaacttttcaattactctgccctctaataactctcagagctggccttcctgttctaaacatttccaatctgattcttctcatgagtcttgcttttcctaacaatttccaaaaaagaaaatgcattatttaaaacatataggatattatgaggtgggtatagcattaaagtaaaggtcttattcagtctcagtatggacagactatagcaaaagcttattttataaatagcaaactcatgcattagctagtactccttagctagttgtataaaagtatttttcaaaaacctttttgaaattgaagtattttggaaaaatcatatatatacattttcactggtagtttgctgtacctgtggtttccaagcctggctatgtgaaaaaaaaatgttgtggcacttaaaagaaaaaaaaaaaaaaaacaatcctgagttgcctcccagagattctaatttggtaagattgaagtgtaacccaatcatctgtattttaaagaattgtcattagtgattacttttgcaaaaacagggttgcaaccctctgcttttattctccttaatgggtggataatctaattgtgaaatctgaaaactttacaactatttttagtgacacattcaactctatgtcaacatcattttgctatatgattccctccttcttcccatcttcataccaaatctaaagccttttgcaacagagttgagtaaattctggaaagacattagtaaaaagttaggatataaccatatagaaataaaagtttgaaaatgtaatgatataatgtaaataaacatctactttatttaaattaggaatttaaatgttttcaatcaaaatcatcttcgaaaaacttaggtgatgaaaatattcaatataaccaactatgtaaaacaagatttttcatgtggcttatctaataaacattctgccttacattataatatttatatagcaaaatatctaagtatgcaaggcatttatttataatataattttgatcaatatattctaggatatattgctggtaataaaataatatacctgattatgaattgatgagatgttatctgaaatattattgccaagttcaaatttggaactaacgttataactaatgaatctcataaaaattccttatatgcaattttaataaactgactccaagttaatgttctaagatggtcctcctaaactttatgtgaatgtgtacctttcaaaaatatcatgaatccccagattgatcaaattaaattttacttattcagtcctcagacacagtttggcaacactgttggttcatacaggcctggcaattactctacaacccagaggttggaaatcccagttcaaaagtgattggaagagtaatgaagaaatatgttaggagcaatcagggtttgaatgtcccagtgcattcaagtatcttccacaaacattagcataaaaatgcagttacactgccatctgcagaaaaattggcacacacactaaaagaatgctaaaggatctgttttcctttttaattatacaaaagaaggattcaattatacctcaagaataggactccaatcaaggatagaagagctcatgaaaaccattccatttcttgagacggtggcaggagaagcattgtcaatgttatgaggctcgaaaatgatcttgcagtttggagccatgggaatccgatcaccattggcaagggttagagttttgttatcatccaaaacagaattcagattttcaatccagatggcatctactggaccatcaagaattatccagatatgttcccctagaataccccaccaaagggaaaaaaaaaatacatacactcatgcagtgcatgtacacataagtttaaaatagcttgaagaactattatattagatgtaattttcattaatttttaaatatagttttgctccaaatgattaccttgttttattacaaaggatcttcaaagatctttatatagtagtcaaggcccataattaaatcaaaaagtagtttgtttattggacaaatattcattgagcaccttgcatatgtcactgttctaggggctgaggatattgtggtaaatgagacaatgtcctgcttttgcagagcttacattctaaggagtagagatgacaagcaaacaaataaaagtttaacatacaaaaaaactaagtagaatgagggcatggggcatgttttagataaggtggtcgataagatattccaggaagagaatgaagtgatgtaaagatctagaggtagaatattccagacagcaagaacagaaagtgctaagcccctgaagcagatacaggcttagtgtaatacaatggactgaatgtttgtgttcccctaaaatatcctcatgaacaagattagtgcccctataaagagacctcagagaactctcttgcccttctgcaacatggggtacagcaagaaatcagcagactgcaaccatgaagaaagccctccccagaacccgaccatgctggctccctgatctcagacttccagcctctggaactatgagaagtgaatgtctattgtttataagccacccagtctctagcatcccaaactaaggtgatcacgttccaggaacagtaagaagttgaacctgaagggcaaaaagaggaggaaggggagaggtatatgagggcagtgggaaagacagagctatggaacccattctggtttgcacctaagtctaaggcatccaacagagatcctcgtagagttgctgagttgggaattcaggagagaggtcagggctggagattaaaatgtgaaagtcaccagttcagagatgggatttaaagctgtgggactgggtaagtttcttctagataagtgtggagagagaagagggctgaagacagaggctctgtaacccttaggcttctggcatggtctcctgtgtttgctcccctttcttccagacttctcaaggaagcagaagtggaaaaagagctagcaggatgaggaatccctgcagcccagagaaggaagggtttcaagaaggcaggcgatcaactgtgccgaatgctcctcagggcagtaccagactgagaactggcaatttgtatttgacaagctggaggtcaggggtgtccttgatacagcaatttcagaggaacactgggcaaaaaacttgacagcagtcatacgaggagatacttggaggtagagaaaatgacaaacatcagcagattgctcaacaagaatgtcattgtaaatttaggtatttgatttaataatagcattcctcttaatttctcaactactaccttctcttactcaccaacaccatgacctgtcttgtggttctaaattttctttgctatgcaacaaccgtgggatagtctatttaaaataaaatgctttgaaaatcctaatcaagttcattcaactagcaattcaagtaaaatggtgatctaatcaccagagtcactttgaaagaaaaagcatatgttgcctttttttaatgtggaaaggggaaaaaaaaaacaaaaaaacctctgcgctcttgttcttttaagtcacattttgtcactgggtctgtgtttacagtgggttagtggaacaaatcaggaataaaattcgatttatttccagtagaacaaaaacaatttctaatatgagcacttttttaaatgaagcattttcatttctctttcgacaatttatattagcgttattaaatgcgagcgtcaatggtactactttaaacatttttcagaaggacactgttgcccaaagggtaaacccaggaagcccaaatatctcctccttctcctgcttctttctctctgcaattgtattcactctgcctttgcctgctcactcaggagtgaggaaatcaaatgagaagaaagctgatgtcacctcttcccaccgaatttatattctgagaacattgggttcaatttacaaagtccataagtgagggactattcagactgaaccgctagcccttaatgagtttgtttaaacaactgaacaccaatgtccatctacacagaataatttattagttcaatgtagacttcatttttgctatatacaattttctctcccaaacaacccattttctctgtgactttatagagaaatcaattctttaaaaataggctgtacttaaatgagagcaacactggtaaaatattcagtgaaaatagttatggtaaaatcactttattcaatattatcaattttccttaacagctttttccatctattttattctaaaatatcacagggatacagacatatttttttagaaaatattatttcctaaaagggagcattttaaatactgtaatcaataattccattatttcaactttcacaaatatcacactgatttatgacttcttagtcttggctaagatattatacagcaaatacagttgttctactaattctgtatagcctccaaggattctatctagaagtataatcaaaaataatccttgtaatttatcttctacctttctttgctcttaatgttttcctccaaagcgtagaaaatatcccatcagtccagtcatttgtggcaacgtccagccgaccaaacatctgtggggcagtaatcgctttgggattcatcctcatttcccgatgtggttttccacaatctataccaagtaaatccaaattttagacatctcagatgggaagtgaaccatcattaagcaacattgcactaatttgtggtgtactgtcagcaggtgctcaaaatatgaaaactgcagaactacattgaaaatatgtcttactgcattctaagttaccataattagcttcattatactttattgactaaagcacttttttatcttctttagagaaaattgcatattgtttaggggtgaaaaaagataccatgctggaatttatgaaggtactaatataatctggaagctctctaaatttcatggctcaaaaaaaatctttggtttaagctacactagattaaatcttctgcctgaaatatcacctagaagatgcctcattcactgcattatcagctttgatttgtgttatgttttcttgctcaccttgaaaacgataagctaaatgaattttgcatgaatcaaggactttcttttgtgaccaagaaatgtattcaagaaatgtattcaaatctttcacaccctaagccgactcttcagtgggctgggattctgtgcataagggactgtggttaatgagcagaagagtgaacaataaggtttaaagtataaaattataaaaatgggcagggcatggtggctcacgcctgtaatcccagcactttggggggccaaggcgggcagatcatgaggtcaggagttcgagatcagcctggccaacacggtgaaaccccgtctctgctgaaaatacaaaaattagccaggcatggcggaagtgccaaagcacttccttgcgtatatcatgttctctccaatccctcctactgacacagactctttttttctgctaaaaacattttttatcaatctggtactcaaccctcaagcctcggatgaagtagcacctggtctgtatgcctttctataattccttagaggattttctcatcaccttggcctctactcatgggatacttgtccaaaccttccttatagcaattccctgttgagttttaattatctctgtctatgtctatgtcctgcttctaatacagaacctgacagatcttcaaagtatgcaatattaaagacacttgatgagatatatgctgaatcaggggacaaataatatgcatcagccctccacgtcgtcagcagaagttaaattatcttctcaaccttttggattattaacattttcagtgagaaacaatggttctttaagtaagattaatgtttcctctactactaaaaccaaaaccaagttcataaacagcaaatagtctaatgattaattcttctttgcaaggaacttctccagaatcagtgatgccatacagattacataatttagatataccatacataatgtatctatattgtttaatatttagtactcattttgttcgagtcattgtaccgtgtgcatttaaagtttattgttaacagaaggcagcttcgtcactgcaacaaaaatattattgagaaaaatttgagaggaagaacacaattatttaagaaacataaaaatcccaaaacagaatcttaacagcatacatgaaaaaccacgtgataagtcctgcaggttggagtggtccattttggtagaggtagatgttagctgagaacacactttatctcagtctgaggactgcctggtagagtcctgatagacagaattcacttcctccaataactgaggaaacaaagaccaaatccaacacctgcagggtcccacagtaaatactggcaatcctcagcaaccaccaacaatgtaccagtgttgcatcagtagcagtgcactgaggttccgggaactgcctgaaagcccacccaggtacctctttgctggatgggctttcagtcagctcctagaacctcaatgcactgctatatattttgcattccaaccgtcaaggttctgtgacattttggaatgtctacaggatgccaatatttttagaaagagagtcatccatgtctgatcagaaccagagaatacaagaataatcatgaatgtggtaatgtccattatccttagatgactttagatgtaaggcttagggacatctggaaatgaaatgcatttatttaacttcactaaaataaatctgattccaaatgggaaggtaatttatgattgggattgggatgacttcggcatatagaacataagagttgggtttggaattattttctatttattgagagacagtgtgttgtattttgtttttactgggaaatggcatggtatgttgggaaaactgggctttttttaagcgcgccctgaccttaactctgagtcccatcacttaccatctttgtgaccgtgggcgtttttgaatttgagccttgatttttatacaaaatggggataataataaccacctctcaagatcattgtgaaaatcaaattacataacatatgtaaaacatacagtgcagtgcataaagtcacctaaaaatgtttttttttctctctggttcattaatgtaatatgttatctctaaaatgttcccaataattaataaagcagtatttcctcctataaaaatatattattgtatctgcctgtgtatccctcttgggcattcaaatgggtcaccactacttaaatgggccaccccaggcattgaccttggctgccctgtacctgtcatggctctcatcaaggtgtggatgcaggtggtcttcccagccccactgggccccagagtcatcatcccatgtcgcactctctgcgtttcgaatagctggatgaccttcagtttccaaggaggatggttgattaaaccagcttcttcaacctgaaaacataagagaatccccacattgaaacacaacaatgatggccggacacggtggctcacgcctgtaatcccaacaatttgggaggccgaggcgggcagatcacaaggtcaggagttcaagaccagccaggccaacatggtgaaaccccgtctctactaaaaaaatacaaaaattagccaggcatagtggtgggcacctgtagtcccagctacttgggaggctgaggcaggagaattgcttgaacctgggaggcagaggttgcagtaagccgagattgcaccactgcactccagcctgggcaacagagcaatactccgtctcaaaaaaaaaaaaaaaaaaaacacatcaatgacaatctcaatttaccattgtgccacaaaaaaatacacagacatagggaggaaggaggaggatttactgtttaatgagtacagagtttcaatttgggatgataaaaaaggttctgaagatggatggtggtgataacagttgctcaacaatgtaagtgtgcttaattcttcttaaaaatgattaaaatgtaaattttatgttgtatttttaccataataaaaaatatattgcatgaaaaatacatatttacatagacaaaaatctggctgaatgtaatgaagatgttatcctaaactaataagaaatatctgcatttatctttgggaactgaaaacatttatataaatattcgattgaatgaacctctgaggagcaacttaaaaataaagactcaaacagcaaaatgtattttaaatgtttaatttaaaaggtaatacttacaactagaaaaatggatagcatactatgttgattgaaattccatataaatttcaaactgtctttatatgtccactgcagagtttctatctatcaaggcatgtatggaagttactctgtgccaaatattattctaagatcaatctttataataacatgatggaaatctttataataacatgatggaagggatgctattaacatcttccttttacagataaggaacttgaagcagagtgactaagcaatttgcccaagatgatcagcttgtgaaactatggaatgcagatttaagaccaagaagttcaaatccatggtctatgcacttaatcatcatgctatgcttgaactcacagtacgtaatgatttcaattttacttaaataatttttataataatcatgtatcactttatgctatgatttgcccttcagatttttatatgctacaaattactaacgtaagtcatcatatcaactacttaatgcttagcttttttatatttttatatattttttagagatagagtctcatttctgtcaccccatgttggagtgcagtggcgtgatcacagctcactgcagcctcaaagtcccaggctcaggtgatcctcctgcctcagctgcatgagtagttgggactatagacatgcaccactgcaccaggctaattttttaatttatttgtagagacgagttctcgctatgttgctcaggctagcctcaagtaatcccccaacgttggcctatcaaagcactgggactattggcatgagtcaccacccctggcccaatacttagcttttaggtagtgttaaaattagccaaaagatgaagaaaccacttgcagacaaattatcactcttacctcatcagaaaattcagacatttatatactaaatttttaaagcaaaatataaactaagtactgctacattttgatttccttttttttttttcatttgtttgtttgtttttgagacagagtgtccctctgtcactcaggctggagtgcagtggtgtaatcactgctcactgcagcctcagcctcccaggcttaagtgaccctcccacctcagcatccagagtagatgggactataggcacatggcaccatgcccaactaattttttggatttttggtagagacagggtttcaccatgttgcctaggctggtctcaaactcctgggctcaagcgatccactcacttggcctcccagagtgcagggattacaggcatgagccaccacacctggccacatttgatttttattataaatattttcaaggaattgaagtgcaatttataaatatgagctaatcaccacttctataaaacatttttttccaaactcttcttcatagaaaaagaaattgaggcataaggtttacgtaattaattttcattcctaggaagactataaaaagttaaagctgcaccaagtaccatgggaagtccagagacatcatgatatacatagtgtggtgggttcccccaccctacccaccgtatcccacccccagagtctgagcaagaagccacaagtactgaggaaagagaagccacatgagatcactgcaaataacacgcagaggcaggcgacacagcaaacaccagggcagaaacaagctaagccaagctccagagaggcagccagatgagccccatccaacccctgctgaccaatcacatttcatttctgcatctgctatggaatggtttccaccaataatagggctactcgcacatgactagctggacatgtggctgtgcaatggtaggagacccagggcaaggggagtttgactcgtggtgtgcattggcctcccttaagacagcagtgttagcctcactgttgttatttttgctgctcagagtgcataggttggagccacagcagccccactttattcccattaaattcagatgaaacagacaccagccctcgttgccctgtgaagcatattacctgtctactaattgctgcttccagttcagggtaacctgccttgtccagaagaatatttggaaagagatcttcaatcaaactcaaaaacaagggttcatcctcatcaatctaaaaaaagaaaatgggaaatcagaccaattattctggtataaacatatcaatatgcagataaactggaaatgcccaacacagtccgggttattgcaatgtaaccactaacaaataacatatcacctttattgaagttaagaaacattttcctcatctttcccataaattaaaaaaaataaaataaagaggaaaagaacagggagaaaggaaagaaatggaaggaagacaatactgtctatgtgacaatctttccataaaatagtcagttttgggggataccatatagtctacaatttttaatttaaacttaaaagaatttttaaattagaaattaatagcaggtttgtgaattggaatttggtgtatacttttaatttaaaataaaaatctatcattttgtgaccctttacatagatccacggatagtgggcattgattatcagtctctatcgtgaaataatagtgtgaaactatcacacacttgtagagtttacacattatttcctaccaggctctaccagactccaaaggtgagatttgagttctaaaacacaaaaatgattcaaggtatttggcatcttaacatgtgtattttttaaaatccactgcaattctattggaataggcacattttggagtggataggaatcattacccaaaaaaatgtctgaaaaagtataatttaaagtgatgctctccagcactttatctgacaattaggcattttaaatgagcattttaaataaatattttgaagtctcatgtatgggcagttagtttaactgatatccaagtaggtggaacacttccatctgtgagtcttaccagtttagaaagattcatgtcccgtagtacacgcatgacaatcgtggactccgtatccattggattggctctttttgctgctcccaaggtccgaagaactgacagaatgttacgcaggccaaagtcataatgaacctagagaatgtgagatacattgggcttattttcaacattaaaatacttgcagaagccatatgaatctgacagaaattatattcacaataatgaataaatgctgattttccttcagaaaatgcatacacacaatggggtaaaatatttctatatagatatacgttttgagcaaatagggaatatcccaaagagtcctcccatgtgccatcattagcttaagcccttagatcagaactagctgctacagcttggcagggaaaaaggaataaatttcttcttggaatacagacatccctttgagcttattcttaatcaatcatacataaggaaatttgctcatatctctacagttaaaattcagaaccagaattaaactgggactgcactcatgactgtcatatacatagagatatatgtgcctttttcgtgataagtaagaagacaggagaatcagggagaaaaaaagcacctgcgcttcaggattacctgaaggaggaaggataaggacaaattagaaagctaagcccccagctttgtcattcccttactaaatatttacaaaagctcaattatgtcaaatttcagcatatataaagtgaataatcaaaatttatttatccaattattgtgaaaaacagtaaggtggttcctcaaaaaattaaaaacggaacgatatgatccagcactcccaattctgggtatatagccaaaagaattgaaagaatgtgccaggcacaatggcttacacccataatcccagcattttggaagaccaagtggggcagatcacttaaggccaggagttcgagaccagcctggccaacatgatgaaaccccatctctaccaaaaaattacaaaaattaaccaagtgtggtggtgtgcacctgtgatcccagctactcaggaggctgaggcatgagaatcacttaaacccaggaagcagaggttgcagtgagccgagatagcacttgcactccagcctgggcaacagagcaagactctgtcttgcaaaaaataaataaataaataaataaataaataataaaagcatggtctcaaagagatagcagcatatccatgttcatagcagcaccattcatgatagccaagaggtggaagcaacccaaatgtccattgacagacgaatggataaacaaaatgtggtatatacatataacaatattatttagccataaaaagaaaggacatcctgtcacatgctaaaacatgaatgaaccttgaggacattacactaagtaaaatatggcagtcacaaaaaatcaaatattatatgatttcatttatatgaactattggcaatagtcaaattcatagaaacagaaagtagaatgatggttaccaggagctaagggaagagaaaaagagaagttgttgtttagtgggcacagagtttcagtttttcaagatgaaaaagttacagagatctatttcacaacattgtgaatatactcaacattattgaattgtacactaaaaatggttaagatagtaaatttaattttatatgcttttaccacaacaaaaaaaatgtataggaaaaaactacagtcttctgctaaggtaattgggagcagtatgcctcacttaagactagtcatttggaagatggagcacataaaaaatattcaaattgagtttccaccttcagggaatttaaattctaataaagataataaaatagaaatgtgaataaacttgtataaaagtaacaatgacttaaaagtgttggtgagtaaacttaatcatgggaaacttcctatcagtgttggatgcagttaaatctgtgggcatgaagggaaagtcacagaatgttcaccaagacatcagtatgagtccaactattttgcacacattgatgtattacatttcactatgatcttgtgaacatgggtggtaggagtgagggaagtagtgaagtggtagtgaagataagagcaggagccagtgatgtgggaagttttctccattcaagaaacagcatggaaaaaatatttatttgaaagataagtgatatggtttggctgtgtccccacccaaatctcatcctgaactgtagtccccataatccccatgtgtcgtgggagggaccaggtggaggtaatgaatcatgggggtggctacctcatgctgttctcataatagtaagtgagttctcataagatctgatggttttataaggggcttttccccctcttcactcagcacttctccttcctgacaccacatgaagaagaatgtgttgcttccccttctgccacaattgtaagcttcctgaggccttctcagccatgctgaagtgtgattcaattaaacctctttcctttgtaaattacccagtctcaggtatgtctttattagcaacaggagaacagactagtaaattggtgccacatagagtggggtgctactataaagatacctgaaaatgtggaagcaactttggaactgggtaacaggcagaggttggaacagtttggatggctcagaagaagactgaagaaatgtgggaaagtttggaacttcctagagacttagagggctcagaagacaagaagacatgaaaacgtttgcaacttcctagagacttgttgaatggctttgagcaaaacactgagagttatatggacagtgatttccggctgaggtggtctcagataaagatggggaacttgttgggaactggagtgaaggtcactgttgctatacaaagagactggcagcattttgcccctgtcccagacatctgtgaaactttgaacttgagagaaataatttagggtatctggtggaagaaatttctaagcggcaaagctttcaagaggaagcagagcataaaagttttgaaactttgtgcccaatgatgcaatggaaaggaaaacaccattttctgaggagaaattaagccagctgcataaatttgcgtaagtaatgaggatttgaatgttaatcaccaagacaatggagaaaatgtctccagagcatgttagagactttcatggcagcccctccccatcacaggcccagaggcctaagaggaaaaatggtttcctgggccaggtccagggtccccctgctgtgtgtaggcatgggacttggtgccctgcatcccagccgctccagctgaggctaacaatgcctgtacccccattgtatctagggagtaactaacttgcttttgattttacaggctcataggtagaggggacttgccttgtctcagatgagactttggacttagacttttgagttaatgctggaatgagttaagactttgagggactgttggaagggcacgactgtattatgaattgtgaggacatgagatcttgaaggggccaggggcaaaatgatatgattcagctgtgttcccacccaaatctcatcccgaagtgtagttccataatccccacatgtcactggaggatcccagtggaaggtaatttaatcataggggcagttaccctcatgttgctctcatgatagtgagttctcatgagatctgacggttttataaggggcttttccccctcttcactcaacacttctccttcctgccaccatgtgaaaaggacgtgtttgcttccccttccaccatgattgtaagtttcctgaggccttcccagccatgctgaagtgtgattcaattaaacctctttcctttataaattaaccagtctcaggtatgtctttattagcagcatgagaacagactaatacaataagaatgagtgagtaagggctccaataagcagaagaaaccaagaatgttgggagacaaaatgttagggtcagactaaccagaaaggctcaatggccagagccagaagagtctgtgtgtgtctgaacactcataggaaaagaactttttagtaggaatgtaattaggttgaacctgtgggtataaaaagtaataaagattcaaagaagtttgaaattaaagcctaagtgataagatggaacaaagattatatatgttaggaagtgttattcatgttatagtctcatgtttattgcactgtgtcattatttagcatatatttctagtaatttttactgatatgtactaaaaaattgtggcatgatgcccacctcctggtggtcatgtccttatatgatatcaccttgagagtaggcaggacctgtgatttgcttcttctaactaatagaatacagcagagacaacaggttgtatgtgattatgtgtgtgtgattatgtggtcacattagattagactgtagcactcgttttgctgaaaccactttccttgctgactttgagaaagtaagtggtcatgttggggaaacccatatagcaaggaactatgcacagcctgtaggaactaaaggtggcctccagaaaatagccagcaagaaatcgaagccctcagtcttacaccctcaactaacagaattctgctaacaacctgagtgagctcagaagtagattgtccccattcgagcatcagatgaaaccacagccccagccaatactttgattgtagccttgttagacacaaaccacaggactcatttcagctaactcctgacccacagacaccatgtagtaataaatgtacgttgttacaagacacaaagtttgtggtatgattgttagatgactattatgcagcaatagataactaatgcagaactatatgtttaattccatgacttttaactatgaaacctcatgatgcctgaacctggtaccctaaacaatcgaggaaactagcaagaaggctgcaacatataaacaagacagttagtaaaccttggtcaaatactcaagtgagcttagaatgaagaagaataaatcattgggaggttcctacaaatcatgaaaatacataacacatataacaatgaatctataagtggtataaacagccaatgttaatatccataagtctttggctcttaaaccagtgcagataatattcacttcatttctatgctgtaaatattaatttatttaaatgtacttcttaaaaaactatgcatataaaattatttttgtagtaatacacctttctactcagtgtcaataaaatcctttgtcaacaagcccagtctagaatttctcaaaatgagaacattctgctgaatagaaaaatgaaacatgcctaagtgcataagacctccaggatgacacacctgcttagaaagctgctcctcacacagtttgtagagcgtgaaaaacttcctggccaaaacaacgttgtcaatgaagccacaactagccaacttcacccttatgataatctgacggtcaggcaccatcatggccactgagcggaaattaatcttcaagttttcagggagttcctgccgtccggcatagccaggattctaaacagaaaataaagcccaaggatgaatgatgcaatcaagcacacatcagcatcatattaaaagattcattatgtacacacaacaaatctggaatgacaaccagggaactcatttacgtatctcaatctcgttttacctggacaggctaagtcatgagctattcatatgatctttgcttaacaccaaaaggttttcaaaaggaggtaaagttacaatcccaatttccattcaggaaaacagatgacatatgaccagggagatgcatgaaaattgtgataagaaggctgaaattcagtagcttttctagcagctccttaccatggttaagaaaagcccaaattcagggttcatagtcacattatctccatcagtaaagataaaagactttttgtgctcctttttacatgtcagaataatggaaatttgctgggctgcaaccgagagaactggtagatcaatacggttaaattcatcaaaacaaccccaggatccagactgtgccagtccttcgaaaggaaattaaatgaaaaatccaattagtatataattttagaaaaccaagaaaaaggatattatgtagctgctaaaatgagccagatgtaagttcattcaaaagtaaagtgcaacaaatagatctatgcatcaagtgacccaaaacagcttacaatttggcacttcacctgtaaacacccaagataaaggaatatcaaaaaaaagtcaggaggaagtaacatttggtccacacaacctggcaagattgaagattttccaaaaaattttacaaagttgaaaatgattctaaaatgtggccaattgttgaaaacaaattttagcaaaatattccaccttggctgcaatttctcaccagattaaaaaatataacccatacccttaaaaatccgtccaagtcctcggaaatccatctggtctgaacaattgaaaaccacgacgtatttcccgaggcatcgtcccatgtctttagtggtttctgttttgcctgtgcctgcaggtccagcaggggctccccccatgctcattcccagagcttgagccagcgtgatgtaacatctgcatgggtagaaacatcactagaaccagccctcagtcacctggaaatacttctgagacatcacagtggcatgaaacgcacacaagattaaaaaacaaaaggccattgtccctacctaacatttcgaatacaacatcctaaaacacacttatccttatcaatgttaacatatgttgaggaaaaggagggggtagtctatgatcaactaagtttaaaaactccttaaaaggttaaacaggtttctttactgctgaatttttcaggctttcttatcataatatgcagagagaatctccaggtataaaaataatacattgcatttccaaaatgtatttggcaacattttcgcagaaatctacccccatctaaaatgtatatattctgtgaaacagatcgggatcctttcaaatagattaatccccttttgaatctaagagttggccatttgatgtagttgggatttaaaacacacactgctaaataatcacaccttgaatctatttctgtgagtatctactaaccttgcacatgctttcaattgcatcttactatatgagattaacaaataaaagatttggtgagagaatacaagaatgcctgcaaaggaaaatttttcacctgataacttgcagatcaattacttgtttgccagcaccacctggtgttaccaaaggagacaaattataaagtggtgccgtgtagggttttcttatggccaaactataaagcattcatccggacttgaaaaagacttccaaggaaatgaagtgactatccagcctgagcagtggaaatgaacactgagtgcaccagctgggggtggttccaggttctcaatgttactggaaacgagtgctataaaggcaagtaaatgactcagcccttaatgtatgcagagtctggatacagaggaaaagatctggtcatgaaatcaggagaatgcctgctctcactttgactctgccttttaacccaaggtattatttctcctgttgcatttttgccatcccttccaaagcagagtctgtaacaacaacagacaccacagtgtgctccacatgcatcatctcgtttcatccccagagaaccctggaaggaagctactgttcctttcccccactgtacagagataaggaaaaaggccacagagattgagtgacttttctcaggactgcggcaggacagctgagacaagccaagtcttctcactttccagctctgggacaagcccactctatccgggaaagaaaaataactaatgggcactaggcttgatacctgggcaatgaaataatctatataacaaacctctatgacacaagtttacctatgtaacaaacccgcacatgtacccctgaacttaaaaattaaaaactgaaaaaaaaagattaaataaaataccaaacacaaaaaagggaatacatctccatcaactctgatcactcggctgctgtgttatgcagaccctcgttacaactgagatcactgggtttatatttaaactgaacaagtagcaagttgcttcaaacagatcaatcctatttacatgaaaagcaggtgggcatgcctggagacttctccctggctcagctaggtggggcttcagacccactgctacactggtgcccaaactgcctttcggtgacaagcatggatctgtcacagcatctccctgtgtgtctagagaattctacatgtgagtgtatctcccttcttgcctcccttctctgctttcctttctagtctatctattggctattttcaaaaccgtttccattcatgaacagggtttgaactttatgtgttttagttgcctgtggtcaactccattttagttttctaaccttcagttaaactgctataaactctctgcggtcaggagctaggtttggttcacacttgtaccctcaactacttgcctaacccctggcaccttgtactatatgaacattggttgaataaatggcttgcgctgatccagtcattcattcttatctggtccctcctgtcccaacagctacaggaattagagatgcagaatgtgaccctgatgccaaatgaaaagcaaccaaccccatgaccccagggctcattagcactcgaactaaccaaatctatcaccagcattcatcgtaactattcatagcactgtcagtgcattttgtcacaggtaaaccagaaatggtttcaactcctattggttctaaactgctgaaaagtttcctaagaaacaatggtacgtgcatcagcagagtacatttcttccttgagaacttggtttagttacagactctttgattatagggcatgtttaaggagaaaccaaagacaaggttgctaaagaatgtgttatccaaaaaaaaaaaagaatgtgttaacataggccaagcacagtggctcatgcctgtaatctcagcactttgggaggccgaggcggatggatcacgaggtcaggagttcaagaccagcctggccaatatggcaaaattccatctctactaaaaatacaaaaattagctggatgtggcggcacacgcctgtaatccaagctactcaggaggctgaggcaggagaaccacttgaacctgggaggcagaggttgcagtgagccgagatcacgccactgcactccagcctgggcaacagagtgagtgagactccttcccaaaaaaaaaaaaaaagtgttatcagcaattttgacaagcaacagtgatagcaagaataataataataataacaaacatttgctgtgtcacgccctgtgctgggtacttacgttgcctctagtccacacaatgattcccaaacaagggaatgagggaggttaggtgtcttgtccaacactacacagctgctaggggcagagctgagcagtcagcactcaggcaacactcacagaagctgtgggaatgtcagagaaaggtacaagtcctgtctacatttcttatcaagcagataagatgcctccatcagccctcaatttcttctgccttctgcttaagtgacagcagtagtcaggacaattctagtcttcattaaaaacactacgagttttggagaaaagtgctgtatgttatcatattataatagctattttatcatctgaaatgtctgcaactctgtccacatggcattgagcttcccagaatccagggagctgccccagctgttaaattcacaggtcagtcagtgaagggctgacaacatgtcagtgcctccagcatttgactttttaaaagtactaatttcaatgaggagttttctcttgcaaaagggaagcaaatcttgcagtggaatctcagttactatcgaaaattaataactcacttcccacataatcaagttggttaaagaaaaataaacaaatgggcatttagggtaaacagacaaacttcagaatccctttacttacatacttgaaaatacttattttgcttttaaagttctcagttttttaatataaaaaaaatacaagacaatgaacacagtggaagaatcaaattgcagaaaagactgtaaactatgatacctatatgtgaaactgaaaaaggattttaatgtctaagcatccacagttttcagagggatagaaaataaactgttgatcatttttaaaaatagaaaagttttccctcccacacatgctacttcatgttcttctgtaccatgtaaatttttcaccattaagatgcaattttggaaataatcacttctttcatttattcaagaactatttatttagcatctgttatgtgacagaacaattctagcaaacaaatcacatgaagcccacgcaccaaggataagagggttatgagatttggagattgcgggaggtcgggagaccctctgaggtgactctctagcaggggactaaaggaagaaggaagcaagctatgccactattgaaggaagagggtgccaggccaagtgtataatgagggcaagggccctgtggcagggctgcgccacagctgtgcaaggagcaggtggcctgagctgaatgaggatagagaaacagagaagtagcagaggccagattgtaccaggcctcacaggcccacgtgaggacgttggcttttactttgcatgagaaggaaccatgggagaagttttggggcaaaggatctgacttacattctggtgtctgaactgagaacagactgtacgaggacaacgacagaggcagggaagccagttaaaacattgtcagaaggatgcaggtcaggataagagtagtaatgattcctataatcccagcactttgggaggctgaggagggcagatcacctgaggtcaagagttcaagaacaccctggccaacacggtgaaaccccgcatctactaaaaatacaaaaattatccaggcatgatggcacgcacctgtagtcccagctactcaggaggctgaggcaggagaatcacttgaacctgggaggttgcggtgagcggagatcgcaccactgtgatccagcctgggcgacagagtgagacttcttctcaaaaaaaaaaaatagtagtaatgatatagaaataactgtaggcagatagagagggtaaaaggagtcctcggtaaggtttgtttcttttaataaaagtagctcccgaaacatttcttttctaacagaaaagcagcttaaagagccaggccggcaagctttgatatgcaaatgctggtgattagaaactgggtccatccaacagggcaattcccaccctcttctccttgtcaccacgtgcgccaagcatcatggctgcctccagataactccatgtgtgcaggacatcattgcgatctgcatttacatattaaaaggctggggttggagggccagttttttcgagggctacatgaatgacacacctggtcaaaccaaaaccctaagccctatgcaaatcagacaccgcctcctccagcctcctaatataacctactgttttcccctgtttacgtggtttttctctctctgctcggagcacccctccctctgtctctgtactggggagctttttccttctttcttgcctatttaactttccaccccatgaaacgactccatgtgtgtccgtagcgtttatctaatcggcacaaggcaaaggaccctgctgttcctccagtcatcggagccataccagtaaggcaaaggggtgaaaatggtcacattctagaaggaacctgaaagcactgctgaccaaattgaaggtagattattggaaaatgaggtgagagagaaggaagggcttcagggttactccagggagtgttggattgcccatttggaggtgatgtattcacaggcttcaggggttcggacatggacatcttttgggggccattatacttactatcacacttccccccagcattctgataaaatggaatggccaacttgctaaaatgaagacaacagcaggagggcacttttgtgaggctgatcaaacacgctaaggttaaatatactgtaagcaaccaacagacatgtcacataggcaaataggtatgtgtgtctggagtttgggagagaagccctggtttgaggcagagtttggggtttttgaagccatgtgggatcacctaaagaatgagtagaggtggagaagagaagagcctggcagttctatgtttaaaggtcagaaacatgaagaggaacgagtaggagcaggtacaaagggacatccagaccactgggaggaaccaggtgagtgtggtgtcctggaagccatgtgatgaaagtgtatcaaaaaggagagaatgatcaactgctcccatgcagctgattgctcaagaaagacgagatccaggaaaaaacactggatttagcaagaggtctgggtgactttcaggagagctgttttatcagagtgatgcggaaagtatgacaaaataatggtccccccaaaatacgttctaatctctgcaacctgcaatctgtaaacatcttaccttccacagctaatgggactttgcagatgtcattaatgttaaggaccttgagaagagggaattatgttggataataaagtggactcaacctaatctcatgagtccttaaaagcagaagagataggtagaagagtgggtcagagacacaagacagaagaaggaggggagattcaaagcacgaaaggcacctgacccaccactgctggctttgaagatgagggaaggagtcaggatcaaggaacgtggtagccttcagaggctggaacagccctgagctgacctaagacaatggggacctgggtccttcaaccaggaggaaaggaattctgccaacaacttggaagagcgggaaacagaactcagtctctgggaagaaacacagccctgcagacacctgattacaatcccgtgagacccacgtcagacttctgatggacagaactacaaaaagaacacatttgtgtggttcaagcttctaaatttatggcaatttgttatggcagcaatacaaagttagcagagagcctgaatgaagtgagttgaagaaaaacaaggtggagagaaactgtgcttttgaggggttttgaagggagcatggagtgggaaggaaaccaggacaatcacggtagggttcgctgggtagaagcaatctcagcatatttgtgtgttgatgaaaaggattcagtagaaagtgaaaatggatgttgcttccagagaggaaatcctggagtcagtgggggtgttggctttggacagcgaacctggagagaaagcagctgcatgagaacaggcacccaggttaacgcacatggtggtggagatgaatgcgtctatcttctcaaaaaaaaaaacatgaaataaggccttcggtggagacagaggaagacaaggaagtgctggagacttgaaaggcagaagacataaaataaccacataagcattttatgagaaattcctatttgggaactccacttttttttttttttttttttttttttttgagacggagttttgctctgtcacccaggctggagtgcggtggcatgatcttgtctcactgcaacctccgcctcgggttcaagtgattctcctgcctcagcctcccgagtagccgggactatggccacgtgccaccatgcctggctaattttttgtatttttagtagacacaaggtttcaccgtgttagcctggatggtccccatctcctgaccttgtgttccacccacttcggcctcccaaagcgctgggattacaagcgtgagcgagccaccatgcccagtccatttttttaatgaacattatttctaatgggcaaatcgtcattgtatattattgtggggcacaatgtgatgttatgttatatgaatacaatatggaatgattaacgcaagccatttgacaataatgagcattcagtgcatacctgaagcgaaaatatacaatgtagttgatattacaaagttcaaattagactaagcaaatcacagaatattagccctgcaagcacccttagagacaacatagctcagggtccccagcccccaggccacagaccagtattggagctgaatgaggacagagtattggtccatggtctgttaggaaccgggccacacagcaggaggtgggcggcgggcaagtgagagaagcttcatctctatttatagccactcccatggctcacataaccgcctgagctctgcctcctgtcatatcagcggcagtattctcataggagcacaacctttattatgaactgcacgtgaaccctatcgtgagctgtgcatgtgagggatctaggttgcccactccttacaagaatctaatgcctgatgatctgtcactgtctcccatcacccccagatgggactgtctagttgcagaaaaacacactcggggctctcactgattctaaattatagtgaattgtataattatctcattatccattacaatgtaataatagaaataaagtgcacaataaatggaatgagcttgaatcaacccgaaaccatcacccaccccctggtctgtagaaaaattgtcttccacgagaccaatccctggtgccagaaaggctggggaccactggcttagctcatcttacaaatgaggggactgaatctagggaggttgcagtggcaggtgtcactaacacaacttgtaaatagcaggccaagggaagagttaacactctggaggcctttccagtgccctctcccaacttttacctgcattgatactcaatttctttcctgcttaaaaaaaaaaaaaagaaaatcttaattgtctcccagtaagaacagatactcaagcagcccccgcaaggcccactgtgatttgcacctgacaacacacaaaaattaattccctttcttgcccattctctgtccacacagtgtttacacatttaaactctgcctctataagactgaaggcaaaggaagcaaggtctgtgtcagtcacaaacctaaatcccatgtgaaaagaaagctgataataaagctaaaaatactaaatttcaaaggttttagtataaagagcctataaaccctaagagactttaagcaaaaatcccctgagcaactcgagagaataaaaatggtgggggttggggagaagggttccatcacctgtctgtaagtggagttattacaagcctgtcagtgcagcctaaaaattcattctggtatatgaacgccacatctgtgatgtgaatcatcatcttgtcagaatcttcgttaaagtaaaatctgcactgtttcagccactcaaagtccatgggactcttgatatgcatatgacactgaaattcaaaaggtatatgttagagctctgatgagaatcactcattaaatatacacgttattagcattcatgtagatcataaagtgaaataaatgaaactcacagacaaccgaactatttcacaggtgtcaactgtatcaccagccaagctattcatttattgatcagtaaaaaagaaactagaagatataggaataagaaaactcaagtgaaacccctaattatgcctctccaatttaagtgcctttacgtattttaataataagatattaatttcttaaatttcaccctgacatgcctaatgccatagtcctcaccatgaaatataatctatgaaaagcatgttttgacacacaaagacagcaataaacaatctcattaggaaaaagacatctcttaagactataacaaagtacgctgttggggttttttaatccagtaattatttttcccaagaattacatcgggccaaaatttctaacatctaaatgacaggccattgcctggaaatgcttttgtccagattttttaaccaaaattttaagccactttcatcattttctttgacaaagaagaaatctaaaattagcctgagccctttattcctcggaaaggtaagtagtgtgcttaactattaagacaggagattagcacacaatagctttgatgtgctgcctttacttccattatatcaggaccaatctttcataatcttttttacataatgggatgagacaaatccagaaaattattatgagaataagagctttttgcctctaatttattttatagtagaggacaaatttcactttttatttcccattttctatagctacacaactctcttttcccaccttgttctctatttaaaagcaaaaatgtgtaacacctgaatgtcagaagctctattaggaaaggccatttgcaatcaatgacataaaatgtagcaaaacttgttaagaatgtgatttttcaaaaggcttaagggaagtcctaaacagctctactaagcaatattactaataattttcatagcaagaaactggtgatcttcaattaataggtaaaaagcgaaaaagatgtatgaaggcttttcagatgctacatgacaattttaacattaaaaatcatcacgttaaaacatttttgaataaagtctaattgcctcaataacatcttagcatagatcatcagaatatgacttacgttcagttaagactgaaaagaaagctgataagctctgattacaaacatgattctttgccagaatttaattttttccttgaattcaatcaaactagttctactgggtaaatgcagatagtgtctagaatttgtttttctctacatgccacagcatttataaagaatttaccaggtcatcaaagatatccctttggtgcacatgaatagtaatcagagtctcgtatttcactcgttccgtggaactcagatccctcgtggtgacgtctatcaatgtattgagtagctccaggaaagcctgattagttttctgcatgatttttttatcaaacttggcatttctaagggcttcttctgaatcccgtgtccatatcatctgaattcctaataatccaaccttatggaaataaaaaaggcttcatgaatttgtatggcatatttatgtatttaaatagaaatacaatgtgatcaacagctgtgattgttacacaagtgtaaagccatgattacatcaactttgataccttttttcataacctatggaaattctatttcttatcattttgagtcatttatgttgaagtcacgtttctcattgtttcctgtattttaatgctgaatctatttttctttttttagtaaagtgttcaatcagtacattttcatgatttttgtacattgttacatcaaaagattgattagggaaaaaaccgttttaaattaaagacaatacatcaaatatatctataacccaaatacacatttaagtctatagatatatgaccatataatctgtagttaaaatctgaaaggttaagtatatttaatgggtccttatgaaaatcttaatactggtctagagttaaattatagccatttttgaagcttacaataggtaatgtctgagacttaaaatgactattttacaaaacatactttcaaatttcaatacactgacctgagcagggaaggatgaaagaaattcagttagttggaaacctgtttcttgaatatttgcggctgcctggcgaatcacaagatgcaatgaggactgagattcttccaaaagagaattaagccaaacttccacattgccctctgccatgacaggtttatccaattcaatcgtctcaccctcttgagaggaaattgacagaattcgatcatagatctatgttagaaaccaaaaaaaaaaaaaaaaaaagctatagtcatataaaaagtaaaaactaattattgacttgtccttcccaaagaaagtaaagctacagattataaaatactgtaaaagccaaatataaactacttcaaaacaataaaaaaaaaagccatgaaatctaaaaggcaatacaaaatcaattccaggccaggcacagtggctcacacctgtaatcccagcactttgggaggccgctctaggtggatcacctgaggtctggagttcaagaccagcccgggcaatatggtgaaaccctgtctctactaaaaatacaaaaattagctgggcatggtggtgggcgcctataatcccagctaattgagaggctgaggcacgagaatcacttgaacacaggaggcggaggttgcagtgagccgagatcatgccattgcactccaggctgggcaacaagagcgagactccgtctcaaaaaaagaaagaaagaaacagagcgagaaagaaaagaaaagaaaagaaagaaagaaagaaagaaagaaagaaagaaagaaagaaagaaagaaagaaagaaagagaaagaaaagaaagaaagaaagaaaaagaaagaaatcaattccaaataaaccatactgtaaggggggaaacttatttttaaaagaaatatttaatacaaatatgatgatttttaaaatctctaaagtttctcagatgaaatgaggcttctaaaacctaaagtgctgtactaagtcctccttagctgtagacagacgtgatctaccaaaaagctaatgaggcttcagtttcagggcccctcacttacacagaccctttccaaggtcctgaatatgaatttgtatttataattttacaagatttagcacccacacaaccaaaatctgcccccgattgtagaaaccttatggcaggagcaacaaaaaacaaaagcaacgcgatcttaagaaacagctgctaagaacaaaggctaaaagtctgtgggcatttaattcacaaaagggagctacacagtaaataagatactgaaagacacttaaattatcttccatacaacttgagacagtgagaagctttgctcctgggccatgatgtcctagtgccatggcagaggatttaagcgaaacatcagaaagaattttctgatgaatttagtcccttctttcaacccacacatcccataaaacaacaagaaacattgatttttgaaccattaaaatccatcctgttttccttcctctctgtcccctctaacaaagccttgttacagctgttcagccttttttatcctgattttgcaatggcttcttacattgatttccttgccccctttcattccgcctcctacactgtaccagagaatgtttctgaaacacaaatcaggtcactgccctgcttaaacacctcccatggctttttatcatgttcaggatgaagctgaattccgtaatgtaatgcacctggcctttggaatcctgcccatcccccttctctctttgctcatggctccctgttgtgggttgaattgtgtctctcaaaaagatatactgaagtcctaagccctgatacctgtgaatgtgacattatttgggaatagcatctttgcagatgtgatcaatttaagatgtggtcacctctagcctccagaactttgagagaatacatttctgttgttttaagccacagcagccctaggaaactaatacactccctcacacatccacgctgctgacatcctgggcttcccacacttccgagcgcccacacctcccttgcacatgctcttcttctgacctgaccatacttcccttcttcacctgcaaggttatattctacttaccttcaaaacatcagtgcaaatttatattctgcagaaagccctcccggacacccccatacaaccaggttccctgatgggcattctcacgttctttgtgcttaatgaagcacaataataacaattcaagtccaaaattatcagcaatttaattgtccaatttctcttgagtgtagtacataaaactgacttcagcgttgatcatgatacacccttcctgggaaccccaggccagcatcatgactctcagacagcaaggagcttgaccttaacaagtggcttttaattgcttcgaatggaatagctctaacactccctaactgggctctgaaggctacttgtttacttccctgtctcctccaccacagcacaagttcatggaaggttagcgtattcccagtgttaagcatgacatctggaacatggtagttgctcaataaatgtaacaccacatgctaggatgaagaaatggatgttactaggggtttgtatgaagcaccagagggaaactgaatacaatatctaacaagaagagtcactttcctagggaatttgggtggagggatggattagacaatagatttccgcagctgtgcaagtgtagtctccgtcaagttaaatgacctatcgtgagtctcatgcagcttcatgattctgtacacatggaagtgttaaaaaaacaaaaaaagtttgaataaagtatgccaaaaccagattaaaacaattacatcatgagggcaattccgtttagttaagacgctattttatgaacagctggtttttcatcttgttggatttcttactagttaacttggtgtgtaaaatcatgaatgctacataaatgccttcttaatcctaaactagcattttttttaatttgaatctacactttggatagtaagaaattacacagttctgaaggtaaattgggccccgagatttgtttttagtcactggccaagagctaatgaacagggaagcaacccttgttataaacccgttttcgaagagctacttaaagacagttgaggttcgaaggtacggtgattgttggcctgccattagaattaggcgaaccttttcgtggaacttgacagatttaatgttgtcaaacacattcagcaaatgggcctgtatagtgtgggagtccgacgcctgccccagaatctctagaagggcaggatctgagacgaagaaaaaccgaggaaagcacagtcgttttttctccaagtacctacaaggagaggaaaaacataaacctttataaccacacaaagctggtcgttcaaggaataaattaacctggatgggaaaaggggagaagattgtgtgacttgtgacaatctgattttcctacgtgacttctcactgtttttaatttttcaattttttaagaatgttttcaaataacattccacattctgatggagaaataattttttcccaaaattggtggcagaattccctcatttttcacaactataatgtacacattttgcacagtctggaaaatcttgtatatactaggtagagagtcagataaaaacactatgtagagagtaagataaaaacactatgtagagagtaagataaaaacacacccaggcaggttttggttttgggtttgggtttccaagcccagcactgtgccatctaaaagctccctacaatacttgaaattgtgacttaaaagagaatccaatgaattcgtcatccaagcagaagcaaaacccagctgtgacgagctccatggaaaagctgtggcactcgtctctgcttccaggagtttccaaaatccactgaatgttcccgatcactgacttgctttcagccgagctttcatttctatatttgctttctgttatggtcattcctgatgttatggatatgtgtattctgttgttttcttaactatagctctctatcttcattttctagcatattttgttataattatgatgcttttaattgtacttcttttttaaactttaccagctttttaatttttattttttttaatttttgctcttcccttatcatttgtattagtattcattttagccttttttgacctttttttttttttttttagacagagtctcagtctatcaccagggctggagtgcagtggcatgaccttggctcactgcgacctccacttcccgggttcaagtgtttctcctgcttcagcctccgaagtggctggaactacaggcctgtgccaccacgcccagctaatatttttttttttttttttttagtagagatgggatttcaccatgttagccaggctagtctctaactcgtgacctcaaatgatccatctgcctcaacctcccaaagtgctgagattacaggcatgagccaccacacctggccccaactttttattttaggttcaggggttcatgtgcaggtttgttatacaggtaaactgcatgttgggaggttggtgtacagattattccacacccaggtaataagcatagtacctgataggtagttttccaatcctcaccctcctgccacctccaccctcaagtagaccccagtgtttgttgttcacttctttgtgaacattgtattatttcctgtgtaaaattataaggaaacatttctgtttcataacagcagaattcactttctaggaaaaatcaagtctttactagaggattacttggatcagaaaccggagcctgatggcaacctcccagggcatgcgtgcggagtgctggacagttcacgattcgtcaactgctggactcgttttgctgagtggggtgtccaggctgaggacaaatctgagctacattcctcaagacaaaggagggcactcattgagaaaaaggcaaagaaaagaaggagatacaaagagagggtcatgctaagtaaggaatttgggaaagaaatggacatgtgtacagggatgatcatggataagcctgggcatgtgggttgaaatcattctatccagctctcacaggatcctcagtaaaacaagctcttgcagcgatgggatttgttcactttggacatgagacagcctggagagtctattttcttctattccccctcactttcttaaagtcttacttaaatgtttataatgtttacttttgttttagctaaaaaactaaacttttctcagtttaaaactactaattctgttatttcaaatatcccaatccttatttgaataactgtgatgtgtttgttatcctccttacagtagcccggtctgattctggtgaggaattgggtcatgttttctgtcccgttagaccagtatggaaggaggctgtggtgtgtgacagccaaactcctgagacggtatagagaagataccttatcttcacggacacagtctgattaccgcaactccgattacgatctgatctgtgtgaagacccttcctgtccatgctgatcctcgacagcttgggagggtgttgtttttgtataaatatgatttctcaaatgtctatacaaggcttacatatattgcttataacctcttctgggtaacaaaatcaaaagacagggaaagctcagttaaaaaaaaaagtgtgaacaattttagagtagacattttctctgcaggggttataaaataatgccaaaatgttgggtgacagaatagaatatgttcatagaaaaaagaaagaataaaaaaaaagaaaaataggccaggcacagtgactcacacctgtaagcactttgagaggccgaggagggtggatgacctgacatcaggagtttgagaccagcctggccaccatggtgaaacctcgtctctactaaaaaaaatgccaaaaaatagctgggcatggtggcatgcccctgtattcccagctactcaagaggctaaggtgggagaatcacttgaacctgggaggcggaggctgcagtgggctgagattgcaccactgcactccagcctgggcaaaagagtgagacctcatctcaaaaaaaaaaaaaggagaaaaaaaaaataaaggggggatttcgcatgtgtgtgtgtgtgtctgtctgtctgtctgtggtggtgggtggaagatgaggaagggagagaaaagcaataaactcagctgtaggtagtccagtagacagttcctcggcaagtgttttagtggtaactgaacctgcatgatgtcttagtggtccctgcccctcagtccttccatgttgaagaacctccagagcagggaaactttcagaaacccttttctcgttctctctgacctgatcctggtgttaggcacagagcattcctgctgggtctatatccaagaactgtttagtggtgcctgaactgcatttggtcatgctaaataattattaggctaaatggaatggcgcagcatcaatcattagacaacaatctttttgtccttcaacagttacttgacttgatctaataattttataagggagatcaactcattaatccctaagactccatttttctaaatctttatgttagaagaattacttgcaaatggttttgctttaaagtaaacaaagggtgctttactgacgttggcgttggctatggccatggtgtttaaaaagcctccttaggtttatggtgatactctatggcagcagtcctcaactttttgccaccagggaccaatttcatggaagaccagttttcaatttttccatagaccaggggtgggagtagtttcaggatgattcaagcgcattatatttactgtgtacttcacttctattattattgtgcacttatatttctattattattacataatgaaataattctacaactcaccataacgtagaatcagtgagagccctcagcttgttttcctgcaactaaatggtcccatctggagatgatgggaaacagtgaccaatcatcaggcattagattctcacaaggagtacgcaacctagatccctcgcatgtgcagttcagaatagggtgtatgcgcagttcacaatagggcttgcactactatgagaccctaatgttgctgctgatctcacaggaggcagagctcaggtgatattgcgagtgatgaggagcggctgtaaatacaaatgaaccttcgctcactcacctgctactcaccttctgctgtgcagccctgttcctaacaggccacagactggtgccgaggtttggggacccctgctctatagcataggcctttgaaacacccatcacctaaattagagtaaacttgcaaatatttgctacagaaaatcttggccctacctctagcttcaaggtagtggggtggacaaccatgtacgcatggttttgtttagacttttttttatatactttaagttttagggtacatgtgcacaacgtgcaggttagttacatacgtttagactcttcaactttcctaaaagtccacaaacttccacatctccccagctgtatgctgaagcctgtgaatttgtccttaaccagcagtgcagactccctgtcctctgcattcttgtcagggtttacatctctcacgttttatgctgcccaataccttccaccaacgtggatatgaaagtaatattcatggaggattcattgaaatgtatgcggtgattccattcccttagttccctgaatgaagccattccattagagaggctcatgtttgactcatgctgtgataagaaagcagatggagactccgctctgggttccttttaataggatacacaatagaaattcctccaaattaccaatttgaggacaacaaaacgtaatgtctccccaggtaacttttattctatgaatcctatgaacctatcatatgccaccctttaccttggaacctaggaaggatctttgctctataaatctaaggtccatttgtagtttttctctgcaccaattttaccctctgagcttattagccctttttgtcctttgaccttaactttctcatgcattgttattttccagcagccgtctcaaatttttttttggttagccgagaataaataagtaatccacattgcttacaagtaccctcttacaggtcttttttccatttttagcatagtcactttttttgttcaattttaataaactcctctctttatttcatcgagatcctgccaaagcaccatttgaagcccagtatttaagccatcaactgcatctatgagggcagcctggcttagatgacctgagtcccgcagtgcacaggacaagctggttattcacaggacactattacaggtcatgaggccatcaggatgtattcatggggaaagatcaactgtctcccagagtgggccaaggagacatcattatttaagttaaatgctcaggtgcttgagtttaacttccttaagtgtcaatgtacacttagcatattactatgtaacatatttctacttacattattttattgtgattaaccaaaggaaaaaaaaacaaacaaaaaaactttatgactcttggaattcacaacgcttctgtacacataaatgtgtgtgtagatagatattagacactttttaatataatcctgactgcatgtatatactaaacactgtttcatataatgagtataataaaatatgttggttctataaatgtttattcaagaagaatgtcagaaaataggtgtattaattttttaaagcagggactgtatgaggatgtttatacagtcttatcccagtgatggaagcaaccttaagtcctatgagtccaacatcaggacaaatctagcaagtctttgatgagaatataaggcttcaaaatatcagtttcatctgtgcaacagctttatatataaattcagccttagcaaaagaaaacaaatttggctaatgctatctagtctccctgtatccttttgtctcaaggataccgagagctttcaaagagccagtgaacttacccagtaagggatttctggcatatttccaactggtccagcaagtgtggtaacagctgccccagggtctcatctccaacacagcactggactacactgggcacttcatgtgcccgagtcatgatcttcacccaagatttatctatgttagaaaaccgcttggcttcctatgagaacaaggtaacaaagcacacttagatttggacacatctgtgatcccaaagacagtatctcacattcctccagctgaggctagagctttaaccagtccagatatccaagcaatatatgcctaatgtcacacacattttattgaagttcttattgggctttctgtgccatatcatcccctgtattaagtaagcatccttagctcaaccttggtactcccattatgttaagttacaacaagaaatgaatacaaaagtaataatacaattcaaggaaatatgaaaagaaagtacacacatttcttttcacaggttatctctaaatgaagtacatttcctatttttatattttctctattgagcactggattgtttatgtagaaaaaatatttaaaaataaagatacaaaattaattccagtataactggaatattgtaaaaaaatttaatggaaaatgcacagattatcttgagagggcaggaatcatataaattttcttccttttttaagacaggtctcactctgttgtccaggccagagtgcaggtgctcggtcacagctcactgcagccttgatttcctgggctcaagtgattctcctacctcagcctctccagcatctgggactacaggcatgtgccaccatgcctagctaaattttttttattttttgtagaaactgggtttcatcatgttgcccaggctggtcttgaactcctgggctcaagcagtcttcccacctcagcctcccaaagtgctgggattacaagcatgagccactgcacccggccccaaattttcattttcttctttaaagctttctgtatgtcaccaatgagtatataccatcaaatatgaaaggaagaaacaacacctagcaccttaaatattctacatgaaaatttctaagtccaattttagattcttcttcatccattaaaaagaaaaacatgggaatcctgggcaagatggccgaataggaatagttccaccctgcagctcccagcaagatcaacacagaaggcagattatttctgcatttccagctgaggtacctggctcatctcattgggactggtcagacagtgggtgcagcccacggagggcaagtagaagcggggtggggcgttgcctcacctgagaagtgaaaaggtttggggaactctcccccgagccaagggaagccatgaggtaccatgctgtgagggacactgctatctggcccagatactatgctttccccatctgcagaccaggagattccctcaggtgcctaccccacaagggcctgggtttcaagcacaaaattcggtggccgtttgggtagacactgagctagctgcagttttttttgttttttgtttctgtgatggagtttcgctctttttgcccaggctggagtgcaacggtgtgatctcagctcactgcaacctccgcctcccaggttcaagcgattctcctgcctcagcctcctgagaagctgggattacaggcatgtgccaccatgcctggctaattttgtatttttagtagagatggggtttctccatgttggtcaggctggtctcgaactcccgacctcaggtaatctgcccacctcagcctcccaaattgctgggattacaggcgtgagccaccacgcccagccagtttattttttttttcgtaccctagtggcacctgggatgccactgaggcagaaccattcactcccctggaaagggggctgaagccaggtagccaggtggtcttgctcagtggatcccatccccacagaacccagcaagctaagatccactggcttgaaattctcactggcagcacagcagtctgaagtcgaccgggaatgctccagcttggtggggggaggggggtccaccattactgaggcttgagtaggcggtttttccctcacagtgttaacaaagccgcaaagaagttcagactgggcagagcccactgcagcaccacaaagctgctgtagccagactgcctctctagattcctcctctctgtgcagggcatctctgaaaaaaaggcagcagcctcagtcaaggcttatagataaaactctcatctccctgggacagagcgcctgggggaaggggcagctgtggggtacagcgtcagaagacttaaacattcctgcctgccagctctgaagagagcagcagatctcccagcacagggctcgagctctgctaagggacagactgcctcctcaagtgggtccctgaccccgtgcttcctgacagggagacacttcccagcaggggccaacagacacctcatacaggagagcttcagctgacatctggcaggtgcccctctcagacaaagcttccagaggaaggagcaggcagcaatctttgctgttctgcagcctccgctggtgatacccaggcaaacagggtctggattggaaccccagcaaactccagaagacctgcagaagacgggcctgtctgttagaggaacactaacaaacaggaagcaatagcatcaccatcaactaaaaggacgaccacacaaaaactccatccgaaggtcaccaacagcaaagaccaatggtagataaatacacgaagatgaggaaaaaccagcacaaaaagactgaaaattccaaaaaccagaatgcctcttctcctccaaaggataacaactcctcgccagcaagggaacaaaactggacagagaatgagtttgacgaattgacagaagtaggcttcagaaggtgggtaataacaaactcctccaagctaaaggagcatgttctaacccaatataaggaagctgagaaccttgataaaaggttagagaaattgctaactagaataaccaatttagagaagaacataaatgacctgatggaactgaaaaacacagcacaagaatttcgtgaagcatacagaagtatcaatacccaaattgatcaagcagaagaaaggatatcagagattgaagatcaatgtaatgaaataaagcgtgaagacaagattagagaaaaaataatgaaaaggaatgaacaaagcctccaagaaatatgagactatgtgaaaagaccaaacctacatttgatcgatgtacctaaaagtgatggggagaatggatccaagttagaaaacactcttcaggatattatccaggagaacttccccaaccaagcaagacaggccaacattcaaattcaggaaatacagagaacaccatgaagattctcctcaagaagagcaaccccaaaacacataatcatcagattcaccaaggttgaaatgaaggaaaaaatattaaaggcagccagagagaaatgtcgggttacccacaaagggaagcccattagactaacagtggatctctctgcagaaaccctacaagccataagagagtgggggccaatattcaacattcttaaaagaattttcagcccagaatttcatatccagccaaactaagcttcataaatgaaggagaaataaaatcctttaaagacaagcaagtgatgagggactttgtcagcaccaggcctgccttacaagagctcctgaaggaagcactaaatacagaaaggaaaaaccagaaccagccactgcaaaaacaaaccaaaatgtaaagaccattgatattatgaagaaactgcatcaactaatggacaaaataaccagctagcatcataatgacaggatcaaattcatacataacaatattaaccttaaatgtaaacggggtaaatgccccaattaaaagacacagactggcaaatttaatagagtcaagatccatcagtgtgctgtattcaggagacccatctcacgtgcaaagacacacataggctcaaaataaagggatagaggaatatttaccaagcaaatggaaagcaaagaaaaagcaggggttgcaatcctactctctgataagacagactttaaaccaacaaagatcaaaaaagacaaagaagggtattacataatggtaaagggatcaacgcaatgagaagagctaactatcctaaatgtatatgcacccgaaacaggagcacccaggttcataaagcaagttcttagagacctacaaagagacttagaatcccacacaataatagtgggagactttttttaacatgttaaagaaatgtttaattacaaaattaagcttacacataacctaaaaattttcaaatgtactgcattttatagcataaaagtacaatcagtaaaatgattcactagtaatttaattacatttaacttaattttaagtaaaataaaaaatgcttctctctcactatgatgcagaatattactctgaacacctacctcatgcatcactcaatatgaaaagtaaactaacaagaaccactccacatagattttcatcataaatcttacattttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccataaatcttacattttaatgcccatactcttcaatagtgggagactttaacaccccactctcaatattagtcagatcaatgtgacagaaaattaacaaggatattcaggacttgaactcagctctggaccaagcggacctaacagacatctacagaactctccaccccaaatcaacagaatatacaatcttctcagcaccacatcatacttattctaatatcgaccacataattggaagtaaaacactcctcagcaaatgcaaaagaatgcaaatcataaaaaacagtctctcagaccacagtgcaatcaaattagaactcaagattaagaaactcactcaaaattgcacaactacatggaaactgaacaaccagctcctgaatgcctactgggtaaataatgaaattaaggcagaaataaataagttctttgaaaccaatgagaacaaagacacagtataccagaatttctgggacacagctaaagcactgtttagagggaaatttatagcactaactgcccacaggagaaagtggaaaagatctaaaatcaacactctaacatcacaattaaaagaactagagaatcaagagcaaacaaattcaaaagctagcagaagacaagacataactaagatcagagcagaaccgaaggagatagagacatgaaaaacccttcaaaaaaatcaatgaatccaggagctggttttttgaaaagatcaacaaaacagatagactgctagccagactactaaagaagaaaagagagaagaatcaaatagatacaataaaaaatgataaaggggatatcgccactgatcccacagaaatacaaactgccatcagagaatactataaacacctctatacaaataaactagaaaatctagaagaaatggataaatttcttctagaaattctaccagaggttcaaagagcagctggtaccattcctcttaaaactattccgaacaatagaaaaagagggactcctccctaactcattttatgaggccagcatcatcctcataccaaaacctggcagagacacaacaaaaaaagaaaatttaggccaatatctcttatgaacatcaatgcaaaaatcttcaataaaatacaagcaaaccgaatcaaacagcacattaaaaaggttatccaccacaatcaagtcagcttcatccctgggatgtaacgctggttcaacatatgcaaataaacataatacctcacataaacagaaccaatgaaaaaaccacatgattatctcaatagatgcagaaaaggcctttgataaaattgaacatcctttcatgctaaaaactctcaataaactaagtattgatgaaacacaactcaaaataataagagcgatttatgacaaatccacagccaatatcatactgaataggcaaaagctggaagcattccttttgaaaaccgacacaagacaaggatgccctctctcaccactcctatccaacatagtattggtagttctggccagggcaatcaggcaagagaaagaaataaagggtattcaaataggaaaagaggaagtcaaattatctctgtttgcagatgacatgattgtatatctagaaaaccccattgtctcagccccaaaactccttaagctgataagcaacttcagcaaagtctcaggatacaaaatcaatgtgcaaaaatcacaagcattcctacacaccaataatagacaaacagagagccaaatcgttagtgaactcccattcacaattgctacaaagataataaaatacctaggaatccaatttacaagggatgtgaaggacctcttcaaggagaactacaaaccactgctcaaggaaataacagaggacacaaacaaatggaagaacattccatgctcatggataggaagaatcaatatcataaaaatggctatactgcacaaagtaatttatagattcaatgctattcccatcaagctaccattgactttcttcaaagaattagaaaaaactactttaaatttcatatggaaacaaaaaagagtccatatagccaagacaatcctaagcaaaaagaacagagctggaggtatcacgctacctgatttcaaactatacttcaaggctaccgtaaccaaaacagcatggtactggtaccaaaacagatatatagaccaagggaacagaacagaagcttcagaaataacaccacacatctacaaacatctgatattcgacaaacctgacaaaacaagcaatagggaaaggattccctatttattaaatgatgttgggaaaactggctagccatatgcagaaaactgaaactggaccccttccttacaccttatacaaaaattaactcatggtggattaaagatctaaacataagacgtaaaaccataaaaccctagaagataacctaggcaataacattcaggacataggcatgggcaaagacttaatgactaaaacaccaaaagcaattgcaacaaaagccaaaacagtgtggtgattcctcaaggagctagaactagaaatgccacttgacccagcaatcccattactgtgtatatacccaaaggactataaatcaatctactataaagacatatgcacacgtatgtttattgcaacactgttcacaaaaggaaagacttggaaccaacccaaatgcccatcaatgttatactggataaagaaaatgtagcacatatacaccatggaatactatgcagccacaaaaaaggaggaatccatgtcctttgcagggacatggatgaagctagaaaccatcattctcagaaaactagcacaggaatggaaaaccaaacactgcatgttctcactcataagtgggagttgaacaatgagaacatatgggcacagggaggggaacatcacacactggggcctgtcagggggtgtggggcaaggggagggatagcattaggagaaatacctaatgtagatgacaggttgctgggtccagcaaaccaccatggcacctgtattcctatgtaacaaacctgcacattctgcacatgtatcccagaacttaaatataatttaaaaaaaaaatccaaacctcctacttaaaacctttaagaaaagaagatgaaaaacatgcacaaatacaaatcaaaaataaagtaaaattttagtgagtgaatacatttcactattgcctccaaaataaatggtctgcagtctgattttatctgtcatctgtaattaaactgaaaactaaccaaaaaagaagttcagaaacctatgtgatgaaaacatttaaaataatcatgcttctaaaactgaaatatattgttaaaatgttataatcttgcatacgacttaaggtaattgaataagaatccttgagaattggttaaaatgttcatttaaaaatctcaaaatatactccatatatacccagtaagatgattacgatttgatgataaatatatacttgacatcttgaaaagaaggtctttttgttttggagattttttctgcacatttccacccctcaattttactgtacagatataattgggtacattgtatagtatgcattactttaaaatgtctgtagtagaaaaacttagcctaccattgtcaagataactgcaccataattctacactgttccaaattctaccttgaaattatctaaagaagcatatcaattatgcgaccacttattttttgtttttttaaccctctatctcctatcaaacctccacagttttacagcattcttactctgattgtcacccctttcctttccacaattcctcactccctttgaagaataacagcattaacagtgacaacaaaaagattgaaggaagggggttcaatagaagtggaatattattgcattatttaagggggtaatcgctctgagagctttctctgaaaaatctgatgaaatcataaagaagattacaaaaccttgggcagctgcttggcaatgtctcctcccacaaagacagcttctaaataaatccacaggttttgcaccgtcatccagctctcgatgatgtctgttgagttggaaaggtactgcacccatttttgaatctgggctttgaatggcatattgtacctaaaataagaaataggtttagggtttggttttgtttttgttgtgctgttgtttcaaattaaaaaggtttttaaaaatcttaatttttaaccgctttctttacaaccttaattatgttgctggcttttaaagtgatgcaaccaagtgattaattcatccccacttactgttcattgttagtctagctttttcccttttgatccagagcatagagaagggtgggagatttataatctaaggagtagatcaggcattagacttgattccaccaagcttccagggtaatataattaccctcagtgctgctatggctacgagaataatatttgccctactgagcttctgtgcctatttcatggagtctctggtttttcatataatatggagcttttatagaaccatcagtggggaccagacaactaattcaatcttcaaatatgataacacctggactctctccttagcctccccttttctgagtctctttctaacttcccacgcacctgtgtccaacccactcatgtttgatgtacatgtgtgcaagattactgcctcttccatagttaatctgtcttccccttttcctctttgagacagactgcctgtgggtggcctcccaatgtccttttttccttctgcttttccatgtgggctcataattacccagctaaattactgaatttcccagcttccctttgcagtaatgtgcagtcagaagactaagttccacatcaacagtgcttaatttagcggaacactggaatgatctcatagctgaacactggaatcatctcgccagcattaaaaattactgatgcctgcctgggtcctacgtacagagactctgattcaatgggtctgggaagtggccctggcattgggatttttttaagttccttcagtgtatctggtacgttgcaaagattgagaacaactcttctacatgaaatgtgagtagtggcattggatgtaatgggtagtatggggaataaggtcacacctgggaaagacagatgagtgagccagaccaagcttgggtccctgatgatgtggtaaagcccccattccaacctgaaccacctacattaggaattcttttatgcgtgagcaatataaacatcagtgttatattagccattttgtatgtggtgtttctgttatttacagacaaacttaatcctaaatgattatacagcctacctttgtgtctcttcttctctttcttatcccttcatggttctctctagccctacataatatggacttgaagtcgtattattgcataaaagtttaatttccatattcttaattgttaaccaaattgttttaatattccatgcatctttctgaatatttgtatgctcttcactagaaatataggtccatagaaacagagatctttcccttatttgttgttctacccacagcgcctagaagagtacatcacacacatagtaaaggttcaataaatatatattgaaaaaatactcctcccaataactctatctgtagattagatgccattgaaaagaaaagtttccccaccccaaccagataatttttacttaatttacatgagtgtcttttctatctccctagggtatattattgcctgtctatcctttattctggtttggtatgaatagtaaccaagttcattaaaactcactaaatcctgagaagtccaaactcaagattactaatggtctaactttatatcccaatattactttagtgtaacaagtaaactgaaataagagaaatttttttgaaatagtatgaagtacacagtatttccaacattaaaagtattgatacacatatatatggagaattgggtgatattttaaagctagaatagaacaacaaattcatatctcaatggtatccactttctgcacaattaccatatatttgagaagattctggggaacaaaaacattatttcagaaagagcaaatggaagcaatgaaacaaggaaatgtaaattcatgactgtgtggtttgtatgtccaaaatgtgaggggtggccactatgcattatatacatgtaatgaaagttcacatgtggacaggcacagtggctcatgcctgtaatgccagcattttgggaggccaaggcgggcagatcacctgagaccaggagtttgagaccagcctggccaacatggtgaaaccctgtctctactaaaaatacaaaaattagccaggcgtggtggctgttgcctgtaatcccagtactcaggaagctgcggcagaatcacttgagccagggaggctgaggtttcagtgagctgagatcacgccattgcactccagcctgggtgacaaagcaagattccatctcaaaaaaaaaaaaaaaaaaaaaaaacaagttcaaatgtaccccataaatttgtacaaatataaaaaatagagtatgtaaacaactaagagtttctagtccacagatattggtaaaaaaggtttttcgagtaaaatgattattctgaaattcaaaataatgttcctcctggattctacagcctgtagagctatgagctgtgcagtcaggcttgtcagcagcaagctgaaatgttcccaagagccgagtggctaattatacgttgcattattttgtccagtggatggtctcagacataccccacaaatagaggataatgaaataaaaccagagttacacatgctctaacatgtgcctgaggccaaaatgaaaacaagaataattgaaatataatctcttgatgatgtatatataagtgggtacctgagtaaaaatatgttttggatataaaaattaattaatcaatgtaattaaaacaagtattttcaacattgagtaaactatatgaaggctattattgtaatggatttttcattaattttaaatgtttgctattacggttctcaaatctaagggaaaagatagatggttttcccacctgttgctcagtagggatcccagcaacatcaagctgtcctccatgttggcgatgatttccgaggtactgtctcctctcaagaggagctctccacgggttttaaagctgccgaaggtgaatgttttattgtcccattcattaatcacttgcttcagcttttgctcaatgtctctctctttcaccgcactgatacagatgtcctatcaaaatggcaagctctcatgttattgcatgaaagtcacacgtccttccttaatagtctacgtgcaataccccatcttcactatttgcttcatatatatataaatatatatataaacttttatatttccagacctaaaatgcaatataataaacagaaggtgtatacgcagatactgatgcatgaagagagatggagataaagatatgactgaaaaatagaactttaatttataaaatttcccagcaaacttgcccaaaaggaaagatgacagaaaatatatgcaaatcacttttaaattttgaaactttaatcactgattcaaaattcaatgtatttctgatctacctctaaagtcaagtgaatgcagcatgtgaatgaacacaggtagcagaaacctgattctcccatggctctgttgactttcccagtctcctcatggcctcaaccttctcctagaccattagtcaagcccttcctttaccctcatttcttcccacctatgttccccctctgggtgagctcatttacacccatgacttcaatcactttcatatctccaggcaagacccacatccatttgcctactgaacttccctgctgagatgtttcaaggaaaccccaaacacagtctgtgaaatatcagactcatgtccctaatcaagaccatgatctttgcaccttgtcacccaatctgatcaccttcccatgttccccatctctgtggtcagcaccttcatccacttaggtctctcagcaagaaatctagagttcatctttagccctccccttccttctcctaccatgttcccttcatcaccgaattctcctcaaatatccctgatcctttctctcctctccagctttactacttcccctctcatctaacaagccatcatttcttgcctgagctactcttagaaactctcagttggtttttccatcattcttcccttgtcctccttcaattatttctccaaagatcactaccagagtgatccttacaaacggtcaacctaaccatgtcagcccctgctgaaaacacacctcccagctggtgcccattgctcgataacatcatgtaggcccactccacctccctggcctctgctgtctcctctctgccctgcctccacgcctcagccacatgggccttcttctggttcctcaaacacacttcagatgctccatgcataatgcaccatctgcctggaatggccttctttgcactttccaagcccctcaccccaaccacacaaccacactcccttcacccagccagtcctacgcatgcatcctagtcctccctagctttatcacccccaggtgaaccaaactcatctaccataggctttcacagaacaacatacattttattcaatggtatttgccacagcttataactgtgcctttatttgtaaaattatttaataatctgtaaatgcaggactgcattgttatatcctgatgcagaatctgtcccatcttaggccaaataagcatttgttgaaggaactagtggctgaatgccaggagaagagtttcaattgtctgagtgtagtttactgatccaatattccataatatagaaatgttatcaaataaatcccatgagaccttgcaatcttccatcacatcatactctacctctatttcctctttatatttcagaagaggtgcctccatgatatttcttaacttaaagctttcattccccacatccagactgtgcccggtgagggtggttatcctttcccagtgccgctccatcatggctttactggccatgtattccagcagcgggcaacactcgctgaaatcatcaatgatcttcttcaggtccaaaaaagcctgccagtccttcaaggcccggggaagctttcgacatctgtgaagggacaccaacatgaaaggccattgaaatatgatggtagacatcactggaccaagacggtctgctagtatttctattaaaaacagtctctttgaatacttatcctattttaaatcccatgacttgcaggctgtctgttcatataatatacagatgacttttatattacagaaaattgtcctctccattagaaaagattttttccaacccttcacaactattacctagttagaggcattattttagagcgtagaggtgctgctcaagctaattcaattctacaaacatgtactgagaacttactaagcacaaagcatagcaaagtgtatcaggctgtgaagtgaaatatgcaacaaatagctctttttttttttttttttttttgagacggagtatagctctgtgcagtggtgcaatctccgcccactgcaacctccacctcctgggttcaagcgattctcctgcctcagcctcccgagtagctgggattacaggtacgtgccgccatgcccagctaatttttgtatttttaatagagatggggtttcaccatgttggccaggatagtctcaatctcctgacctcgtgatctgcccacctcagcctcccaaagtgctgggattacaggcatgagctactgcacccagccagctctccattttctttaaattcaagagctacaacaatacagaaaaatcatgggcccctgcttttgttccagatgataatctgacattaacttcaaatgtttcataagtgtaatataaataaaaatcagctcccaccaagctgcagaaaagcccctaacatgactcatcctgatagacagaatgtgcttgtctcattgtgtacacacaggagtaattaataaatagcatttgacaagagtgatgtcaatggacaagaacaatgcagcaagatgtgcttttgaaatagctggggtgaaaagagaacttggctgcctatcaaagaggaaagcatttgaagttcaattgctgggcatgctaaacatttaatttcttacctgttctggaattctaagagttcattgttaattttttcaatattcacctctgaccaaagaatatcataatagctatttacagtttctatgacactgttgtacagagtatatattttctgtagaagatttagttgcttctttatttcaagaagctgaggatactgtgtagctggcaggccaaaaagctcctctcctccagtatatgtgatgtatttccgatagatattatcaaattgattctaataaaaacacaagtgaaaacgcatcaaaatgatttatacatgatcaacatacaaatgaaaatataagatttgcaaacaagcaagccagagatgtatgatctctgggcacatgtaaataggaatactaagttggcataattaattcatagaaactacttctaattgtaatcctacaatatcgtatttttaatgcaagtacataccatattccacaatagggccctctatcttacaaagaagaaaacatatgtgtgtttaaaacacaacaaagtttcattgtttagaaagtcatagaaactaaaaagattacctgaaacatgataagcctgtcactggcttcctggggcttcaagccgctagccattggaccattctgaacaaaaagtaaaaaaagaaaaatagaaggaagtgtttgcatataaatttcatgaactcaatccatatttaaatattaaagttaggtttcatgcatgataggaaacttcatttttatttgttagaaaaaaagggcctcacaaagtgattcatttagacatatgtttctagtctaaaaaagccaaattaatgccagaacttcccttagtcaagaaacttttaagattaaaaatatgtattattcatttcttaggtaacacagggaaagaggagtcaatgcctgttctataagaagcacatataaagtctgcttttcagctaaatgctaatatcatataactcatagatttttatcattctaatacccacttgtaaagtggcctataatcttaacattccaatcagattttccaacattagaaaatcttaaatatgtggatttctgtgcttcttcatccatggcgttggtacatgggtccaatcttctaacttgattaattttgtggtttattgtgctactagttaatgggtacaaattttaccctaaactctatatatttcccttctccagcatattataattgcctggagatgggtctcattacacaacatatttacattagaagattcagtacttaaacctatatggataattaaaatatggactccgtgggggcaaggcttgatctgtcttatccactactgtgtagtcagcaccaaggacagcgcccggcaattgctgagctctgtgttatttgtgtaaccaaggaacgctgtggaaaggaggacaattataactgcatgcgaatagtacttttctacacaaatttagaatgctaccaaacaacttcagtaacagaccaaattatacactgttagcccttttaaatttatcattttctgttgaaattattatgtatgaaatccgatttggttaggctttccatccccacccaaatctcatcttgaattgtaatccccataatctccataatccccacgtctcaagggagagactaggtggaggtaactgaatcatgggagcggttttccccatgctgttctctcagtagtgagttctcatgagatccgatggttttaaaaggagctcttccctcttcgctcagcattctccttcctgttgccttgtgaagaaggtgccttgcttcccctttgccttccaccatgattgtaagtttcgtgaggcctcccaagccatgctgaactgtgagtcaattaaacctctctcctttctaaattacccagtctcgagcagttctttatagcagtgtgaaaacagactaatagaaactctaaggggaaagaattgtgaaaaaaaatgtttttctctcatgaaaataaaattcccattccctgggaattcctaggaagtttcacagaaatttacccataatttttagacaactacattttgcatgttgtattcactcatccccgaaaacgcacacagagaaagccagagacataccaaatcatagtccagataaaactggtgacaatcttggaggaatacctccacagcactaataagctctttcttgaaactgggctgcagtgagactaatttattctggacttcgccagcacgtgccagcagcttctcccaagcatagtgcagtgtatcaactttgtctatctcttcccttgctatcagaagtccatatctgttaagcagggcataagattcctaaaaaaaaataggaaaaacttaattttggccagtcagatgcataaatctacacacagccatttattaaatgataagaatggaaaataccagaataatagtgaaactaccctgagagttctagttattctacttcaaaccgcaagaggttaactgtgcaactgagctgttcagctatagtttcctcatctataaaatgggaaaatcttctggctacttcacaggatctttgagactattgaaaaatgtcattttaaatgcattttgaaaaccataaaccattagacaaataaaagatatttttacttaggcccccaaattgtatttgatcactacaaaattctatcaagtaaataaaaaacaaaataatttaacttctaatattagaataacaaaatcaatcagggttttaactctgtcttatttcacgtgatcgataagaggttccaatagtaagacacaagggaggattcttgaatcagagcctgggccaagtcattcccttcagcatgtaaaatcctggatggctttcttctctaaaaggttaaaatgaggctaaggttggttttcataagaaagaattttctctaaatatctctagtctcttctcccaccattactcctccccatagaggtggaatgagtgcctgattattaatttgggggaaaacattgttgatctgagcaaggatagcccagtgcctttctctctcttccctccctctccgtggaggcatgcctgtggtcagcacctcagtgccataaactggatcagggtaataccaagacctacagctttccaacactgcctctgatggatgaggaagtataataatcctgggatttagtgttcactagctcataatgtgtgtgtgtgtgtctgggggtatgaaagggaggggaataactggagtaatacactaagttatgtcttccgaataacttccatcaggcataaaggtgatgttttgatcttgtctacttgattctacttttgttcttaattcctaggtgggagaaaataggattgtcagttactgtacctcctcttcatacttgagggtatcccctgatcctgcacaaagaaatgtctctttgccttgatgtttcaacccaaggagagcaggttggaccatgtgatccccctggcccaacacagcagaagtgaaaatgtgtagtagtctgtaccattctcatggtaatgtgaaaattttcaaaattcaaacagggatgcagaaaatgggagaatagagtctgatctcgaccatcagagtataagcccagacattccagttatagtgtgatgaaaagatgatgattttacaactggagttttttttaatgctacaattaaactagtctcatttaaaaataacaaatatagtgacccacttctgataagacattttcatctggaggttaacagcaccccctgaccccacggtgcctccatggctgagaagtgcttttccttaacgtctccactcttgggtctttgtcaacaatcacaagtggcaaataagatttaaagacatgcaccaacaattatgattatggaaagttattaatgatattaataattcacactcttactcatttctaatgatgatataaatattacaagatgaataaaaatggaattcaaaattacacacacatacacagacattaaaaggagctggaaagaaatataccaacctcttggtatgtacttgattgacaatattatggtaattctgaagttttgttttatacaatcgttttgtgttttctaatttttctacaatgctactttttaattagggaaaaaagagtttgtttgtttgtttgtttgttttaaaaaaaaggctgttgctaagactgattttgctggtggcctaacatgagatttctaaggagactccttagaaagagatgatgtttactcaagtgaatctattcaagggtgtctgcttgtaatgaaatcaactgtcttttttgccattgcttaaattacactatgtatgttgataatattataactaataagtaaataaaagcagacttcactgcaaaaaaaagacattttcatctggaaaagatagtatgatatggtatacaaataaaagtgatgtgcaacactgatcaaattacataatttcttcgaccctcagtttccttatgtgaggagtaggagccatagtaaggatgaaatgagttactgcatatatggacactgttaacgccccatccaggtcccgattaccagctggtattcccatccccgactactgagagtgctggctataaggactgcagctgtcccttccctggaagatttttctcagctgaatgtgagccttctcatggggaggttatagcccatttcctactgacttaggagtagaaagggtagtctcctttgcatgaaggagggcccaactcaattgatgttgtagagtgcccatgggatcaggctgaagttagtccatagctgattgacttcctttcctgattccctcgcccctcttctttggtgagcactcaccaataaatcatttgcacagaaatctttatctcaggctctgctttgaaggaccttaggcgacatgtgaaggtgaaaactggcccatggaaggcaatgctataggggttcggtatcatcaacaatattgaaattattgtcttggtttagtaaccatttagtaacttcactccagacccagtcaatatttcagctaatagcatccaacatgtagaaatatttctataatgaacaaatgatcattagttacctcaataggtcctacttgaaagtcaatggagatttgctcctcccttatttctttcagcgctgccattgcaatccgaatatcatctaggtccttaattggacgatttagtttcttattgaattcttcaataagcataaaaatgttttccatctcactccggtattttttgttacagtggcgtccaatgacaaccatccaggcctttgtctcagcagtcagggcgaacttcaagtcagctgtaaaaacccaaatgtctacagttcagttttaaaaactcgaatcagtacgaaaagtcaaactgtcgctgttctccagtagtaaatattttatagcttattgccctctaacccacaaaaaattgaactggaaaaaatcataatttttcctactcattatatattcattcattttttaaagtttgtttttacaacaactcaacacacatttcaaaatgtttttttaaaaaagcacatatcagaactctctgggataagcctcaaaggtttgttattgttatttattaaacaaagggtaaattttaattcaaaatataacagacatctcctttctctgacttagtctttttttcaaggtttagcagcaaagtgtgcaaaatagtccagaatcaataattatgcagaagaaaattttttaaaaatccacaaattggttttaaagcttgaggcccataaagtcaatctttaagacaggtagaactctctggaatacaaatctaggtaaagaggcagaacaataatggctaatttatataactatatgaaagaaaatgaaccaacctgtgtacagagcaatggaacccacacagacatattcaggctcagcattaatttcctgctctaggttttggaaatagagaatctgggactcaaattcagaaagcaaggggctctgtgtaataaatgtcttaatggcttcttcttttcccttttgccaaatgtgattgtagcgtttgaagcaatccatggatgtaataacttcctgaatgcaaataacagatttatgttaagaaggaagaatctgaaaggcacaatgatataagtgaatatttaccaactgctggtggttcctatggatttattaaaatgtttagtgaactgtgtgattatctggaaatgccaaagaactgggactatatacaatagtgtggacagtagcccagggctagtaacagtttcactgttatcatccctagctaaatgggagaggagcagtttctagaaactagatgacagttcttgaagatcctgtggacagggccctcttggttggagctgggccttagatcaaaaaccacagctcaagctcacactacagggaaggtgctatgaaaaacatactctgaggtcattctcctctttcccccctcccctcagatctcctccaagattcttcattgactgaacccactggaagcctcaatgggaatctactgacatgttgcctaaggtcagataggtggagggaatggagattagatcttaggggcatgaaggacaaacagaaaatagcgagcatcacttcaatgagagattgcctggaatcacataaaatgtataattcatataactagaattgacatctgaacaatactacatctaaccaaccaggaacatagtgcatgtttccatatcttgtcatctttttcaaaaattccttaagttttagcataatcttcatagagaccccagatacttcttattatacatgtttctaggtatttttcaatgctgttgtcattgtaaacaagatattttccactattattataactggctatgaatggcatatacatttttttaaatttatttgtaaatcaacagtctagtttgctaaccaagtatgcatctgtaaagatgaaatgactctctggcaattggtaaataggggacagtgctgacataatgcagaggtcatgttttcaaatgctatttttcccagcaaaacaaatgctactgctttgtaccagctaaagcagcaagtcacagaggagtacagtcctgtgtgccactccccctccatcacttcttccttttggattgatttggctaccacctgtcttaagaatatctttgcatatggttctcactcataagttagtgctaaaaaaaaaagtgtttgcatggacatacagagcagaatgatagataatagagactcagaagagtcagatttctcatcaacttcagaagggagggctatgagaaattcactaacagatacaatgtacattatttgggtgatggataccctaaaatccctgacttggccactatgcaatctatacatacagcacaattgcacatgtatcctataaatttgtacaaataaaaatagataaataaataaataccaatcaaagcagaaagaacaacaaagaaagaatgttctttgtagagtttggcctgatttttgtagagtttatctttgcttctatgcctccacaatctcttccttttcccacttctaccaagcttctttcatcttttatagtaaagttctgtaattactatagtgttattaaatatgtgaatatttcactaagattgttactgttactattttactatgattattattgttttatttattaccctggttacaaattgcctagattttgtgtctgcctcaatcttgtttttctcatcatccctattatttaatattaaatatgcaacttctcaaaacaggacgattttcaggaacatgtttattgtattctatgaaaaattcatataattatctttccattggtgactaacttaactcttgttgggccacaatttcttttttagattagcctcttggatttacttggcagacaattgtatcatctacaaataattaaaattttgtctttttttatttaattactatttatttatttatttatttttgtagagacgagatctcactgtgttacccaagctggtctcaaactcctggcttcaagtgatcctctcatctcggcctcctaaagtgctgagattacaaacatgagccacggcgcctagccaaaaaatttgtctcttcatttctaattcctttgtgaatcaagtttttccactgccttatattatgatttcagagttacatctgcatgaaaaacaaatttagctgataaagaataaacagtgcaattatctgaaataactgagcattacaggattctaaatggtctgattattttaagtaaattgcaccaagctgcaccaaaccaagaagcagttccactccagctccccacatacagctaaaatgtccctccgagcctcaggttcaatggatgttgatacttcccatccattaaaatgcagaaagctaaacctatcactgcctatcccaaccacaaatgattcgtttgcatgacctgaagtgttgacatgcagaccaagaatgcattgcaatagcatgtagacatattcacatatgtatgatggtttgaagaattaattacagattattgaagattcccagaaatggatagaagttccagaatccagagctctctcaccacccaagcttataatattaagaatataccctaactaaatatgttggagggtattcttttaaagtgtctgtctttattaaattggaactttttcacatgaaggtaacctagaccttgaaaggaaaatgacctcagtaggaaaattagatgaactacatatgtagagttgttctgattatgtaaccaaggttattttgattgtttggtccagctcaacgtttctatattttttttttcgagacaaagtcccgctctgtcacccaggctagagtgcagtggcaccatctcagctcactgcaacctctgccttctagattcaggcaaatcttatgcctcagcctaatgagtagctgggattatagacatctgccaccatgcctagctaatttttgtgtttttagtggaaacatagttttaccatattggctaggctggtctcaaactcccagcctcaagtgatcccccaccttggcctctcaaagtgctgacattacagacatgggccactacatccagcctcagctcatccttttaagccaggttgtgttagaagttgatgaccaacctatgggcatgctaaaggcaggtcaggtttacattctaatccaatcagctatagcaacaggaaaggggcagggatcataggactttctgtggttgaggcagaatcattcagaaaggtctatggctgtggagggctggctatatctaatactatgactaagtgtacatatattctcccagaaacaatttggctatcctataaatctggaataagttcttcaagttgttataaatgccaaccttttctactattttaaggaaaactaatatctgagcatttccttcatataaagtaaaagcaaatgcaataaaagtgacacagaggccgggcacggtggctcacgactgtaatcccagcactttgggaggccaaggcaggtggatcacctgaggtcaggagtttgagaccagcttgaccaacatggtaaaaccctgtctctactaaaaatacaaaattagcccagtgtggtggtgcatgcctctaatcccagctactcaggaggctgagacaggagaatcgcttgaacctgggatgcagaggttgcagtgagccaagattgcaccattgcactccagcctaggcagcaagagtgaaactccttcaaaaaaaaaaaaaaaaaaaaagacacagagataagtattttgtggccagcactgtatgttaactatgatttcttcctcttagattttcataatagtggttgatcatactagagaaactagtggatcttattgctgatttattttcttttattttctaggaatactgagacacttgaaaatatttctgaatgtttattgttatcatgaaatactttgcttatcattcagtatagagcttaataatctaagtactagataaatatttattgagttacctgaatactgtctctaggggaaaattaaatacaggaccttcaatatattaagaaaggaaaattaaaagtccataaatgcaaaagatttccagttcccttgggaacacattaaaactaaacttaataatatttcctcacattgttacagcaatggtagcttttcagagtgctttcaaatgaacgtaactcattgtatcaaaactgagtaatagaaaaaatgcacttactgagcaacaactattccttaaacactgggaaacattattaacaagtcaacaagtcttactggccatgtgaattagaagagtttttttaaaaaataaaagatgatttcagggttttaaatctttttgtctgtaaaatagatttgcatgaacaaaaaaggggaagttgagaggggagtatgctgaaagaaaaaattgccttgaatgtacattcatgtccagttcaagtttgtattgatagtactaatatcttctttattctcagtttcatctaatttctatgtggcaatataaataaatttttatctgatattttataacatttgcccgactactcaaatatgaaaaaatgactacaaaccttattctatttcaaatatgttagtatcactggttctttgaaggtgaattataacaacagtctgacttgtagtttggaacatattagattttttaagttagattcatttgtattaaaagaatatattaaaagcattaaacaaaacacaatatgagagtaggaataattttttttcaccttgcaatctagaatgaaagatcttcagttagacaaacatttgctgagcacatacaagatgctccctgaaagcacagtgtgtgagacccaggctacataaaggacaactttgtgatgttcactttcacacaagtgcatgttgcaaagcaaaaggtccggctgccagaccctcttgacatacctttttggtggagttgataattgtgctaagcacagaaactaattttacaatctctttgttttcagaaacattcttataatagttcttggtttgcacgggaatgggtaaatttacagatgctatctccaaggtatctaaaaagaaaaaaagaagagaaaactttacactactcacacaagaatgtactttcaggagatgaggatatttctgtgatagtaaagcaaggacttctgaaaatcttctcctttataaaaacaatgaaaataatggaaagagttgtcaatgtcaacttttcaggactctgtaaattaatcaaagcttgcaataatccaaaaagtgtttattcaagaacaatgctaaatcttggtaacaacagcaagttttgtggtgttttgacttgctctagtcccactgccgctctctggctatagggtagccttgaaaaacagcagccttacaaccattataactggaggaaaaaaacctaccagtagcctagcagtccctggaagggccagcctgggcttggagctccttagggagctccatagaattctcactctttgagctgtctgggagctccctggaaaagccctgttcaaacagtttatttttatttgacctgactcagagctctctgagaaaaaaagtcctatcctcatggcatttgtcaaaagactatcagcaacaattgcttaacttcacagctacctgaggcaatgatattagttgggggcaaataagaggttggccaaaaaagttaaaactctgggaaaggagaagaatgaagtcagcaacatggctgaataagaatatcctggctctccctccacccatggacacacccaatacacatctattctcagatcaattccatctgagagaaagtcagagaccagtggagagactcctgcttatgttataaccaaaaacatatccgcatcaaagggcaggaaaagtggagacacacttggacatggatcctgctccaggcactgaaccagagaattgggaaaggaatctgcaacacacagtttctctctgtggaaatgaggctttggacctcacatgtatcaccataactcttaaggttccccatggcttggctcttaattcaccaattctgagagtggagtggattagacacacaagagtctctctggaccacaagaaaaaagtgatggctttacacaggcatgaagcacttacagaggcttcattctgtggaagttgtgcagagacggggctttaaaaccatggccccttgtttctctctcacatcaagtgccccaacatttacagctgccacccaagggactacattctaaaactcctatctctgggagcagacgggactggcatttgtgtgtctctctagaccacaggaagaagcggccatttaatatgagcacacaagcacttcaacaggctttatcccccaggagcagtgcagagaaggggcttaaaaaacacagtcttctgtttctgtccagaaggggttaatgctatgcactgagtgccccaacttctgcagccacctcccaaaggactcaatcctaaacctcttagctacgtgaagaaagggcattaggcatatgtgaatttccccagatcacaaaacagaaaggaagtttcaatggacatggaaacactaccaggggctacaccccctcagaacaatgcagaaaaggatcaagaatgtgcagcttccattttctttctgggaaggggcttctggcacccccccgcctagtgtctacttgatggcctggcttctaaaaactgtacatcagagagctaatgaggcaaacaaacaggagccctccagcagctggagccacagctgagcacttcatgagtgttccctctggctcccctagtgataagcctaggcctagccattctttctggaaggagctacgacacgcaccaagtgccataacttctatagctcctacccaaaggactgtctctttaatgatctagctagctctgggagtcagtgggtctttgcacttttgagtagccagagaccatggaaaacaacgaggtggatgtacaatgggccaacttccatcagttatctcgccagaatcagaggatgcagcctgaacatgatggcaggcatttgccacagatcctctctctggcttaatgcagagaactgaagataaatgcctgtgctcagcttcactgtgaagacagaaaaaattggagcatgcattcaacactccaacatttccagctacatctagagaatctagctcctaccttaccagtcttaggggtactgacaggacatatcatatctgaatctccagggtaggggggacaaaaaatagagacagcagtctggacaaacactaagattagagaggcatcttgaaatctctggttagtcgaaatagtgagatcctcccacatgaggtcagtctgacaagactgaaagaggtagctgtcttttataatacacagaaaccaacacagagggtcaaagaaaatgaacaaaaacagggaaatacagttcaaataaaataaccaaataaatctccagaaactgttctgagtgaagtggacatatatgatttatctgacagggaattcaaaatacagatgctccttgacctatgatgaagttacatcccaataaatccatcataagtcaaaaatatcctaagtcaataatgcacttaataccctagtaagcctattgtaaagttaaaaatctgtaagtcaaactattctaagtacagatgctctttgacttactataaagttacttcctgataaccccattataaagtcaaaaaaaatgtgaagccaaaccattgtaagtcagggaccatctgtaatattcataaagatcctcaccaatatcaagagagaaatgcaaaaacaaactgagaacttcaacaaagacagaaagtataaaaaagcaccaaacagcaaacataaaactgaagaatgatgtaactgaacacaaaaatttaatagtttccacagaagactagatcaagcagaagtagaaaaaaaaacagtggattcaaagagaggtcactgaaaatcatccaatctgaggagcaaaaaataaaaagaatgaaaaagaatgaagatatcttaacagacttatgggacaccatcaagaggaacaacttatgcattattggcttgccagaaagagaaaagaaagacagaggaaacatactcagagaaataatggcaaaaacttccaagcctgggggaggaaatagaaagccagctccaggaagcccaaaggacattaaataagattaattcaaaaacactcacaccaagacacattataatcaaattgtcaatagctaaagataaagagtgttgaaagtagcaagggaaaagtgtttcattgtatgtaagggaacactcataagactatcagtagatttcttagcagaagccttgcaggttagaaaggagtgaagtgatatattcaaaatactgaaagaaaataactgctaagaatactatatcaagcaattctagctttcaaaaacaaagggatggtataaactttctcatacaaacaaaagctgagagagtttatcaccacaagacccatcttgcaggaaatgctaaatggagattaagctgaaggaagaagatgcttattagtaacatgaaaacatatgaaaatataatacctcactcataaaagtaagtatattggcaaatccaaaacactctaatactgtaatggtggtgggtaaatcattaatatttccagtaaaaaagttaagaggcaaaactactaaaaacaactagagctacacaaatttattaagggatacaaattataaaaagatgtaaaatgtgacaccaaaaacttaaaatgtatgaggtggggagtaaaagtatagaatttgtatatgcaatcaaaactatgttgttaccaacttaaaatagcctataattagtataagatgttttatgtaagcctcagggtaaacataaagcaaaaggccataagagatacataaaagaaaaaaaaagatccaaaatatatcactagagaaagctatcaaaccacaaaggaagaaataaacaaagggtctacaaaacaaccagaaaacaattaacaaaaaggcaagagtaagtctgtacctatcaacaattactttaaatgtaaatgtattaaatactccaatcaaaaggcatagagtggccaaatgaactaaaagaccacaaaaaaagacccaactgcatgctgcttacaagagactcattccaccttaaagttcactcacagattgaaagtgaagggatgaaaaaataaagttcatataaatgaaaaaacaaaatagacttaacatcaaaaagtgtaaaaagagacaaagatcatcatataataaaaagggaataaattcttcaaaattatattataatcgtaaatacatatacacccaacattggagcatataactatataaagtaaatattaagagatctgaagagagacacagactagaacacaataatagtaggggattttagtaccctactttcatcactgaacagatcatctaaacagaaaatcaataaagaaatattagacttgaactacactttagaccaaatatacctaacagacagaatattccatctaacagaacagcatatacattcttctcgagtgcacacagaacattctctctatggtagatcatatgttagacacaaaatgagtcttaacaaacttaagatcaaattacaacaaatttgatcttataacaaattataacaaatcttccaaaccaagcgtatgaaactagaaatcaggaaaaaaatcaaacaggaaaaaccatgcaaatgttttaaatatgtgaaaataaaacaatatgcttctgaaaaaaacttctcaaatcaggtcaaagaagtaattagatgacaaatttcaaaatatcctgagacaaatgagaatggaaacatgacatatcaaaatttattggatgcagcaaaagcagttctaagaggaaacggtatagcaaaataaacagctaagtcaaaaaaggagagagatctcaaatacataacctaaaattacaactcaaagaactagaaaaaggagaacagacaagcccaaagttagcagaagggaggaaataaagatcagagcataaacaaatgaaatagaaactagaaaaacaatagaaaagatcaacaaaacaaaaagttggttttctgaaaagctacacaaagttgacaaatccttagctagactaagtaaaaaagaggactcaagtaaataaaatcacaaatgaaaggagatattactactgataacccaaaaatacaaattatcatgagaatgctaagaacaattttgtgccaacctagaagaaatgaataaattcctagaaacatataattaacctaccaagatggaatcaagaagaaattgaaaatctgaacagacctatagtaagaaagaagatcaaatcagtaatttaaagtctacaatcaaaaaaagcctaccaccagatggttgcatagctaaattctaccaaacatttaaagaactaataccaatatttctctagcacttcaaaaaattaaagagaagggaatacttccaaactcattttacaaggccagcattaccccgataccaaagctagacacatacactacaatttaaaaaaaaaaaaaaactacaggccaatatcactggtggacataaatgcaaaaattctcaacaaaatcctagcaaattatattcaacagtgcattaaaagatcattcatcatgattaagtgaaatttatcccctggatgcaagattggttcaatatatgcaaatcaataaatgtgatccaccataacagaagtcaactaaaatggtgatattaaaatacgtggaccttgatattttgtcaacttcaaattggctcatagattaatattctgatgtaaaataaattgagaattacatggaggggttaaaaaacatttaagctcaatgaatgttgatttacaatgcctcttttaaaagactaaaagaacatttaccttgaagttcattttctcccatttcaacatcagaatcactgtcttcattactctgcaaagcagccatttttctttcttgtatctttttctacaatgtaaaaggatatttttcagttctgtcctatctgtaaaagaagtggtttccatatgaaaccatttctgcaccccatacccaccttggacaacagttcactgctccactgtctgacccccttagggacactgatgatgcactccacggctttgttcagggtctgctgtacatcttccagggcaggggccatgacgatgttgggaatggccagagtgacgcttgcccggaaaatgggcaaactgttctgcttcatgttagaggcactgttactgtctgagttaacccaaaacaaggaagaattcacatttttaatacaaaataagatttgcttcctttgtaaccataaaaattaaaacaatacataataggtataaaatctaataaatatttgttgaatgaatgagtcaattaaaactaatggaggatctagtattgctcaatataacaaagcagttcaggggaacccaaggcattttttgctgtttacagcttcttggaatactctccacaatgaaacccactgtgtgggatcaggctaaattataaacacttctgtaaaatattaaagatgattcttccaaataacaagatgccaacaaattagctaaatgtagctaagtaagccaggaatgaagaacaagactatcggcataagccaaagttagaacaaataaccactttggaatttcagataaatcataggcctttcctaccatggtgtgtaaaatccaaatgtggagcagttaaaaaaatggaaaagaaataaagtgtaattcgccattcatactgaaggagcttttaaggttgaacataggtataggtatgtagatacagacatgtatgtatatgtgtctgtgtatcatgcataactttacgtagttgcaaatatctgtaatagaaaagctgggaaataattgtgattgaatatttagcctatcagccaacatttattaagttctaataataacgctgtgccaaagaaaagaactattctccatcctgaatgaagtaaaacataataagccatggcaccaaacaaaaaaaaaatctttcagagtttccacttttatttacccacttttaattaaatattgaagatgctttcctttaaatgtcaatattcaaaatatatttaaaaattttattatcctattatttcagttttcattaattactattatttgttttctttttaccatttttaacttaaaatttaatttcaggatgcctctagatttgacagatttttgtggcccacctgagaaatacaacacctatttctgaactgtgccgaggaaaagatgatgctattgaaaatgaggaaaccacctggaaagtactaaattagcataaaaatagtaaaatacatatatatcctttgaagagtgtgacactagtaagatgtttccactttgtaagactggctaacaaacctaatgatttaacaatgaaagaatcgtttccatataacttcctttaaagtatgtatttttttctttcaccaattaaaataattttatattttttcatcttattacaaaaagattaaacgtactaccaattttcatgttattaacaaaaacttaagcaaactatttaacctccctgtgctgtgctctagttctctgatttaacatgagagtagtaatagtatctacttaatagaattgttgggatgatcaaagttcataatgtttaaaattacgagaaggcactaaataaacggtggatatggccaagtgcggtggctcacgcctgtaatcccaacactttgggaggccggggcgggcggatcacctgagctcaggagttcgccaccagcgtgcccaacatagtgaaaccctgtctctactaaaatacaaaaaattagccaggcgtggcggcgtgcgcctatagtcccagctacttgggaggctaagctggagaatcacttgaacccaggagatgaaggttgcagtgagctgagatcgtgccgctaccctccaacctggtcgacagggcgagactccatctcaaaaaataaaaatttaaaaaaagatgaatatttttaattatttaaatttaacaggaatgtacatgcacgtgcacacgtgcacacacacacacacacacataccccagcaactatgcctgatcatccactaagcaaaccacacaagattattaccccggaagttaattgtgtgagaggaatgaatacgtttgcgaatggcctctagtgtattccttgtaactttcagaagagcatccatgttctgatggttgaaatgagagagtaactcgcgggcttcttcccctaacatctcagtttctttctttttcctcgtgactgtcgtcaaaagcagggcattggccctggcattaatagatgatgtcaaggtgtcaaaatttccttcttctctttttgctgttacaagatgaaagagatagagatagagataagttagatggatggatggatagatagacagatagatagacagatagatagaatcatctgttgcaattaaaggataaattacatgcaagtttagtatcacttaaacatcacacttcttaggaagtgaggacatcaaaaagtaggaggaaatcaggaaccagagggactgatggaagcatctccttctcaatacaagaaaacagccaacaagagaggcaggagctatggctggaaaagctacagtggcccccaaggacctgggttctggtgctacctcccaccaataaccctaaaactttggggggataatttcccttcttcacatccacatctctctgttctcctctgtcctgcaaaaggtgcgctcagtctagaggctctccaaggggaattccagtcaataatccatccaactctattgataaggtaaaataaaacacccacccacacataaatgcaaagaaagctaaccagggccaatgcaaagtgcatgtttgcaaagtttaaccaaaaatagtaggaattaacaacatagagtcactaaaatatgctcagggccataatttcagatttatacatatcattagaaaatcgagaggatgtttatagaagtatgaaattaattggtatgtagaaaatgcagttttagtttttagtaaatgtcatagaaaaacaagaccctttcattaccccatctcttacctgaactttcatttttgtaattaacactattctcattggatattttttcactttcttcttcagataaaacttccacatccagcaacatatttacaagctcattgactgcctcctccactaatgagcttttaaaatgtagtatttgtgcaccatttacacaaagatcctaaccaaaaaaaaaaaaaaaaaaagatagcacagtggtatatggtttatctagcttttgagagcacagaaacagtggtagcaatgctgtggctcagcctccaggtgagatttcagccccagtgatgcttggccacatccttcacaatagcacaggccaggtgtcctctaaaggaatgtgtttaggacaagagaacccactggatcagtgtagatggaccaaaattacaggcacttctccaccagtagagaaaatatcttcaaaagccatcagcagcctctctactcgtcacatttccttcatatcacataaatcggatccagccacccttctttctctccttgtttttgccaacaaaccatagtcatcccctcattaatttcaaagacactacccacccttctaactatattgtgcatttctcaagaatggatttaataaatataaactaacatgatttgaggcatggtgatcaattctggaggagattaggtagacagatagttatagatggatgatatagacagaatcagtgatttaccacctggttggaaagtaagcccatgaaacaacagactgtcagttaggcacagtgtccagctccattccaagttccagcattatacatctttaaacttatacggcttgaaaactaggattcaaatccttgctctgcatgatcctgaaaattcttttcagtctcaattccctcatatgtataatggtgatatagtagaactcactgtagtttttgcaagtattccataaaataaatgcaagtaaaatactaagagcagtgcctggcataaagtaagcacacaagaagtgcttgttattattattggttggaaaatcacaaacatccacaggacctaaatatttgcaaaggttagtcaactcattccatgtaaactaactcctcaattctctgagagaacactaatattttttaaagtctgaatcttaagtcctctgactctaccttggagagaaacacacatgtggtctccattttcagggccagctctcacagggaatcctcaattaacttgcagctctttcagtcctctcagtaacacaagcacatgtttgagatcataaaattcctttgtattgagggttctagaagatgagattgataacctctcaaagactaatatagttccaacaacgttgtttacatctcttaactctttctctctgtgagaaggcataaccataaaaatgtaaatagcatagaaattaacaaagcagaatataaacgcaatgaggaaaaagaagtaataaatagactcattaaaatatcccccaggacaaataaaataaatgaaagatgctgcctccacttatcctgcttcatttcaacaactaacctccatgatgacacccaaaagctgaaacccaccaaaagggcctttctttcaatcctgagtggtgtcctccttgaataatcagcatggggctccaccatttcctcattcccatgatgctttagctttggcaaaccaggaacctactagacgccatgtcttctcaaggtctcttcacccttactccctggttcatgccctctcctaacacgatttcacacttcaaccattgttttgctaatatcctttactccatcactctctcaaccttccactgccccacccaggagacgcccaacccaaatgaaccaggtgacctaccctctccaccggcacacataggtcatggtgaggcagatgcttggcactgggaattcatggtccccaaactcaaactggcccctaatgctactcgggaatcattctacatgactatagccacctccctctaccaagctccataatagctgtgtcttcaaatccctgtgtcctcaaatcgttacaccatccttcctcgtcatactcaaagaatgaccttgatttctacagcacaaagcaaatggaggtcatgacacggggactcaaacaactcccactgccctcatgcagaagacaaatcggcctccatcatgagccccttttcctcttgttttggtgaatgcaatcattctccttttattcgaggttaactccacaacctgagttctgaatcacagcttctctggcttcctcagaaaccaagcctacccctttcttcctctctactaattttccacctgagcatatgaacacccaatgtacttcaactcaacacctttctccagctacaacatgcttccacctcagggcctttgcacatgctattctctctgcctggcatgttcttccactaaaatgttcacatagcttgcactctcactccctcccttcaaatctaaccgtagaagtcatcagtgaccatgaacataaaatcacaactttctgtcaggtactccttttctccatcatccttttcatttttctccataattgaattatgaattcaaataaacaaactcaagagaaatgatttactaatacctatattggtaatcaaaaatgcaaactcaaattgggttccacgattttgctacttaaagtaaaagtagtaaactataataaaacagtgtttgttggaagtgaaattggtagtactgcattgctggtggcattgtaagctgataatatccttttgaaaagcaatttggctaccaatatcaacagccatccaataaggccatactctctgacacaataattttattttggggagggaataacattaaaggagaaaatacatgatacatgcatatattcactgcagctcttgacaaattagcaaaactttggaagccatctaaaggttcagcaataagaaactggtaagtaaattacagtatatcaactcaacagaatattctgaaggcaccattaaaaggctgcctatgaaagccatgtagcaacatgaagaatattttgtgacgaaatgttaactgggagaaaaaagtactattcaaaacctgatatatatggagtagagatcgccactttattaaaaagcttaaaatgcattaatattataataatgatggtataattgattaaaaggctagtttctttccatttttaaaatattctaaaactttcttttaaatttaaatttaaaacaagtgtatttttataaaacaatcatcagaaaaggggtaagactaaaaccatggaggcaagtgatttttcagaggaagagatagttttttaaatgatgaggaagaacaaggggatggttaggtgtacccacagttagtgaatgtgaggaggagggactagaaatttctaacatgtagacagtaagttttgcgtataaaatgacttaatataacctgccatatatgcagaaaggggtgaacacagcaggcctgaaactgctctccttagaaagtcctgcttgggaggtggtcccttggccggcgtctggaagcttggattttaggagggttccccctgttgccctgctgataaagatagtttgctgtgcctaaactgcttgtgcaaacaatgtagtttatgctgaacacctgattccttctgggagtctggaattctggtccatgctaagcagagtgtgtgaccagacccagtaagaaccttgggccctgagtctctaataggtttccctgggcagaaacattgcacagaggggacggtgagctccgggcaagcctcacaggagggagacagcatgaaaaagcctggacagggactccccagacaccacctgtctttgttccttatgatccggctgcatctcttaactatgtcagggcagtgcaactacgtgctgagttccgtgagtcctcctagtgggggtggtcttggagaccccggcacatcatattaaaatcatgatcaaggagtccttatcctcaagatgcccactgggaatattgtaaatgatgctaacgtgacatgcctgaaggggcacttcatggagcactgctcccaggagcttactcctggcacagggaagaaagtatcccatttgcaaatgtgttggagaaataatgagctacgaaaagttaaatgaagggccgggcgcagtggctcacgcctgtaatcccagtactttgggaggccgaggcaggcaggttgcctgagctcaggagttagagaccagcctgggcaacacgatgaaaccccatctctactaaaatacaaaaaattaggcaggcgtggcagcgtgtgcctgtagtcccagctactcgggaagctgaggcaggagaattgcttcaaccggggagtcagaggttgtagtgagctgagatcgcatcactgcactccagcctgggcaacagagcaagactccatctcaaaaaaaaaaaaaaaggttaaatggagatcttctgagggcctttatcttaacatgttaaagtgtagcggatctgtaagcacagtctttaccctaagcagtttgcactcactccctgcctctctcaggattcccagcaatggctccagaattgtgtgctatagaacaccagtttgggaaaccccccctcaacaaaaatgtttaaagaagaaattttgtctagaagctgttcaaaacaattgtttcgttaattaaccctagcttatgagaagcacttctgcaagatagctctatccttcattaaaaaatggaaaaattccaagtgtgttctatggcaatttctctcctactgatctgaaatgatgtgttccccatagctaagtgaccgcttacttagatacatttctcttcactggcaaattattgtcagaagattccatgtctgaatcacttctatcacagagcactgcaagtagagaaaaaaatctaacttataacttcaaaaaagtgacctttataggaaaatgaatcaccaaaaaccttaaacaaaaaaaatcaaggttttaatgacctttgtcatttggagaaactcttcacaggttagtggctcctcctggggaagctgacaaagaggcgtgctgctcatttcttctagaatggcatcaatgcggaactcaatcaaatcattgaccctgtcaagcagcaactccaggtcctctttgggaaaaaataaaagtaaataaaagagattaggtaaagcattttgttttttaaaaaaatcaacacttgattaaatgacagtagtaaaatcagctttaaagattctcagttacgtatgttccccagatccccactgattcacacttggttgtcgctaataaaatatccaagttgttaactttctaatactaatactctgtagggagaatggaaaatctatcttggtagccccttctaatttgattatgatcattcttattataaagtttttatacattttataaatgcctccttagggacttttagccaatttccttttgttttatttcctggggccatcgttccttctctgtaaccagtttctgagctcctgcctgcctaactctcactcatacttaaagatccggctcaagtgcatttccccacagaggccctgggtgaatccatgtgcattggagtggtccctcctcctgtaaaaccacagatggagcatccttccgtctctgcggattgtctacccatgtgtcttatcttctttagaattcatattttttatccttacatcttcaatatttaacctggtgcctattccacaagaagtattcaacaaatttgactaaagtgaaagttccctattttttctttcactgtaaatatcatagggtacatttttttagttgtgctgaagtaatattgaatgctaagttcaatggatgcaaaggccaactctgaagcaaactaacaacaactgcacatcaaaagtaggaatgattactaatggatatccatctaagggtaatacatttttcaacagataccatacagtaaaatttctctttttctaatactcctttctcctgggaaataaagctgaaattgaatacaggaaagtcaacgttacataccaacgctgtatcggagatgtaaacacctccttaaataaatacctttatttcctaaagaataaaagcctaaaagttttctattttttctaagctaattattaaagaggctactcaagataccaaatagttctgcctggtaaattgattgaatactaaaagagagccaacactttcacttaagtatgtgtgagcaataaaattctctacgctttctaacggactgcttcttcatctttaaggacatctgtgttaagctgaaaaaaatagtccccaaggatgtccacatcctaatctcctgtgaatgttaccttatatggcaaaagggattttgcagatgtgatcaagttagggattatgtaatgtgcagagtgtcccagattatctatactctcttaaatgcatgatgcaaatgaccacctgtaagtaggattggcttactaatccaattaaaatccagctgcacttgagattttacatagttttctctcaaagaaacttcatctttgttctattttagttccttaaattacaaaaagaaaaacataatagaaaacaagaacaagaagtttctctagaaactagttccttgtctccagctaacaatctaataaaacatccaaattgttaatactttaatactagtgttctaaaggaaggatattactaaagtctatcttggtcgcctgttctaatttgattatgataactcattatcatgtttttatacatttcataagtgcctccttaggaaattttagccagtttcctcttgttttatttcctggggaggcgtattttggaagaaatattaatttagagcaaggaaatcgggttctaaactcattattatttcttacatctatgtaacattaaaagccatttagcatctctggcttgatattcattcatattcaaaaactccattatcatttgtctttgagtccagctcccaatctataatgcataacaaaggtgaggtatgggctgaatcataatttctcactctactcccctccaacccagtacttctcaaatattcttaaatatgaagtacctggctatttaaatagctggaccttctgaaccctaagttttttggaaagtgcggtgaaaatctactgataagacaagctcttgacaatttacattataaatggactaggtactatgttaacagccataaattccagaacaagagagagacctgaggggcggagttgggggagagagagagagaataaaaggaggcatcacgagagctatctaaaagggaagcccaggaagaggtatccagaaataaggtaatgggcttgaggggtaggaacagggttacagtgataaagaaatgaagagagactaagtatataaaattattgctattatgaatctgcaagtatatggatgtctcctacacacccagctgagaataacacaaaagaagtataaatgtaaacagcctggatttaattatttcacattgcattcataaatcgtaacaccattttgtatcccatcaatttttccccacgcaactccttcttcacagaatccataaatctatacaattataaattatcaatttacaataaaaaaagaaaaaaaattaaacagcctgatattcaggtcctttgtagtctgtttgaggagaaagatgaaactgtactaaaccattagaagacaaccaaaatatcaagtctctggtcccaaatataaatccaacaggaggtcacaggaggaagcggtcacaggaggtagagtaatcagagtagccttctaggggcaagactcactctgggctataagagtggggaggactgggctatgcagaggagagggtgtaagacactggctaggagaggacaatagcaatgtctaagtctttctgagaaaaaaaaaaaaaaaaccattaccacgttccaaactgtgctacactgtctgccacagaggatctgtaaggtgttaatgtgtcctcctggaaggcagccaaggaattctgggaaatgccacaagcaaaaggccacttttggagacctactgggacactggcatgttacaggctctgaaaagtcgtccagcaaagaaacctgtccaactgctcctcttggatttcccagacatatttgagcccttctttgcaacatacccgtacacattccagaaaagcgcattttatggaatatactaccttacatatattttagactattatatctctttttaaggaaaattgtgtttgtttaaatttttcccatttatcctgttgttcagcactgtactctatccaaatctccacatctttcaaatcaagctctcaaaatacactaacctatttatataaaaagctgaataactctaaagatactttaaatcctaatgtccaaaaatacaaataaatgaaaatatgtggttaatctctggggataaaattaaatagtgaatatttatagtttccaggaaattactgaattcgcatgttttggaacacttccttatgaaacagcttaagaataacactccccatttcattatttatatctccatattgataagaaattattcaacagatgttaggaactcagcctttagaattcagaaatactaattattcaggcagacttactgatctttgcaaaagtgttttctaaataagcctcaatattcagtgatgtccaggtcagtgcagccaagccaggttggagagcttcatccactttggccaagtgagggacaatcaattgctcaatggcagcaggtatttttgacttcactctctgatattcagctagcatcatctgcaatgaaattggggttaagtaatcaattaatatctcacttctaatgtctgttaatatctcatgtcttatacaaaatgactacttttatttagggtcaaactgtagggctctaatagcctggcaggtagagtagccaaaacaataaaaagaaaagaagacggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaagaagacaaggactctctccataattacaaattcctaatccaaaaaaatacaactgaagatgaacaagaatttaagactaacagtgtctcacctcctacacagcctaaaaagggagaaaatctaaggccaagtaatttttctaaaccatgcagaaacacgggaatggcaccttcacctgctcatcaccaggcttgtttgttcctctttgtacactgatacgacatgcgtgctgctcctctggggacctcttgtagactacacccatcacccaaaacatgtgggtcgccagaggtctacctcagccctttgctaggattataggccaaatcttgttgccaagacccaaagcacaccgggaaccagtattgatctcaactagtgtcacggctttgaatttcatccagatgccagaaacaaacacatttacgtctccagcccagatctcactcctgaaagtctagattcacaaatggcagcagcctcccaaagtttccacatcaatatatagcagacatttcaaacttaataagtcccaaactgaaagtctgttcttttcccaaaacctcttcccagtgcatcctccaactcagctgatagtgactttatccttccagtccacaggtcaaaacccagagtcatccttgattcctctttcactcacacacatacaggtaatccattaggatatcttgtttgctgtctaaactgtacctagacttattgggagagtgagtggaagcagggagacaacagtagatcatcccaataatttaggtaggagccaatgatggcagtaactgtaaatgtggaaagcaagtcagatcctgcttccactcaccctcccaataagtctaggtacagtttagcagcaaaaatgatcctttcaaaatgagaattcagatcatgttactcctctgctcacatggttacatagcctcccatttaattcagggctacaaacctttatacaaaggacttggatagatgcttgttctagaaagatctacccgattttgtcccattacttctctgatctcatctccaaccactctttccctctcttacctgcacttgcctgactgtcttcctttctggtcctgagcctcagggcctttgcacctccttcaaataagtactcaaatgatactttctcaattatacctgtcctgactacctgtttaagattataaaccaccaccaaaaccactcacacattttatcccccttttttgtccataataactatcactttattacaatagactatattaatttacttacttacagtgttcattttctgttttacccaattagactataagttctacaaggacaagaattttgtctgctttgtccagtgagcctgaaccagtgcctggcacataggagataataaatcaatatctatctaattagttgttatcagaaggatttttcatctgaaatgggcattctcatctttcactgaaaggtacataatgtcaaactgtgtcagtattatttacataatgtcaaactgtcaatattttgttcatatgtaaccatgtcaatattaataatcattaattataagaaactaactttaatgtgccccataaatacagttggtattaaggtcatatatgtgcatgttggttttaccttgataatagatgaatgttttccaaactgttttgcctagagtactaggtccaaagagattctataagaaaaaatgtccctttgatagataaattttgaaaatgctgcatacaatatctcccctcttgggtggtcacagctaatattaatgattcttagaaacctgcttaaggaagtaagaagccttgcaaggctttgaaaattttgttaaacacagtatttcccagatggacctcataatcctttcctcatataatgtttttccacaatttctataagattctttcaatgtccataaaagccactttagaaaagtctaaattttctggttctattcgcagctacttacatatttcctgaaacttgtatccactgcttgttttttttcaatgtccaccagttattctatctggaagcagttcttagaatctgcttctagcaggcattctacttcccacctttaatcccagaagggattactcaactgctttgacaaaagagaaacccaggcttagaaggtgaagtcatttacccaaagataatgatttgaatccagattaaattggcttcagaacctatatttgtaactattagcctgtacttggtcttctctttctagttaaactgtcttccaaggaagagatgaagaaacaaattctcagctactttggcatatctgcaaaagcctgaaagctctgtcaaatattcagcacaataattctgcaacacttcagatggtcacctaaacctgccaatagatctgctttgaccagctactcaggttgagcagaaacttttaactctcaacctccaagataataaatgttaatgagatgataatttactcccttgaattgtcatttaaaacattctttgatcctcttcccttcatgggggaggggggaaccacatcccctttttttgaatctgggtaggtttacagtccaacagagtacaacagagatgatgctgtgagacatctgaggctattataaagaccatgtgacttctttattgttcactgtagcgcttgttcttgaaaccctgagctgccatataagaaattctactagccagaggcctccatactggaaggccatgtatagatgtgcctgttcacagtcccactggagtgtaccttccagctttcctcaggaaagaaacagaaactagaagaacccttcttggaccttacagattgaacatctgccagttgaataccaataaacaacctttgtcaacaatacatggaacagaagaatcacctatgcaagccccactcaagttctttacccataaagtcatgatataatgatacggttattgtaaaccctacaacgtgcttacaagtgtttgttgcctgaaacagacaagtgaaacaacaactctgcaaatacaattaaattatcagtaattccataatcttataattatagtttcttagtaaaaatattattttctttatgaatatgtaaattgactaagtgagtttcctaatgtgaaagagtctaaaagggaatctcaacatgctgactggtattttatgagtctacatttgaggaatgtctgtccattgccaatacaactttttaatatgacatgaagtggtgggaagacgatggactacaagtctgggttctggtcttacttctgccactttgtagctatgagacctttgctaaatcttttaacttctctaagccacagttttgtcatctacgaaataaaataatagtattctgtcctacttacctaacgtagtggtagaaaagatcagatgaaataatgagcatgaaaatggctttaaatgtaaagtacagtgcaagtgcatggacttagtattgtcacgtgatgttaaccactatgaaattttaacaatggtttccatgttgtcagattccatggccgcatctctgatctcaccttcttcatcccctgggtagcagcatttgccactggtgaccagtccctctctcagtagccttttcatacccttggcttcctttttttgttgttttttgtttgtttgttttttgagacggatctcgctctgtcacccaggctggagtgcagtggtgcaatctcagctcactgcaacctccatctctaggttcaagagattctcctgcctcggcctcccaagtagctgagattacaggcacatgccaacatgttcagctaatttttgtatttttaatagagacggggtttcaccacgttggccaggctggtctcgaactcctgacctcaggtgatctgccagtctcagcctcccaaagtgctgggattacaggcatgagccaccgtgcccggccatccttggtctccttgacacttggtttcttcccagctcagaggtcagtcctctgttttatttgcacacctgtcttcttctttcagatctgttaatactggaacaacccaatgcttggcccagtggccctccattcttctctgtctgtattctctcccctaagagatctcatccaggacaatgacattaaataacaatgatattctgataactctcagaagcatgcctcccactttggcttctccactgaactccagacttaagtatccaactgcatggacaacactgccacttggctgtctaaaaactatcttgtacttaaatgggaactactgattccctcctgctgctccaaatacactagtttcggttttcgccatctccataacttgaacttacagtcagggcccctgcatggtattgtgcaagttatgaagaatgcaacctacacagcattctacggcacccctgctttaattcatggaactgctcacaccaaaaccacaggtattattcctgagttctcttataacctgactgttgacataactctaaattctccaaacaactctgctgccatcccagttcaagctctcatcttcatcctgggccagtgcaacacttcacaaacaggcttcccgctgatacccctcgtccctcttaacatccattttccacccagcagtaagaataacttttattataaaaagagatcgtgcctttttcagtggctcgaaatcctccaatggtttcctggtacactcaaaataaaacccaagcttctcatcttggcctgcaagacctgtaacggcctggccccagccaactctgcagctgcaccccatggcactgtcccctcagtcactccattcatcctggccactttctgctccttgaatatgacacatcaccatatttttttataatacattccagagctagccaagaatggggggaaaaaataaaagtagtataccttcatgttactgaagttccttttgtatctatctcgtttctggaagagggaagttgccagtggagagacttccagacccatctgggccatgcactctgtttctctaaataagattaatatctgagggtcaaagtttacaaacaattcccctgtgcctggagccttcaccaataatgaagcctcaagacctacatgaatttcttcaatctgtgggaagaaaccaacatcattactatcagaaagttcaattcatgcagagtatctagctcagctatctctaggaataaggatcattaaatgttcttccatggatttgagcttcctaaattaagggcaataagatcactcactcttctcctaaatccagtctcatacaatagccttcaagttcttggtgttgatgttgggcagtcaattcaataaaacctttcaatgactctaacactgataaataagtggacactgcaacagtggtggcgtctcaaaagccatttagctacctgataccttcatgcctactctattattcttcctaataaaagtttcgtaagacctcctaaactcagtttttacttatctagaaaaacaatgaacacagctatggagacatcgcatcctgacagcctacaaagaaatacatgtattggtaggatatgctatgattaaccagttgtacaacaaaagaaaatttgaaactttgtttaacagatgtgctagtgtttactgacatatttaggatctgactgaattttaaaaagcaagatatcctaatagattgggcataggaaccaataaacaagatcttctcactttggagttcgtaaattaaataaaaatggggttctgttacctggcttgtggtttcttttcaaatctaataattatttttctttgtggacatattacactctgaacgcttagattcaacccatctgccttacaaaacacctacaaatccagctttctaaagaaataacactgtcaaatgctagaagaggggttcccatgattccaacaatgggaagagtataaatttagggactcacttgccgaagccacgccctgtggaagaggacctcaaactccaggaggaccttggccatcctgttgtaactgcgaattataggtttggcttctgccgtgcttagcacagctgggtgctgctggaaaagctgcatgggctgctgaatcctatggaagagctggcgggcccacaaaatctttccagcgatgggaggctggtttcgagccagaggaggatcgtatttctgctttgtatacagctttgaaatcatatcaatgtcagccccatagttctcaaggataagttgatatttgtcatcaataccaagattaggtatattcaatctgatttttttaaaaagttaaaagcttgaattaatggaataaaataaataaaatacacaataaaaatatctagtaatctcatttattaatatttattttttaaaatgctaatggaaaagaatgagatatttacatggaatattaaaagaataaaaataaaactcatccataaaatgtaggcaaaactattaacttgggaagacatttttcaaattatctatacattaggaaatattattataggcagtcacaaggtacttcaaagctaagagtattctctatttgtagaaataaaataaatcctgaatccttaaaaggattaatcctctgaaaaacttaaaaactatgaccttgtgacccaaattgccaagagaggttttcctttccatcagaatatgaaataataataataggaataacaacaataaaagctaaactatcccaattttagaaaatagacaatttcttgaaaattttacctttcaaatttcttcaacattcttagagcttgatttgtgttttgaatctttgcaaatgtaacatccatgaacttccgcaactcgttctaaaacagaataaaatctgatgatgaacaatagaattgggaatttactgtttagcaacaagataaaagagctttccattctgtgcaaacacatataacatggaacaaaatgtaaccgaaaattgaatgagcttaaaagaaaaataaatgcccagaagccagaaacaaagagagacttgaaagccagatcagccatgggagttggcgccacgtcaggttccacgggtactgggccagacacagagcctggggggtggcactggggccttatcgcaatatggggagatgggctatggggtcctaacattctcaacagagcctgtggaaagcagggatccttgaagtgctgcccagtacatgcaaagggaattgattcacaagttgggaaagctgcaaagaggcttgacatctgcccaaacccttgaataggaaaaaaagtcaccctacaatagggttcccatactttctcatcacagctactcacttctaccactgcaatgccaaagcacccatagacagtacacaaacaaatgggcagggcactgtctggctcttggacatagtttgctgacccctgccctagaggaactgaaatcccacatcggtgccacacctagataaggggtccaggtttaaactacacatgaaatgaaagggatataacccaagacattaacataaaagctagtctgggaaagtaaaaccactaggaccacagaattcaagaaaagccactctacagaaacacttccaaagcccagggccaaaagattcctataggaaaaaaaataaatacataacttctaaagaagctcaaaaagtttttgaaaacccatgagaaaatcatctttgagagagaaggagcagaatgcacaaacagaattagtaaccaagtactaaaaatgatagagcagtctaaaggagactatgaaataagtatatttaaagtgattaaagagtaaagaagaaacagaaatcataaaaagaacagaactgaataaaacaagaacactcagatttttaaaaataaaatttagacgtataaaggggaacataattacaattcaaaatacaatagatgcaaattataaacacctgaaaagaaaactgatgaactacaagacagttttcaaataaaatcacccaaagtatagcagagaaataaagaaatggaaaaatacaaaaaaagatgttaacaaacatggaagatagaaaaataaggtgtaacatatgtctattggaaatcttggaagaagaacctaagatatttaaaatgagaaaggctgagaattttccacaattaaaaaaagacttagtcctcaaatggaagaagcacatcaaattctgaacaagagaaatatgttttaatcacacccaaaactcacagaaagatgccaaaggtaaagagaaaaacaatattaaaagaaaaataatagtaatattaatattaaaagatagaaatattaaaatcacaaaagggagaaatcaaatttatctataaagaaataactatttgatagcaaatacctcgtggagaacaatagccgacaaaaatcagtgaataaagatcttctaagggctgacggaaaataacacccaaactaaaatcacatataaaacgagaataatattcaagattgagggcaactttataggcatttgggtgtaaagactggatgagtttaccattaacagactcttgttaaaataaaactaaaggatatacttctttaagaatgataatgaacccaaaaagagggagagatacgattactaacaagatgcaagaataagcaaagcaaactgtaaacatgttgctaaatttaaataactattagtaataacaagtttgaaaagtttagcagcaaaggtaaaactaaaattcaagacaaccatagcatgaatgagaggtaggctgataaaacagttaaactctttaaagtcaggtatatatgctaaaaccactaaaaatataaatacaatattaaaaatataaatagaagaggaataaagagaataacaaaatttaatcaacaaaatataaaaaggaaaaagtcaaagaaaaaaagttcacctcacttaaaattcaaaatagattgtagaagtaactctatactaaaaacaacaatcaatgtaaatggcttaaacttgcaattaaaggaaagagagtctcagctgttttttatatatacatatatgttatatagagagatatggattatatttttatgtagattgtacatggatattatatataaattatagatatatatattatagatatatggattttatatatatgtggattatatatgtgcatgtgaattatatataaggatattatatataaattatagatatattgattttatatatatggattctatgtatgtggattatgtgtgtgtgtgtgtttgtattatacgtatataatccaaccattgctcttttaaagagatatgtttaaaatataataattaagaaatagtaggccaagtacagtggctcacacctttaatcccagaacattgggaggccaaggttggcagatcccttgaccccagaagtttgaaaccagcctgggcaacatggcaaaaccctgactcttcaaaaaatacaaaaattagctgggcatggtggcatgcacctgtagtctcaactactcgggaggctgaggtgggatgatcatttgagcccagcagatcgaggctgctgtgagccaagatcgcaccactgcactccagcctgggtgacagagcaagaccctgtttcaaaaaagaaaagaaaatgaaagaaagaaagaaatagtaggaagtaaaagaacagaaaaaaatgtttatttcaggtaaataataaccaaaagaaagtcgaagtagcaatataaataattcacaaaattgattgtaaggcaaagagcctcattgaagataaatatggtcataatttagcattaaagggaacaatttctttggcagatatgccaatttcgagtctgtgtttaaccaattgaatcaaaatatatacacagatttttagaaacccatggatcaagcatgctatggtttaaatgtcctctccaaaactcctgttgaaatttaattgccattgtgatgatattaagaggtggcaccactaagaggttattaggccctgagggttctgctcccatcggtggattaatgttatcgcaggagtgggttgttataaaaaacgagctcagccctctcttgctttctcaagctctcttgctcttcagccttctgccatgcagcaagaaggccctcatcagataccggctcctcaaccttggacttctcagtctccagaactgtaagaaataaatttcttttttttataaatcagccagtctgcagttatgttatagcaacacaaaaagaactcagacaaagaagatcaaaaaacattcagtataccactacaaatattagaatggtcaaaatctagaatgctggaaacaccaaatgctggtgaggatgtggagcaacaagaactctactctaattcattgccagtgggaatgcaaaatggtatggccatgttggaagacagtttgatggattcttataaaactaaaaacactcatactatatgatccagcaatcatacttcttggtactcaatcaaagaagttaaaaacttatatccacagaaaaatctacacaccgatgtttatagcagctttattcatagttgtcaaaacttggaagtaaccaagatatctttcaatgtgtgactggataaattgtggtacatcacaactgaataatggaatgttattcagtgctaaaaagaaatgagctatcaagccatgaaaaggcatgaagaaaatataaacgcatatcactaactaaaagaagccagtctaaaagggcatattctgtatgcttccgactagatggaaaaggcaaaactacatagacagtaaaaagatagtagttaccgggagagggaaggatgaataggtggagcacaggggacttttcggtaggaaaacactttgcctgatattaccacggtcgatgcatatccttgtatctttgtccaaacccatagaatgtataacaccaagagtgagccctaatgtaaactgtggactttagatggtaatgatgtgtcaatttaggctcatcgattgtaacaaatgtaccaccctatcaggggatgttcataatgggggaggctatgcattctgggggagagtagggggaatatagtaaatctctgtacttcctctcaattttgctgtgaatctacaacttctctttaaaaagtcatttttaaaaaatatttaatgaggtgtaaaatatttgaataacccaattaaaagtgtgatatagtgacatcaaaagaccccaaatccagacagaaaacactactcttttcaagtacacatggaacatctacaaatcttaactacgaactaggccacggaggacatctcagtaaataccaaaatactgacataaagtattccatgttctcacatcaaaatataataatttaagccaaaataaaatgagagccaatagagtacaataaaaaagctaaaaatgctttcaaataatccatgagtaaaataacaaatcataacaaacattacgtgatactttaaactcaacaacaacatatgtactacatattaaaatttgtaagaaacagcaatagtgacccttcgtggaaaagatatagactttcatgcacctattttaaagagaaaaagaaaagaaatggaaattaatgagctaagctgtcagttgaagaaaggtaaaaataacagaataaattccaaagaaagaagaaaaaaatgttttaaaacaaaatgcaataaaattaaaaacaaagaagtaagagacaagattaacatctccaaagctgctctttgggaaaaataataatacagactaacctttggcaaaattaaccaagggcagtggggtgaacgcaagttcacaccgagagcatctgtcaaattagaatctagcagaacgaggccaggcacggtggctcacgactgtaatcccagcactttgggaggccaaggcaggtggatcacttaaggtcaggagttcgagaccagtctggccaacatgctgaaaccccatctgtactaaaaatacaaaaattagccgggtgtggtggagcgtgcctgtaatcccagctactcaggaggctgaggcaggagaatcgcttgaacccgggaggcagaggttgcagtgagccgagatcgtgccactgcactccagcctgggcaagagtgaaactctgtccccccgccaccccccaaaaaaagaacctgggggagagaagggggaatatggtaatgatattaatcaaagaataaaaattgttctaaaagcattaaaggtgaaacgtgttgtaaaaagaatgacttaaatatcaaagattttaaaaatccttttcatgaacccctcaaatatgttttccaaaatggtctttatgggttctcctgagaacgtcacacatcttatactattatgtaactatgaccctccccccaaaaaaattgcaccaaaaaactaagcacaatttattctttgtgcatcctaagctttagtgcagagctataattaaaatctaaattcagttaaacaaaacatagaaaaattatttccttattttatatttcatgcttcaagacaaagtgaacaactttttttcaacttaccagtcagaagttttaattaagtctttgcaaacttgaagagacattaattgatgtagtattaaattgaggagactagtttgatatgcgataagaattagtacctaaatgggtttgatttcagataatgttaggtcagaagtaatatggtaagaaaaccagttggcaatatccagaccaccacaggagatacgacctgtggaggagatggagctattggcagggtgggggatgggtaagccgcaaacctcctgcctgatccagcaaagctccaaaactgaaggagctggaagcctattacaatacttccttgccctcaatagtttcagctacttctactggaagtatatgtattttttaagtgacattatttctcctgctaagtccacatcctaggatgaaaaaatgttcctgcattaaaaaacagtacagttagcctacctaaataaacatctacattttttcactacataaaaaatctctatgtataaattatgcaaaactagagcatttataacccttccactgcctccctctccttcagacaccagcaaatctctactgagccctaacacttttacctggttttccttgcctttctaccctatggcttcgcaaaggcctgggctgaactctctgtcaacatgtaagacctagacttttcttgttctgagccttggtccatccttacagtttgtggggtctgggttgtggaatcttcatactcgtcttcacattagttttggggtctcagctcctactcagttttcctttaactcagcttgccacctcaacacccatcctttactaagtagtgccttctccatctgctgggatcagcatgcttctagacttccaacagcccacttggttccaacatgctgccctctttgacctgttagtaccagcacgaaccctaaatctggagaggattccaggctctgatccctttgacaccaccctgatccaaatcactcatgaagactttcacttgagattccactgttgctgagtctctccaagactcctggacgcatcaccgcccttactccattcagagtcgtgggaaggtatttttgccccagttttataaagatgagggctgaattcatgagtgggtgagtatttaaaggacagactgcagaacaattagttaagagaaagagaatggacaaaggaataaagaagtgtaagtcaaagaaaaactcattggcaaaccaaagacagaagtgaacaatttctgacatggaagacaagatggataatagtgttgactttcttttaagaaggctgagtagaatgggaactaatacagtagtcccctcttatcctcaggaatatgttccaaaatccccggtgggtgactgaaaccaaaccttatatatactatgtttttgcctgtacatacatacaaacataataatgtttaatttacaaaataggcagagtaagagatgagcagcaataataataaaatagtacaatttttaacaatatactgtaataaaagttatgtgaatgtggcccctctctctctcaaaatattttattgtactatactcacctattttcagaccacagttgaccctgggtaattgaaaccatgaaaaatataaccacacaaacatctttctagcatcaaccacagcctcctctctgaagcctttcctaaccccagccaagcagaagtatcagattatctttccctaggttcacatgatcagattctacgtaatgttttccaggcctgatctccctatacatttttgtaggccttgagctatgtctctttatttttgaatcctcactttttcatatagtatcagagtagtattctttcctaagtagccattttaactccatttgcccttttttaaatgctaaattcattactctgttctaatgtatgtgcttatattttcatcatttcaccatctgcctcctatctgactatgagctgcgagggcatatctacttgatttatttctgtattcataacctacagcatagaagtctaatacataattgctgtatagcaaacgtttgtttcattgcaataaatctacatcttcttattaacatatgggaataaaacatgatccctgcatttgaggtgctcaccatctatattccacatataagctacagaagtaccatgtggtcagacactgctgaggaaacacaggtgaacatcagaatctgccattactcatcaatttccaacaaaaagagaccaacattcactgtccttatgtctgaatctgcccccaaaagaaatcattgcttaaattattataggtactctctcttcccatcaaatgaagcctgctgcatgccacaatggttaaaaaagttgaattccaaagccagactgcctggctttcaccccaactccaccccttgttatgcctgtgactttaggcaagccacttcccctcacagtgaagtttcccagtttcctcctctgcaaaatgagagtaacaagagcacccactttataggattattacgattattaaatgaattagcacatacaaagtgcttagaacagtgcctggcacatagaatgagctagctttgttatgactcattctaacactgaactcgctcctcccaaggtgtctcagagctccttttactttgaagtgcacaaatttaatgcaaatcaaaaaccctgggaaagaagaaatagagtggctattttcctcttatagtcagaaagatagacatttgcacctcactgggatgagaaaatgtccccatattcattatggtagatacctgctgggtgtcttcccatcttaccctccctgactcccctttcctgataataaacattccccgtgacccagtggatcccatcccgcctgtgtccaccacaggatctcacagttgagaggcccagtactaggcacctcaccagaactggctagcccaaccccttcctcgggaatctggagctggcctggtcctgtgaaacagtctcagaagctgctaatggcataaactgctcatgtgagctgcaaggcaagatggctggtctgcagtgagcaggtgaaagaaggaagagaaaggggttgcaagtccaagcggggtccaggtgctgagtcggtcctggcgccaccgtttctaaggccagtggcagccctgccttggaatctgccagacattgctgaccatttgcctgagctacctctggtcataatcattgctacacagtgacaaacggaaataagagtctacattccaatcgtgccgcaatgttcaacagaagatgaaagttaactttctaagaacgtcaatggaagacatgtggaagtctgatacacatcattagccaaagctatatttatgaccctttaatccatgaaaaacagccttcaattattaatctgaaatcacgaaacacaggctgaggttgctatcggtcacctccatgatgaagatacctctgccttctgattgggtaatgattaacggcattatacagaaaggaaaaaataaacacacgactgtcaacaggaattttattatacaacctacatgaaggtcattagtctgcttgcaaaactcttcgtaatcttggtcaaaatccattttccgctggtctaggaaattgtattcctttttctttatggttgccacaatgccctgaaatattatgagataaattagataatatttcaatattcttatattacctaactaaatatgacccttaaatgtagagcctatacaataattgccagaaaaaaaataagtttaaaggaagccttatttttttactcacattgttttgtgcttattattttacaggcagtataaggttgccctactgcattcaaagaaatcacttggaaagtattttcatgatgttttatgtatttttgaaaaaatgaaataaaaaccacacctgaaaattgggaaagattttttccactaaaattttattgttaatcatatctgaaataatttttaaagcccagagtagaatttactaaaatattctgtgttgaatagtttaaatcttctcagaaaataaataaggctttcacagaacacaaacaatataggaagaaaataaatgatgttatatctacagatgagttactaccttccaagcttcaaacatcttaaaaatgtcagaccagaatccaccacttaaaacctttctaaaattaattgtttcctactgccctgcaaagctgcagcctgtgactaggaaagtacaaactaggaagttcatctccttgaaaatactattatcagaagctttgtttgctttcaataatgagctataatgctctgcgattcttcttaaccaggtactaagccattctcaaactcaggtgcccacactgttgacagaagcatataatttttatgaagaatattgggcctccttcttctacaatctcctcttcaaagtcacttccatttaaacatcaaatctctcaatagacaaaagtgtataaacagcataacttcttgaatcaagtttactagataaaacaacctactttttcatgctgcataactacaaaattagttctatttagaaattgtgtgtgtatgtatatatatatatacttttttatataacgtgtgtgtatgcatggaatgttatataaaatatatacacacacacactatatatatgcatggaatgatacaatgtctaggatttacagtgctgatatcccttaaaatcaaaagaatcaaaagtatgtgtgtgtatgtatatatacacatatatacatacacatgtagcttttccatacttcttttagacattttatgtaacactatatacatatatacacacacatatatagtgttatataaattgtctaaaacaagtatggaaaagctactacattttgatgtagtaattttaaagatttgggaacttgagaaaatcctgctctatgactggatttaatggtcacttaagattattaagttaaataaaggaaatgattaatcgtgacctttacatcaactactcaaactcaatctacttaattattttcttgacagatatttattgcacatctactatgtgccagtaaacttaaaatgtttcctgctatataaaggtattttctttatctctcccaaaacttggtatactcaggaaatgaaaaagattccttatattgggctaaattgttagagtacaaaaattagtgtgtagtggttaattatatgatccttttcaaattcaagtaccaaaaaaaatttaagatttagtgtcactgtcccccaaaaaagaaaaaaattgactatgtccatattaagaatttaaagcaaattgtttgtaaattgtttttctaaaatcttcgaaatgttattaggtcactatgcccactttcaaaactaaaattagtcacacagataccatgacaagataaagcagttaaaaatcaaaataattagggaaatcacatctagaataaaatcaggtcctttatattttttaatatgggtccaaataaaatgcttaaatgcagagataattgagtgccacaaagtacctggtgtcaactagtgcctgatacagtatactcttcattaaatatttcttgcaagaataaataaaacaataagttacaattaaacatttttcttgtgctactaatgaaaatgcttttttaatggtgattaattttagactattggaaagtcattcttataaccacacacctgaaaagaacatattagcaccattacacaattctcaaacaaatctaatttctttattgttaaaaggccatgagattatttatattttactttacagactgatgatttgaatcattctaaacactgttatttgcataaaatattgaagtttagttgtggattatgttataaaatatagctttaaagtacaatacctggtatttagtggccatgtcttccagcccttcaattgtggaatcttgcaggactgaatacgtcttgagggttgtaaagatgtctattatcttggcaaggcgtcggtgaaaagtttcgaattttccaaaaatatacatctcgctaaaatcaaattgttttgcatttggattttgtttaagcttttgttttgtcttgtgaaagcagagctggtattccttaaaatcaaaagaaaaatatacaacaaagggaacaagaaaggtatcaactttattttcttaagtgaaggcgacagcaaaattaggatggaattgtaagccttttcatagtttcatgcctttgcttgtactcactcatcagcctggaaaatcatcttttcacctcctctaatctagcaattctagattctaatcgggttactcacgatgcaactcaaaggtgtggctttcccatcttggtcccatggttttggtaatagcatccttctatgactctctctccattcatcttaaagatgcttaaggaaaactacctcatattagctgtctttgtatctctagtacttactgtgatatcaggacatagtaggctcccaaggagggtacaaaaaggtgaataaatttcctgggaaggtatattaacattccattttcttcatagttaagaatcactgttctttttatcaaccaatgatataataattacaaaatgatttaagatggtctcaacaaaaataagataaaaagaatagaacatctaaatactaaactgaccattacctgtttcagtttaatcgcagatagtattttttcttcaacaacatcctgtggctggttccagatggaagcggttccattattggtaatataggctttacatgcagatataatctgatttgtcacctgggattttccaataaaatgatgttaagcacataaaacagccatggattgtaaactggactagaaggtccttaactcttctacttctcagagttcacaatcttctaacttgagcttgggtttattttttttccatcacagttataatccaccaataaccctttgatattgtcaaaatcatttgtgaaatcacagagttggaagcaccatggaaaatcgacaatttaggccaccttgtctatgcaggatgaatgtcttaacaaaacaaggaaggattcatttccttccctgaaaactgatgagtttccccaaatctccttaggtagcctgctctaatatctaactcacagtttactagcaccatgtaaagtactgccgatcctgatcttttcatgtgaccatgatcagcaatggaaatgtcaaaaggagaaggccgcagagagaaggaaaactaatgtacaaaaccactaacattttattcatctctccaaacttcacaaaaatcctcagaaatgtattaattttttggataaagcataaggaaaattaaatgactatgctgtatccatggaaagatatgatgcccaggatttacagtgcaaggggtgggggtataggtgaaacaagatcagccatgcgtggatatctgctgaatctaggtgatatgtacatggcattccagtatacgattctctccttttgtacctaattcaacatttccataatgaaaggttttttacaattagataaatggtggtttcattattttatgctaaatcaagttttgcaaataatatgcataaaatcttaattaataacacacatttacttgtgggtgtcatttacccagggaatactctcgcaaccctaacatataattttaacgtataaggaagttgggagggaatcttgcagccatccctcctgtctacctgaactacctacatgacagaaggaaaacgtttcctattgagctcttaaggctggatgtctttattcccaggaagaattgtgcttcctactgcgttagtattcagaacacgagtcttgattcatcaaaaattcttctattttaatataacacttaagatttttgctttgataatgaaaaagtcatttacttcttagagactgttcaaaatgagaatagcaacagtgcttaccataaacacttacgagttaggacataaggtttaagcatcgttatgttttttggcagaatcattataattgctttatagattactagaacattgcaagtggcttttattaccatgattactgttctaataacaccaagtaaacaactgtggcatcaaataaatttggaacagtggcatatgaaatatgaaacaggagatagccagttaaatatagcttttcttaattaaaatttacccagtaggaatacatgatgtgctaaaccacataggaaagaaattccaagagcaatcttttttcatttgtattatataaataataaaatatttattataataattactttgggaaataatgctttatgatttgctagaatcagcctctgacatcaatttaattctatctctattgatagcctaagcctttttaaaattttaagatacatacatattgaactgagccaatgtggtaatttttaattatcaaaaaattgatcactggcaaagaaatacaaatgaacatggactctacatcatgcacttacctttacaaacagagatgtgatcttctcagaggtattatagtaatgagagatactatagatcattttaattgcatttataagtgtaggaatagcatccatcatggatagctgaaagatatcaccaaagttttcagaaaaaatcatcaaattcagcaaaattctaatagactaaccattccatctgcattaaaataaagtttaagagctttctattaaagatttaaaaatactatttaatgctttacatgaaaataatatatttaatattaattttattagtcacatatggttaatcaaattttatttcagtggaagaaacattgacccactgttaatgacaagcaacagcaagttaactgttaactattattaaggataaactgttaataacagttaatgttgtactaagtaaaagcaggcacttccgaaagctaaaagattaaaaaaaaacatcactagctaatgacttttcccacagttctttggggtatatagttcagaatgtcctttgcaatatttaatggaaaatgtaacatgcaataaatgttttaaaatataacatctcatatacatcttcaatagataggaggtagactgcttagagaaatagatatagaaatacagatatttgtgcgtctgcgtgtatatacctatatatatgtaattttcttgaaaataaagtttctaagacctttccaatgaactgtaatattgatgaaacaaaattcaatattcaattcagctagtgcaaaaagggttatctatagactgaaagagtagaaatccttaactcacgggatcactgctgtacaaagggtcacaacatttttcaagtgtatacaagtatttcacattgtcctttgcttcattagttgcatcagtgattcgaatatccatctcccgccaagtctaagcacaatagggaaaagcaattttaatgtaattattaatagaggaacttccaacacaaccactgctaagagtcaccacaagtccattaggcgagaccttctgtccatctcacagaaaactgaatccagaggggcgagagatattgctatgctggaaagcaatttaaaatttttgactcaatgttttaaagcatatcttccagggcttctcatataaaatctatgctatgactatcacagagcaccaggagggcagcaccgccctttaaactcacacgttctcccctgcactggttagcagacccatttgataccacacttccatattttctatctttcctctattctaacctgaactcccttcctatatccctatacatttatccattaatgtagtaattgtttattatctgccaactgtatgccagtactgtgctatgagctaggaacttagaaatggaaagataatctaaaagtgagagaagtaaaaggaaattatttagcacgtcagtacattccattgacttcacggaagtctgactgatagtatttctgaactgtattgcaaggctcacctctgctatttctttgaggaataatagaaggtaaatctatagcacgtttattgcaacaaattattacgtatcaaaacatgcaaatagctaataacacccatgcaaatagttaacaaacagtctttccagcaccagtgccaggtgagttaggcagcctctatgacggtccccagtgaccacagactccctgtattcaagctcttgtattcatcccttctccttgatcatgggctgaatctagtgacttgcttctaataaggagaatatggctaaagtgatgggatgtcacttccagaattaatttacataaagactgtggcttctaggttggggactctcttgccctccttcacttgctccctttaagggaagccagctgctatgttctaagctgctctacagagaggcccatgtgggaaggaactgaaggaagcctctagccaacagccagcaagaaactgaatccagcaacaaccagatgagtaaactcagaagcagatcttccccgcgttgagccctaagatgaacccacatcacagctgtagcctcatgagatacccagagtcagaggcacccagctaagctgcacccagattcctggcccatagagtgtgagattgaaatattggctgtttttgttttttgttttttattttggcagagtctcactctgtcacccaggctggagcgcagtggcacgacctcggctcactgcaaacctccacctcccgggttcaagcgattcttctgcctcagcctcccaagtagctgggactacaggcacacgacactatgcccagctaatttttgtgctttttaagagatggggtttcaccatattggccaggctggtctcaaactcctgaccttgtgatccacctgcctcggcatcccaaagtgctgggattacaggcgtgagccaccacgcctggcctattgactgttttaagctgctaagtttggaggttgttttgcaatataaaactaatatacaaggactaaaaaataaatacagatagggtgagttttcattattattatttctagctggtctgaaatcataaaacatagatatatatataaacatgctatcatgttctgtcttaattacatacaatgccaataacacatatacatacacgtacaccagctaacaattgcctttcattcaaagactatttccgcagcctccaaagtgatgtgagggaagtattatgtaattttaaatgtttttcatcaaggtataataacatttttttgttcctaatcactctatgccttgaaaatatgcatagagaactcttattcccatttcacaaggcaaaatgaaatggctgacgaccttcagcagtttcgacttggccgccgcaagcactgccagcacagccttcacatccgggcttttcaattgttccaaaaggtagttaaacttggagagtctttttttccagtgctccagctccgctcgtggcccaacgtcatccgcttccttcagcagctgattgttttcagcaagaacctgcaaatgcgcggggaaaaacacgagccattgcacggggctggagacgctaaagttataaacaagcaaaaaacaaataaggaaatcaattatcctatctggatcatgatatatgcgtattccatgcttccaataacaatcttttactcacttagcatgcatccatttttaaaacttcaacgaaaatctctttgaattgttttaactgaaaacaacttatgctttcctcttttgaaaatagtttatattttggggggtttttaaagatttttgattcatacttttttcttttattgatacttattttacatatttatggggtacatgtgagtatttgttatatatgtagaatgtgtcatgaccaggtcagagtatttggggtatcatcaccttgagtacttatcatttctacgtgtgggtaacatttcaagtcctctcttctaggtattagattggtgcaaaagtaattagccattgaaagtaatggcaaaaaccacaattacttttgcaccaacctaacagtttgaaatatacagtatactgttgctaactacggtcacccaatctgcaatcaaaaactacctatttaatgagctgtaatgagcttctgaaggccatgacctcaggaatttttcttggctattcatttactctataaccttggaggaacatggccttgttaaattgcatggctcaggctagtggattttaattgtgcttactttgtaatgtaatgtccaccttcatgccttcattgaggacttttctgaatttgtgtttaaggtgaagtctcaagctcccttttggaggacatactaaattagaaaactcctcatgcttctacaggggttctctccaaagtaaattagacattgagaaaagaaactggcaaagtgcagcgtttgagtgatataagtatatgcagccattttctttcatttcttagaattcttactacctcttcttaattcatgacagtaaaggaaaaccacattggacctctcacctcctcaaggatttacagtaaaacgcttaacaaatggaatgtcgtatgtcaatacaccttcttccattgtctagcgcagtaatgtggcacctgaaattgatgtttggtttctcaaaattacctgttctgtctgtttgatccatactttcatgcaatcctctatttttcccaaagtctcagggttatttgctagagtcaagtagtccgtaggttcctttagggttttcagttcaagtatgtcacactttcgaaggttcacctaattagaatgaaaattaaataatcagatgatgcttttgtaaaacacacagactgtgggccctgtgttttccactttgctgcactctgacagcgctctggaaagcccaccaggtagcacatacctcctctccactcccacgtgcctttgtccacgctgcccccagactgatgggaccttccaacacttccctgtgatcctacacaacctcacaattcaacccaaagcccactgccctctcccactcagaaagaatgcctcctcccacctggggacccatcccattttggtaatacttttattgcaatatgaagtggacccatatgaaaaaaacactgcttttttagatagaatgccagcaattttatttttttagtagtaaaaatgtttgctttattcatgtatacatatgtaacaaacctgcacgttgtgcacatgtaccctaaaacttaacgtataataataataaaattaaaaaaaattttcaacatgtagaatgccaacaattttatttggtccaacctgcaatttggtctgccctccatcacagtcaatcacaaatataatttgggtgttagctggagtcatcctgtgtctgtctggataaaatttgcttaactcccccattccacatcctttggaaagcgtaatgccccttccccaatcccagcaggatcagcattcctgggagaggagggcagagtgtcacactgtcatcattaccataggatccatttccctacctgcccctacatgcctgatctgggctctgtcatctctcttattaccttatcttctctctctctccctctctctctgtctctctctctctctctctctcttgctctatctctctctcacacacacacacacacacacacacacacacacacacacacacaagcgtacatccatcaacctctgccccaagtaatcacaaacacagacttattataaacagcacaaatcatacagaaactaaatgtcacctttgccaaaattattcttaaaggcccttttgatcattggctgaatcacaggatcagacttgctctctccaaacatatcaattcctctttccttcttctgcttcttcaggatctcttcccacctccatctgccgcccacacacacccccccacacacacacacacttcagttccaaattcctttcattctaggatgcacagcagtgccacaagcatttctgactcttgcctttggagtcactcatctgactgactgagtaaagccctacaacactgccaacgtttttatggaacccctgaatgtgttgatcattacaaactgtagaaatttaaatctaatcaccaccacatcttgaaggagcaataaaattgcctacaaaaatttttgaagaactgaaacatagaggaattaagaccatctaagagaagcattacacacttatgtactgtgcttgttgaccacctgatcatttttaaaggaacagcttattcgtcctcaccttctccttcagactctcctgtgcacccgacaggacgttcacaaagccttccagggagctcaagaactcctggcgaatgttagctgcgtcctgaaggccctcgagctcgccccagccatggctcgtggctctgagagcaggaatgaagatgtccgacagcaaacgtctcacactgttgagcaggcctccatctgccgcatctaacatgttaaaactcacctcctggaaaacaggcaggagatcttttattgtaaaaatcatcctcaaatgcaacacaactactaagtcatttcttaaatgttgtcactttaccaaatacccagtaaattattagtttgtgccaggtgtggtggctcacacctgtaatcccagcactttgggaggctgaggtggggggatcacttgaggtcaggtgttcgagaccagcctgggcaacatggtgaaaccccatctctactaaacatacaaaaattaggctggtgtggtggcaggcacctgtaatcccagctactcaggaggctgaggcaggagaaatcgcttgaatccaggaggcagaggctgcagtgagccaagatggcgccactgcactccaacctgggtgacagagcaagaccctgtctcaaaaaaaaaaaaaaaaaaaaatcagtttgacaacctggttaagaaataagctttacactattctaaattgtaatcatcaaaataaaagcatgaaataaatagaataccagatgtttaccagtttatttgctccaagaagatagtgcacctgtcagagggaaggggaaaacttgtacagatgcattttactttgcacaaaaaaaaaaaagttatatatccactttcagaaatcttatcttaaatgtataaaatttgccattaagtaaattatgcatggggaattcattagaaaaagaaagccctcactgttatacacacacccagaaggttatatcaatttgtgttaataaattgaatattaagtcctcttactcaaaagatttaaagggaatgtcctcttaatttcttgctttaaatttttaaaaaatacttctctgaaagtagttttagatactgtagtgaatacaatgattgtctccaccagaggaatatttgtgtgcaagttgtgtgttttttggtaattcagagtaaacaatggctcttgccccttacctggtggatgttgtcaggggtgatggctttggaagggtcagtcctgatgaagaacacacataccccagtaagagccacatcgtttccctcggtcacgaacaccttaggttttttaatctttccagaaacaagatttacccctcctagagagccaagttgtcctacaaaagcaaaataattttagtttcacaaatgctttttgcagtccatgtggttccctttggaatgaagtttccttgttaaaatattgccattgttgacttgtccatgtgccttagatgggtccacctcttgaacaatctctagcatgagccgtacagggatcttaaaaaatctgtttgattccagatcataggttcacttcaaaactgttgtttcaggggcagtgaaaagagggaaggaggacaatgtatctactggcatgtactgtgttccagaccctctgctaggtaccctgtgtacattattaaaactcacaacccggctgggtgcggtggctcacgcctataatcccagcactttgagaggccgaggcgggcagatcacctgaggtcaggagttcgagaccagcctggtcaacgtgatgaaaccctgtctctactaaaaaaaaacaaaaattagctgggcgtggtcgtgggcacctgtaatcccagctacttgggaggctgaggcaggagaatcacttgaacccaggaggcggaggttgcagtgggcagagatcacaccactgcacttcagcctgggcaacagagcgaaactcagtctgaaaaacaaaaacaactctgaggcagctgtgacatgttccaagtcaaacagccaataggtggcagagccaaggtcgaaaaccagctctgactacaaaactcggaacccccacttccccatgctgtccctactctgtcatagtcagcatacctggttatatttcaaatactgctgcagtcagggtcttgtagaggtaggaccacttaatgattaacaatgtgggctctagagtcagattctcagaacttcaatctcaggctgcactcccagccacgtgaccttggcaagttactttatctttctgtgcctccattttctcatattcacatcttaaaaatgagaataatatggccgggcgtggtggctcatgcttgtaatcccagcaccttgggaggccgaggcgggtgaatcacctaaggtcgggagttcgagaccagcctgatcaacatggagaaaccccgtctctaccaaaaatacaaaattagccaggcgtggtggcacatgcctgtaatcccagctactcaggaggctgaggcaggagaatcgcttgaacccaggagatggaggttgtggtcagccaagatcacaccattgcactctaggctgagcaacaagagcaaaactccgtctcaaaaaaaaaaaaaaaagaatgatactagaacttagcatctgaaattgttgtgaaaatcaacacactgtgtaaagtccttagaaaagcacataagaatactagcctctgtaagcattattattatcagtacttgaacagtcatctttgattatccaagcatgtggctcattgagtagataatttaagtacatagaatacactctgagctgtttcattgtgttcttacctgcccaagaaatgtttagatctccaaatggaccggtagctcaatcaggatcactgcagtgggaggatggcgctaatggtggactttgggatggggagtggaccagaagttgaatcctaaaatcctgggattggaacctcttggagtaatcctccctcagggatcttcctcccatggtgctaggctagagaccttgactgtggcttggacagtgaaccctcattaaaggtaactagaagatcaatctccccctcattcaaaattgcatcccgctcctggctaatatcacctgggtctcatgagtaataagatgttaggcaacaagtttcaaccaaggcaccaacgcatgatagacatcagaaaacagaatttcaaaggaaaaaaaaatctgcagaaatttcaaagctgttgtcctagaactgattagacatcttctccctggcccccatcagaatgcaaaagggtcaagagcgtgtagactaaggaaggattttgtgaggacagttatgctaagtattagtccattttcatgctgctgatggagacatacctgagactgggcaacttacaaaagaaagaggtttgattggccttacagttccacgtggctggggaagcctcacaatcatagcagaaggcaaggaggagcaagtcacgtcttacatgaatggcagcaggcaaagagaggataagacccaaggaaaacagatttccccttatcaaaccatcagatctcatgagacctattcactatcaccagaacagcacaggaaagacccgcctccataagtcaatcacctcccaccaggttcctaccaagacacgtgataattgtgggagttacaattcaagatgagatttgggtggcgacacagagccaaaccatatcatgctatgcaaacggtgaggttataaagtgttcctacttttacctcaggtcaagaatgagactgcaactgtcccagcttgcccaggacaggggggtttgctgggatgcaggactttcagtgctacaaccaggacagtcagtcactccagtcaataaacaaggtcttcaacccaaccacctaaagagcttgatttatgtctcctggagtttaggaacaaaatgactgggatatgacacctgaccaagaaatctaagcacagtgctcaataaggcagatagagagaaactggactgcacggggagctaacagcaccaccatggagggcagggacctaggaacccaggtggggcccctgctgaaaagagccagactggagccaccttaaatcctactcaaaaggagcacctgagggaggatgggacagagtgagcgagactggtggcttagactaccaaatttcagaggccatcatcaggacagcctgtcacctcgggagaaaccaccaccgtgcccacaagagcaaggtaagagtgcaaggtcagcagctcatgacagcgctagtccagtaaaaattttcctgcccctcttccctcttacctctgccctgcctctggcctcacacagtcagccactttagttaagctgatgtggacaaggggtagaagacgaaggtagggagaaaagcacatggtcctccctcttctcctactgagaagttcaaccttcagagaaatgggaggttcaaggatgaggagggaagaatatttcgctttccatcaactggacagttttgctttttgagttaaggttgtgtttgtaatttgaaatgactatagaattttttgtaatctaagaacatccaggaaagtcacaggattgcttgcattctaatccaagttcagaaggactatcaccagtgagaagatttaaaggttaaacttggttttatgtttacatcctacgaacacttcttggtccaagtaaaatttacgcagaaggccagtttcatccagtgctccgttcatggataaacttgatctttcatttgagcttatgttttgcaatctggtgtagaaaccaaaccttctatctcttgatttttcacttaaaatgtaataagctttctaagcacaaaatatcaaattgacagctttgagaaaatgccagttcgaatttgcatgcataatttcttcagtttttaaacaaagaagtatagtcttactatatgccaagagcaatagctattttcccttttatcaaatgggtcataaaaaggatgtatataatattttaatatattaaataatacatttaatcagatattgacttatcttcctacttaggcctttaaaattacattaatccacttaaaagtagaatagactatgccagttgaatctatagaaagatttgcaaatttgggccaggcacggtggctcacgcctatatcccagcactttgggaggccgaggtgggtggatcacaaggtcgagagatcgagaccatcctagccaacatgctgaaaccccgtctctactgaaaatacaaaaattagttgggcgtggtggcgcgcacctgtagtcccagctacaggctgggactgtactttgggaggctgaggcaggagaattgcttgaaccccgggaggtagaggttgcggggagccaagattgtgccactgcactccagtctggtgacagagcgagactctgtctcaaaaaataataataataaataacaacaacaaaaaaaagatttgcaaatttttcataaatgagaatgatgaaacctgtcatccaatattatttatttaaagcagagtcagtagaaaattaacacaatgtgatagctaactaaaaaggggtgttacacatgctggcaataattcctatgttaaaaagaaataatgcctatatacatgtgaaacaggtgcccattataagttctagaacataaaacacagaatgaactagaatataagaaaaggaagtcaaacgtaatctactttattatcttcattgccagcacagcctgagaaggaatatgagacaactccaataaagttagaacaaccaggctaaataccaactgtaatctgtcctccatccttgaggtgaaacagaacttcttccacagggccacaccctacacactaatggtttcccacatggacccacacacgcatctccctcccgcccgcaaggtgaaacaggtccgttctcacagtagctttcttcttcaagctaccctcagataaatctaataacacatttctgggttatgtcacatcaaattcagatacctgtttctgcttcctccacatcttgatagtaaaacatgaggtgtcggagacctccaacagcaaaaagttgatcaattctttcaatctgggaaaaagaaaaaggcaagataatgattttcaatccaaattagaaactgcaattaaatcagcattaataatataaaaaaggaaaatttactgtcatctttcttattcaaacaggactgcatctaatgtatcctataaaaaagggagcatttacatcaaaagaataaatgtctcaccatagtaaagactctgttcaaaaaagtaatttcatgaatcatagaaatatttgctacttatgcacatttgaaaagcattgtccatctatatttgcaaattccctaaagtgttgagctgttgaagggagatttaaatagagatgagtgcttcagtcaactgcagataagcaagaacaaacctttcaaaacttagtctaacactctagagataattaatattaaattgcaataatcaccaaaactgccatgagaacatatctgactatgaacacaccttccagtaagcaacctggcactaagctgggactaagagtcccatccctgaggctcactgtaagtctacaagtctaacaaatggcctgctaccaacagaaacacttcttttaaatagtcaatagcactgtttggaattcatatgaaaataaaaagataaaatccacacacccattaggcattaggatggctaccaccaaaaaacagaaaacagcaagtgctggcgaggatgtggagaaactggaacccttgagcactactggtgggaatgtaaatggtggagccgttgtggaaaacagtatgaaggctccttaaaaaactaaaaatagaattgccacatgatccgggaactccacttctgggtatatatcccaaagaattgaaagcgggctctcaaagagatatttgtatacccatgttcatagtagcattactcacaatagcttccacaaaagatgaaagtgacagataaagcgataaacaaaatgtggtatacatatacaagggaatataatccagccttaacaaggaggggaatcctggcacatgctacaacatggatgaaccttgcaaaccttacactaagtgaaataagacgatcccaaaaagatgaacactgcatgactccacttgtgtgaggtacctatggaatagtccaattcctagagacaaaaagtagaatgcgggggttgccaggggctggagggaaggaggactgtggagtggtagtttaatgggtacagcgtttctgtttttgtaataaaaagcattctgaagatttattgcacagtaatgtgaacgtacttaacactaatgaactgtacacttaaaatggttaagatggtgaattttatgttatgtgtatttactacatcttaaaataatgtttttaaaggataaaatctagcctgaacaattaaatgtgaaaaataagtccccttcaatttccaccatgattgaagatgccacagggacgaggaggaaggactccccaagattcaattccaggccaagaatgcagtgaagggcatgcttccatcacagccagtattgaagctcctatccctcccctctgtgcttgagagcctgagccagatgctttctttaaacctccaggttctgacatccctgggttctgaccttgacataggagtttaacctggtatccctacagagctgaacttttgcctgcttcttccccttgcatattcccaaatccagatgtctgaattgggaagcagggtggagttaagcatttcacctctggaacaatctccccaagtggccctctctgcttttatgcctccatattctgggaataatattatctacctcctggtattatgaagatggaaatgaagtcatagatgaaagagactgagaacagggaccgacacatggtaaacattcaataagtgtcagctatgaggagaaggagaaagaggagaagcacatttcctcagctcctgcttgatccatcctgtagtttacccattttcgtgttatccattcttaattgttccccaactcctactaaccccaccagagtagcccagcaggaaggaatgaagccagtggtgtgccacagatggctcgtactggcccaggatatccaatggatcataactctttacaactcaacatttcgttaacatgatgatagtagtttggaaccagccattgtgggagtatttacaccacagaaattagcagattttcaaactagtacctccctgcctacttcctccaaccttgcccaaatccagttgttaaaatttacaagactaccactgaaaagaattcccaacggtgtggcaccctgtcagcaaaaagggcttgtcttctttcttttttttcctaatgtctaattagtttctttaaaaaatcttcaggaatcatcatagggctgcttatgtgcttttctcactgcccaggaaattatatcttcccatattttggccttccctaaccaaggtcaaacacaaagcaaatcacacccccagttttaaagaaaaattgtagcagaagatgggaacaaaagcaagcaggttaggaacaaaagaaagcaggttcagctgccaaaccaaagtgaaagccagaaaatcatggcacaaatccagtgcctagaacaggggaaatgcacaaaagacgaatcggcaacttgaaacgagattctgttccccggctttagtttccaaaatggcatgagagcccagcttcactggatgtagagagatgcagacaatgccatcagaatcacggaactcaaatgacaattagaagtgcccctattcaacatggagagctggagagccttaagctcattctgcaagcaccagtacagagtcagaatggagccctgtccacgttaagacaggcacctccctctgggcacagcatgggatcctgccacaggactgtgtcaacagaccatctgtgccctccatcatcaagtcagtgagaagtgaaacgcatcccacctgattcccttcaagaatggcatcctccacttcggttttgttcaggtccaaacaggaagccacaattgcaaataagtagttatgcctcgcatccaaaagagcccgcttggcttccttctctcccttcagtctttgctaaaagaaaagaataaaaatgttacatggaaactgctgttctcaagtggattcattttgtaataatttcatacaattgttgttttttcaagtcttaggtatccagataatagacagcttaatggtaccaatttttatgtactatcttctatttttagaaataatttatttctcttatgaaaataaagcatgctcattgttgtgaaattgcagaatacagagaagccaagagagaaaaatctgccatccagaaattattattgttaacattttgttctaaatctttacacacttatttctatgcatatataagcattcaacagaatatcaaaaaaagagatctccatttttgtaaacattttcctaagccattaaagtaatattttttctacagtatctcctatctttattgtttatctacagctacatatttggtcttgaaattaacttctgaataccattgcttgctctttaactatcaattgttaattatgagaataaggcatgcttaatgtaaccaatgttggcagtttgaagcatgtctttccttatactgtatgatcatacaatcctattcaaacatatgcacacacctatatttacatcatactataaaatgttttcatgcatttctcccttaacaatgcatcacggacttctttctagtttaatacagactattccatcctgtgtaatagctgcaaaaatattcagtatgaatgtaccatactttattcaactattttgacactggtagacgttcagcttccaattcattcttggaataatacattacctttaatgccaaccagtagctcccactgggaagaggaaaagtggcccctctggatcccttcttttaatcaacaaacatttgttaaacccctaatatgtgtcagcactgaagagactaacactacctggtaacctcaaaaaagctcatggcctggctggcaggatgtgagctgaaaatttaaatatgacagatggcatggcagttgccacagaggcatcagatttatgggtctccaaatgcaggggcatttatgggtctacagagaaggagcaaaaagaagggtctcccactctagcctggagttgataaggggtaggggtggggatgacaggacagctttcaggaggaggtggctgaagcctagcattgaaggagggttggtcatactcctaggacagtcgcctttctgcatacacaaaggctgagaggcacacaaaagcacattctgaaaaccacaaggtagccaggatgtgtgaactaaaaaggactaggaaaacataataggaaatgagaaaaaagtcagataataaatattttctgaaccacattacaaagtttaactgttatgtaaaatccacggagaatcactgatgagtttcatatcaagagagataggtgtttagctgtctgtgcagcactgaaaaatccatcattctggcagcagtgtggaaagtaggctggtgtgatgcatgcccagaggcagtcaggtgggtgatggtggcattcccagacactgggttcatcaagaggaacaagttgaagcaacacaatcataagttcagcttttggatgtgtaagattttgaggtgactcaatacacaggtggacgaggcagacaggccactggaaatgttcaaggggaaactgcattgcagatacagataacatgcaggttctcaatttagcacgatgactttatgagacagaccattcttgttgtgaggagcagtcctgtgcaatgtgaggttttagcagcgcctttggtctctaacttctaggtcccagtagcctccaccaccaactcctgagaataaaaaacgtctccagacattgccaaatggcccctgtgggacaaaataacttctcctgttcagaaccactgatatgatacagacatatatatagatatagacataggcacatatagacatagacatagagaagacggtcaatataaaagctacaatgtcaaatcagtgtgaaaacaatgtggtacctgttggagttgtgcagtacagaacctgcaaaagtacacatcaacagctctttcaaccagcaggtggtatgtgcattcaataaatatttgtcaaatgaatgaataaatcaaagtttaaaccatgagtgcagatatgattttctaacaaacatattgaaatgaaaacacactaaaaaagtgaagaaaattggggaccaccagtatcccaggagcaaggagaaaaagaagtgcaaataaagaaagctaaggatgaggttgggcacagtggctcatgcctgtaatcccagcactttggaggccaaggcgggtggatcacctgaggtcaggagttcaagaccagcctggccaacgtgccaaaaccctgtctctactaaaatacaaaaattagccaggcatggtggcatgtgcctgtaatcccagctacttgggaggatgaggcaggagaatcacttgaacccaaaaagcagaggttgcagtgagccgagattgcaccattgcactccagcctggatgacagagtgagactccacctcaaaaaaaaaaaaaaaaaaaactaaggatgaatgtgcaaagagatagaaaggagaccaagaaaccgtagtagcaataaatcatggagagtgaccaatagcaacaatgctacacaggattggttgggttaattaggatatctttagggattgtgtttacaggatggttgcagcttctcacagctcttttgcagtgtgactgtgccactaacctgtcaagaaatagactgtatttcccctccccttgaatttggctagccctatggccagttttcaccaaaaaaaaaatctgagggtaaatgagatgggacttcctaagctagttcttaagagatcttcaccttctgcctttgcacttagaatgttgcctcagaactcagccatgtagggagaccacatggaggagaacaaaaccttctggtcagcggtaccatctgaccttctagctgaccccagcaccaactttcagccatttgagtaagctgtcttggatgttccaacctaagtttcccctacagatgacagcaagccagccaatggcacctgcagaagaaccacccagcagagcccagtcactcacagaataaagagagataacagatgattgtttctgctttaggcccttaagttttggtatggtttgtaacgcaaaaataaataatagagtaattttgttagaataatttcattggttggacagaaataaatatagacttgagaaaaggatgattgggaaaagagaaatataaaaatgctgaatataaactactttttccagaaacttgactataaaggaatagggtatggtagtaatagagaggaaaatttagagtcaagaaagaattttttaaggtacaaaagacttacagaaaagtaaagatgaaaaagttggagatttcagagcaattgaaaggttattgctacacctatgtaattgacatacatttctctgaacttgaaggactacctatctgagagacaactttgctggggaggtggcaagaggcaggattcaggtttaaaaaatagataatctacctgttttctcaccatttctttaaaaacaaacatgttagttcattccatagacatcaaataaaagtacatttaaaacttttttcaaatgtcactaaagccaggaagatgtcctgttgttttgaattgttttctgccttcctggcagggagaaataaaagacttttctctaagtgatcactctaagtttgtgctaaatatctttagcagcttgagaactcagaggtcaaccagggagccaggaattcagcaacaacacaaagagatggcaaatgcttggtagccaaaactaaaaataaaagaagtagacagccagaagattcaagatgtaaaggaactgagggcttccaaagagcacagagatttaaaaaagattcttccatggcaaggaactgaggcgttccaaagaacacagagatttaaataagattctcccatggcaacacattacttcataacccaattgtttctgattccagagaaaaaaacatcctaatgaaaaagagggaaatcactccctaaaatagaagactaattattctatttttacttaaatatcacaggagaaagaaacttccaaagcagctttatttatataaagctaattattgacatatttttaagtaaatgttttcagaagttatttaatatatttaaaagcacgttaagacttgaatatattttcttatgtaaactgattgttctattgcctgaagacaagtaatatgaagtcaatcctagtgtcatatagatgaaatgccacaatgtttatcaatctcaactttcattgcattacactaaggtatcctgggaatactgaaattgctttttaactaccataaaaaagtcaataatgtcaaacaaatatttagcaattagaacagtgcactgtcaatccgcagacctaaccctgcagctttctggctgctaaggaactgcagcaacaagcagtcaggtgactagttctttgggggttggcttgtcctgctggcctttgaaacacctaggacacttggaaagtgaaggcagagagggattaagaaggcaggaggtaaactatgtcaagacttttctggagtcctactaaaattgttttgcattgcatgaaaaagcaccagtgaataggggtggggaacatggccagaaatctattcaatgtccaaggaaatctagagcagcattaaaacattgcggcaatttgtgatatgttattactgccttagaatgggagagtggctaatgtactacctcacaagaaaggagctctgcttcccaggtggccaatcctccacagacaaaggagcactgatgtcagaatgaggtggtaaggttctagtcccagctctgacactaattgcaagacctcacatctttcatttaacctctccaggccacaatttcctcaactacaaaatgaaagtgttggactaggtgacagccaaggttcattccttcttcaatatgtggactacttctcatgacttcaaacgtttacacaatctacagactcaaaattttaaaatacaaatcctaatgaataccccaaaaagctcagtgactgtctcaaaagtaatctatccatctgatgtttaaaaaatactaacatttgcctttaactctgtagaaccaaagtccaagtctgcatgcttatatacacaaactgtgtataaactacatacatgatcagtctttcattttgtctctaggcttataatcctcaactatatgggagaccttatagaaatgaagataaaagtaaaatggagataaaagtcccaacttgaaagaggtttgtgagggttaaattgcatgcagtttggtgatcacactaaatcaaacagcactcgaattaaaatggcatgaccaaggatttgatcctggacatcaaaatttaagtgaaacaaaacattttcataatgatttcttttaattgtacaaatgtttaagcttcctacacccttatgaagctctgccttgttgacaggtttgttcctgacacagatctactccactgaccccattggcagccagcagaagtggatggaggatggggctattgggtctgagagttcttttgtgcctaagcaaggacatcttttcccagaccctcctgaagtgtatattttgcattgtttgccctggttgcattgccagcttggttctgttagtcatcatttgctcactatgttttggtttaattgtcacaaaatccctatgaagaagacgttattatctccacaccaggaaatcaagactatggaccattaactgctttcccaaaagcacacaactaagaaagtggcagggttgggaatcaagcccttgctgtccacaggaccagaccaagacataggatgcccaagggcaactaagaattttgcataacttcaaactgatattccataagcactttttaaaaaatatgcgcttaacagttatctagtgtgctctagcaggagaccccatacaagggttatacgaggagttgtagatggagaccagttaactagcaccgatttcctgagttatatcagtggtattttagtgccagtgtggactggtacccaggtgcttccagctgggattaatgtattcagttctcactgcactcctgtgtctctcagaaaatgataacaccctcaccccatcttctactcctgaaagtgtctcggaggttagttcctcatttgggtagtcagtaggtgatgctccagattccccctactcactgctgcttccatctgacagtatcactgttatcgacatcatactgcatataccaggtcctcatacaatacctttgcacggggaagtgggtagggaaaggaatgggttctgcagccaaagaatatttggttgttaaagaaaaaagtttttctaggtgacatgattagctttgttgcacgtctgaatctgagaaagagaaagagatctgacttaaggaagttcagttgcacacgttgaaatgaatatatttctatttgtttgacttgagcattttgttctttatatatgtgtattcatacagtaatgtaacaaatataatagagaataatataggttaaaatccccatctgagatcattgtaaataatgtattctatgaattacagccattctcctatccccatccaaggtttccgtttctatggtttccattacctgtggtcaaccttgttccaaaaatgttaaatggataattccagaaataaacaattcataagttttaaattttgtgccctttggagtaatgtgataaaatctcatgccgtccaaatccataccacctgggatatgaaccatcccctcatccagcatctccacactgtagacattacccaaccattaaccatcaacatcatctgctcccggcacccaatcattgacatcatcatagctcaatgatccaggatcacccaaagcacacggtccccctgctataccatcagatggtcagtagcagtcaaacactatatcacaatgcctacagcattcacctcacttcatctcattatgcaggcttcgtgtcacctcacatccacacatgaagggtagatacagtacaataagatattttgagagagaaagaccacattcacacaatttttattacagtatatagttataattgttctattttattattattgttgttgttaatcttttactgcacctaatttataagttaaagtttgtcataggtatatatatgtacatatgtatatataaaaaatgtaaatatataaacgtacatatatatacatatatatgaaaaaaacatagtatatatagggttcaatcctacccatggtttctggcattcagtgggggtcttggaatatattccccctggataagacagaactactacatggttaaagttccttatcttaaataactaaagtaaatacatccatgactgatttccctttggctgtcaatgtcaacctcaagtccacagataattgatcacttgatgagaacacagtgctaacgaaaccaaggacatggatttgatcatctcaggccagctaacttcactttatttcatcttccccaactgtggatgaatcaggacaaattcacgagcagaaaaagaaaattattcaacgtgtatgcctggctgaaatacctggttattggtaaaatatgtgtttcttttctttctttaaagacacccaaatggtttagttctcctatctgccacatatattacctgatccttcttatctcctgagcagtaaaacaaagtaaataacaagagaatctcatcattcctacaggagtaccagctttacagggaagggatgttttccattttgatttattcgatagcagcagtgtcaacaacaggccctggcacactgaagatcctcaattaatatctctaaataattttaaaattattttacaagtcactctcacgtaattaagggctggaacaaattatcctagaccaacgtgagtccacgattgcagaatcaaaattaagtcaataggatccatgctgttgtgcctggaacataagtgactacacagaattctaccctgggtaggatagtagctccccctcaatttacagcaaatacagctaaccttgctttacctgcctcccgttttattttgttgaattagagaaactgagggaagcagttctctaactcatttacccttagagccctctacaatcaaccctgtttccctgtcttcccacagagaaaagcctccctctttgtcttccagcttctctgtttcaacccacagggccccgtctcctttcccggcctctctcagagagaagaggctgctctgtgatgcttcccagcccagcctaacctgctctctaattggctgggagaaccacaatttagagactctccactcctaactgtacttttcaagtcttgccttttctgactcccctttcgtttcatttatcccggtgaagggccacagctgcagaggaagcacggcacctccttccagaattaagcgcacttcagtaaagtggtttcgggaaagaaaagagatgacacgctggctaatcccactcacagcaggtgctttagtgaagccctcctctatttaacaagagccacgctttccctctattgcaaagagatagcacttaagcgtgtggtaccatccattttcttctgtccagggataaactttggcatcctgtctatttttgctggagttcccaaggcctctagctctccctatttactcactcccttacctatcattccttccaggcaaataaagaactctctctttagcatttacgatgtgtgaattttccacccagaccaaccccaaatctgctgtaggcatatcccggtgtccacagcctcacctcccccgacattccatcatccaaattctaacttagagtctgttttctgcacaccaaatttctggacctgaagtgagatctggtggaccttcacatggccatatatcctctttccctaaccccacagtgatttcactccaaaatcagaaatgcctctcatgtagaatttcaagaggtctctctggcagcagggaccatataactcaaatggcccttacccatatgctaaaaatatatatatataatatgtcaccattcacgttatatatggcacaggagtggaattccaaaacttcccttattcatacaacaaaccactgtgcttaaagctggccactcattggaatcattggagagctgtaaaatactgatgcctgggcctcccacccctgagaaatcctgatttatctggtcaggtgcggggcccaggcaccggcatttctccaaagctcccctggtgattctaatgtacagcccagcctgacatcactgttctcaaggaagtcattttacaaattgatcctgatggattagtatgaccgagttctcacttgaggtagaaacttaacagagaaagcccaaggacataaattttgggatcttctaactctaacttctccttttctccttactagacttgtgcaaaaattgaatgatagaaagaacaagttcagctctaaattccatggtgtctagaagggtttttccctgccatatcacagagcacagcacttagtacaaagtaggcatccaagagagatttgtggaatggataagttttgcacatacagttacattcccccagggtctagctatggcatgataatgatggggcatcttttggccttaactagttcaggctagagagtgctcagtgggcctttacaagcagcactggcacaatggctcatgtctgttatcccagcactttgggaggctgaggcgggaggattgcttgaggccaggagtttgagatcagtctgtgcagcatagcaagactccatctctacaaaaattacaattaaaaaattagccagatgcggggatgcatgcctatagtcccagctactgaggaggctgaggtggaaggattggttgagcccaggagttctaggctgcagtgagctacgatggcgccactgcagtccagccagggtaacagagtgagactgtctctaaaaatggaaaaaaaatttttaaatagacagtacctctctcttcccagctaaaccctagatccattcaccttccagtgctctaaggaaatggttttgatctgctctatgtgaaatttgttgacttggccaaacaggtctgggcctgattaacagcacactgaaaatggtttggttaatttgccagagaatgagaaaactgacatcttttcagatttcaaaagataatctgagagcaaaggttctttctgtcttggcttctactaagcaccccactggaaacaatggctgccctcctgcagagcttctcggcgggagagggaggtgtgctctcttcccccacagcttctacccacaagagattcactgttcagagaaaacctgcagcaatctgaaagttcatgagcaacagcattccctaacagaaacacatacagcacaaaacaggaacaacacacattccgctgcagtggggagaagacttttctccattttaaaaccagctttgcaattaggtaaatttgacagtctagaggactaccatctatctttcaagttgttcttttttctggaagtcaacaaagtcaaccaacaaagttatagacttcagtttcattttggggaagtaaagaaaaacagaattcaagtctggaattcatgtccgtcttacacctgtaacttggtactaagcattctttatctctgagaaaagcagaaaaaagacagacatcagatctggaccataatttttgcaaatgagcgaatgaatatatacagaataatttcaagtttttaaatgaaaataacgtgtgtttattatacaagagaaaagatatatggcttgactttgtttatggtacatttggttgttactggcatgatatttatggataaagtcaattattacattacagtagcctaattataacatagcatcattgcaataatagttccagaccttagcgtggaacttagttaaatatatatggacttgtagttaaatacatacatacttatagttaggtagctctggaatgtttcccattggtcattttcgatcatgaagttataatataataagctatcttatcagttgacaaactttccttgcttggccaaactttagtcaggttcctgaatcttctcctaggcccatctgtacacttccttgtaaaatctagttttagcaaagaactctgctaagtcagttaacaagaacccctgtagagggtactcaatatctgatcaccgtcagtcgctgattgggttcctcatcctccaccatcccccacgtgctgtctcatccccctggcctttcttcagcaagaatcctggtaggtcgtcagtttagccagaatccccctccccattgatgtctcctctaagcactttcctatccactgacccctgccctgctccttggctacaaatcctcacttggccatgccatattcacagttgagcccaatctctcccatcactccccagataggtccttatacctaacacgacggtcgtgaataaagtcttactttaccatgctttaccaagtgtcactgaataattttttttctttaacacagtgcactaagtagaaactgtgtaattatttacataatacactgcaatactattaaggtaattctgttaatattatacttcagtggagtgaaccaaaccagcatcctaaatatataattgaaacctccaaaagacttgacttactctcaaaacatagttcatgtcaaggaagaataattcattaattatacctgagattttatcatcaattgtggtgtttcagacttggtactgaagcacaggaaaaatgttcagacatgtgaaatgtttaattcattcaacttattccacaagcatatattaaggaccaagcatatactatggaccaagctctgtgttaaaggaagattattttaaaatggagagaactcgcaatctagcaagagaaagagacatgtgggtaaatgtcatttcactacagtgatgtgacaaggactctataagacatcgaaggaaagtgctgacagggtacaggaaggaaactcacacctcctcctcaaagtgtcaggggacgcttctcagaggaggtaacactagcacttggtcttgaagaataagcagtgcatggactggctggagtcagctcttccagaatggtcttctaactctagcaagcaagttcaggggcttggctgcaagacgttcaccttgggaaggatgcatcagaatcttgtggcttgggcaagtgaggggtggcagatggtggcatacttaaaaaattcagaggtagatgcctgctcttttgtggtaaaaacaacaggctaggggggatcatgtgagcttctggggatacacaaaaagacacagtgatcaagcccagtaggaagcatgggttaatggttgagaactgagtcctagagaaacctccaatttcttctgacgttaattggcagtggaagaggtttccaaatccctctctatgcatttgcataataaaaagctgctgagctgagccctgtgctagggaagttcattcttcaatgtgatttccaaaggcacagccttgcatctcactgtctgtgacctcatttgcaggcatatagaacaggggagtgatttcaaagcctaaaccttgcagcctagaatctgccttaactatttctaatcaccaactaaagtttacaggtttgaaagaatacaaagtgcccaaaccactatgaatgtgtttttgaccccaggaaagcatcttcccaaaagatgcagcatgaatttctaggtgcgtagtttaagcggcaacgtgcagaaaagcctacagatgcaaaattttttttatttaaaaaatgaatatgtagcctatgcaccaggtgaacattagttaaaaaatgtgtttctcgcaaattcatcagtgtgtgactttgaacctttttcaagtttgttttttccacccaggtgtgacagatgataatccaaaacacacatgcaaaggtacagacaacagcaccttaccgttaaaactcgagtgacgctatgcttccagagctgtctcctcccaatcctaaacattgtagccgtgcatggacaggctggagtcagctcttccggaatggtcttctaactcctggcagacctgctcaacatccaacaggcttccaaatggaaagttttacttccattttactttcacgtttctaatttgcatgtattattcactacattcacagaataaaaattaaaactccacttataccactcaagtttttctcctagagtgtctgccctgggcctctcctctctctcgaagcctggtgttgttagggtaatattgtttatacactatacagttgaaccatgcctcttaatcatgtttatcaagcaatcaaagcattttaactgctcggtagcaacacaactccttctgttgttcaattaattctattcactgcccaataataagcattgagtcaacagtgatatctaaatagtttctttgaacaatgagaaactttaaaccatatcagattagaaatccaagaagccacagctctgaatatattgtccatgtcgagaaactcagtcttactttgtgtaaacaactttgcaagcacgatgcactgccagcattgtgactaattgtgactaattgccagataggctaattgtgacccataggagccattttctccaccacaaagaacaagaagtctgtttcatatgcaaatagcaaaccatgtccataaattacttgtgctcacacagttgcacatacacttcagccaaggtaatttatcctatgtggctaaacatcttgatcatcttaactgtgaagatgtaatgggaaaacactgccaaatgctttgagagatctctcatgtatggtttctcccatcgagttgaataaaaggcaggacacttaaggttggtcttgttgaatctagaatttagtccttggaattcacagtccagcaactcaaatcctaaaaggtcatccaaggataatcaggaaattgggaactcatcctggtaacatcctgctagtcaacctctgtggagcctgacttggaaggcagggtgctgacatggtttcagaacatggagattcacttggtccatatccaatgctagggcacggacggcctccatatgtcaggttaacagacaacatttagacctcaatattatttggtaagtaaataactagaacacaggaagtttaagtttgtttgcaggattttttttttcttttttgagacctgcaggtctcactctgtcacacaggctggagtgcagttgcgtgaccaccactcaccacagcctcaacctcccaggctcaggtgatcctcccacctcagccttcctagtaactgggactacaggcaagtgtcacaacacgcggctaatttttgtattttttgtagaaacaggtttggccacattgcccaggctggtctcaaactcctggcctcaagcaattgcccacctcggcctcccaaagtgctgggattatacgcatgagccaccaggccaggccctgcaggatatttgttgaagtcaacctctggttgttggtaagcggctgttgtccgtttctaataaaaagtgttgaagacagtatctagactctgagtcccttctctgtgtggtgctgaagacaccagaaaatagcagtaggatcggatcctcctcacatggcatctcctatccatcccaagaatcctctgtcaacacatgacctcaggacaaacatgttacaattcattacatcgccgattatctttcattagttacatttgaatcggtgcttccctaatggtattttaggcaccatcctcattgcagcagcagcccatttacaacgcatcgcttggggagagttacttcctgggaagatttccacagatggctgatggcatgcattttgtgtttggcaggcataaccatgactcccttgaggcttcacagcaaaccgggaagccttccagtctgtgtggctgaatttcaacccctcgggcaaggtagatggcgtcttaaggtatcttcttgagcgctcaggctcactggaagttgttgaacaacacaaacaaagcaagccaaggctgaatttacaacaggccacctacccccgccagcccctgccagaatgaaagtcaatttctggcatttggagggaaatgatcaaacattgttcggtaggaaactcagaaaggcttgcctacaaatagtttccaccaggcaagagcttcagctggcagggctctatatataggactcacacgagggaggtctgcagccccgtctgtgcggatagtacacccttccaggctgaaaatattggtcatacacaaatcctgtcagacataatgggaaaacaagagtagacaatggacctcatgtgggcggaaggcttcatccagaaatccaagtacctgcaggcaaagtttgaagttccactttcattcattgaacaaaagctcgtgagtgccttttacgcagccagacgctgcgctatacactatgaatagaacagctaataaaaacagatgtttactcagacatttaaaaatattaattgtagaatgcataattatcctatgcaacactcggaatgaaaaaataatgctgcctattcaacatatccattttaaggtgcattctgatttcacagatgttaaaatatgaaaaatgtacatttcataatcaataaaaaatggttattcttgcctttactgggggtagatattaagcaaatatataaataaatgtataatgacaagtaaaatgttacaaattttgataagtgtcattttaaaagaaaataaggtataagctttatgtggacatatgttctgaattgttacctttacgcttacattccaaagtgtaaaattttctaaactcatctctaaattatggagtcatctaccctgcatcttgaagcctcgtatgtacatcccgttccatatggcttaatagaaaagtgcaactttggggtcagacagacctgaacttaaatcccagctatgtgacatcagatattttgtctcctaaattagacgttagaaataaaaccacttacctaaaactggtaatgatttaaatatatttaaatctcctagatcctcataggcacctaataaatgaaatatataaccacattttttatctgcaaaagagttatgactaccatttatggcaatatcaatggagaggacgaattcctaaatcttaacctaacccacacatttcagtcgagagctggttgaaaattttgctctcaatttctgagtatgtcctagcaaaagagtggatccaagttttatcagttactagctacacgtttttcatggatttccatctttaagaatgtcttactgaggcccaacaggatcaaacacattcatcagtttaatagccttgtaaacaatgatacaaactacagcatataaaaatggcaaatgagttcagtgggatgagagagttccatatttcacccatcaagcgctgcacatttgtcttcacgctttaccatattgaaatgtggtcattccaaatgcaacatgatatttcatcttatattcaatgccctcttataattgctgttggccagacaaaaatcatgacatgagtgtccttaccagagcttgtgcacacccagctgtcacccaagtggcaccacaaggccacaacaataccaggaagttacagccaacaaaccacagaagctccatgtgaggaagaaatgtgtgtcccggttgttttctagaaatcttcactgtcaccttctgggaagatccagaaaacaccagcactgcaacttgcaggaaggatgttagtagattggaagaaaatcccagaagagtcagaccctacatgtgaagaagttttagaagtttcttaactaattcattgcacttatctttgtatggatgcatgggggtgatgtttaaaagagcttcaattaaaataaaattgaaattctaagaaagcaatgaagcctagtttaatggacaggtgtttttccttcttggtggttaatgacacagtaatgtgtttcatctgataatggattaggtcagatgaatacagttttgtgagttctaatgatcaaaggaaacttttggagaagggagaatttaaggcaagccctatagaagaataagattcaaattagtagataggaaaactagagtgtaacatatgtgaaaaattatcttggagactggaattcaacagagcccgtcttgtgctgcaattttaagtaaaaatgattgattaatctctgaaaggtatgttgaggctgaatggtgggcgtcaatctaaggtagtgggccttgcaggcaattaaggagtcactgaattaatgaaagtcttgtttaggaaggttatgctggtattatagctgcacgccggtaaggatgaagtagagagagactgaaggcagtctcctgggcatgaagaaataaagaattcaatagagggaggtggaaactgtggtcacccaaacaacctaaaaatgaataaactcgcaagctgaataaaaggggcaagtctccttgtctctgtccaatatattgctgcccctaagctactcctctagagaaatcctggttgaggaaggaatgagaaagaacagatagaacacaccagaaagaaaaaaaacacacacaaataacaatggaacttgacaaccggtaacagagaaaaggacaccattgtcagagaggattccatgtttcccagcttgggtaaagaatcatcataacttaagcagaagcagaggaatctagaaaaagtacattttggagactagatgactaaggaaatgtaaataaagctctaattctttacttttccttttggtctttccatcttgaaaacatgaaggccagtatgattatatgcaagacaataaacatccagtatctttttctttatacaattgcaattttaaaactcacaataaaaagaaaaaactcataataaaaaggaaataaaggaaccaataatatagtattgatgccataatcatttgagctatactcacaaaagaagatagtgattctaagagcttcaaatggagtgatatggttggttgattttgtcaccatttttatggattgaaattatacagggtaatcttgaaaagatgcacaagtttcctgggagactcatctgtcaaaattcaaaagagaggatgggcaagagaggagaaactccagaggaggacacagaaagctgatgcatttagagtaaacactaagagcatctaagttctgccgtttggaggaagagagcggcttggggctaaacgcactttccagatgttatcttgcatagtgcctttcatgtagaaagtgtaagaattaggaatattgggcactaacggagggatacattaaagaaaagactgtctaagaagtatctctgtcttccctggtaacacttccacatacctgtagaaataatgttgtcctggctttaggacgttacgcttctgatcctgaatcctgtacatactggttgcttaggtggcctctgattaacaacgagccagctacactggccccattttcccctaaattatatgagatgggtggcccagtgatcttgcaggtaacttctggctccaagaaaaatgcacaacctaagtgaaggatctcagatcccaagcatactgcatgctgaaagtaactgcaatgttatcttaatatgatttctacatgtactatcttataacatggtacacaaaacattagaaaacttatgagaccacttgatcatctgagatgaggcctatcacttaaacactgcagtactgttatgcctatggtaatagtgttttctccataagagttttttttcctttccagatgcccatattttgaacaaattttgctccccaaaccatgatacttgtattttttttttgagatgggagttttgctcttgtctggagtgcaatggcgtgatcttggctcactacaaccttcgcctcctgggttcaagcaattctcctgcctcagcctcccaagtagccgggattacaggcatgcgccaccacgcctggctaattttgtatttttagtagagatggggttcctccatgttggtcaggctggtctcgaactcctgacctcaggtgatccacccacctcagcctcccaaagtgctgggattacaggcaagagccaccacacccagccgtattctttgtatataaagctgtagtgctttctgaaatttttctcccaaacctacacacacaaagctcatgggttgtgaatgaagacatgtaaattcaattttaggtgcaaatcaccaagattattatagtaagtctttctggcatcctgcttttggttctgctgcatagcacagttatgtttcatgttgagtctcttcagatagtatcgcctagcttggttattgcagttgttacttgcttagaaccaaaatttcagcattatggcatatagaaccaagaaaaaaaaaacttctttattagaagcttgtttgtagttatcatctaaaggacaaccaacagcttgggaataaccccatgccttaattacttgtactttcagaaattcaaagtccatacaaatatacaaccacaattaattagagagataggaagagaacccttattaatgtgatgcttcttgctttatgaaagcattaggagctgatggtcttcacattttgctaccttttaattgatatttttccacttcacacactggcattctagggcaccaaatcatgattattttcctgaatataaagtaacaatattcatatactctgtctcttttgttttttttttgtttttttcgttttttttttttttttttttttttttgaagcagggtcttgctctgtcgcccaggctgaagtgcagtgatgcagtcatggctcactgcagcctcaacttcttgggctccagcaatcctcccacctcagctccccaaatagctggaaccacaggtgtgcaccaccagattcagctaatttcttacttattttttgtagagatggggtcttcctatgttgcccagactggtctcgaactcctggactcgagcaatcctcccgcctcagcctcccgaggtgctgtgattacaggcgtgagccaccatgcctggcccatattctctctttttttcattgtgattgagtttataaggtattcattgaaaaggaaaatatatttcatttcataagtcattactcatgccaagatctggtccctggttttgaagacatcaagcagcagttaacaacggggagaaactcaccagcctgcaccctcctgtgcttgctctgtcccatcaacagacacacaccaccctgcagaaaccagacagctgtggaaaggaaagtggagggctccagtttccctgagggatcattttgggggctatctttgctgttatcacagctgtgttagttttcattaaaaagagaaagtaaaaagtagagttaggtttaccagcaaacataaaaattctcctttaaccctgcatttaggtcctctttgcttttctcttgtgctaagatatcatgaaaatggtaacttcaaaatcatgttgtcttcctatagaaagatttaatgagaaaagtgaatcaaatgtcatttaatgtaaaataaaatcctgataataggaattgtttgttgactcaagagacatcttctaaaagcaacgaagaatcaccccagcccagggcctctaacatcaccccatcagaagcacattaattaactagagggatctcccaacttgggatagcttgacgtttatcacaaataaaaatccgtgaaaataagcaagacatatccataaacactgatggttagcactcacgcccacactaaggagtctggaactaaaatgagatgcattgatttgaaaggcagaaaactcctgattacaagaatgtgatcagagagagcaaatccatttttttaaagcacgcagcaatttctgcaaagaaagttctgtctctgaaaagcttaaaaataggctcagggagacatcaaaggaagatgtttctagccagagaaagaatgatttgatcaccccagaaagagagcacttggtggcagatcagagttcaaggggaagctcaggggctgtgtttttgatgactcccaacctccaccaatatcaccgcaaattcagagggcagggatcaatatgtcttacccatgactgtatttctgggttttccaactgctcattaaacgaaaaccagcccatttataatcccatccaggacctaattatgtctttaaatgtcaaactaccaacaattacaaattgtattagagttactccactatcaagaaaacaatatttacattgccaaggaggacaaaaataacccgtttatttacccattgctgttttcttcagggttttttaaagagacggggtctcactctgttgcccaggttggagtgcagtggtgcaatcatagctcactgcagcctggaattcctgggatcaagtgatccttccaccccagtctcccaagtagctgagactatctgtgtgttcagtatttgacctttcttaaacactgtaacataacttgtgataaacgtcattgctacttaatgcgttgtcacaagacaaatctctgacactgttgtttccttcaagagcaaaattgctattaataaaatattattttagagaccaaacataaacttcatttctcatacacataaagaataagttcatcttattgctaagaagactaaattatagaaactctgtacggatcaaatgtcccttcagagttttcttgaggatgggtttcaacacttctcactaaaaccaacatcacaacttcttgacggagcagaggtgaaatgacacccaattaaagtgaatgtgtatatatatatatacatttctatcataaatacatttgacaatagctttagaatgtaataccttgttcctgcttccaaaagaattgtcagcttcctgattttccatctatcatgaactcttctactagaaacagttaacattgggccttatattcaaatgtagcccctgggtgggttcaaacattcaaatgaaatggcacaattaactacataaatcaacagtcattgattgaagtaaattccaagttggggacataaaggaccttgctatgaaaacataaagaacaagataaggcaagaattttgaaaatatagcccttacttggtgattcagcatttgcaatggaattaatctgaacaattactttcttttgattgttttaactttcaaatattatatcattcaaaatgtgggatgcttcttgttttgttttatttttggttttgttttgagatggggtcttgctctgtcacccaggctagagtgcaatggcgcgatctcggcttgatgcaacctctgcctcccaggttcaagtgattctcctgcctcagcctcccaagcagctaggattacaggcgcctgccaccacgtccagctaatttttgtatttttggtagagacgaggtttcaccatgttggtcaggctggtcttgaactcctgacctcatgtgatccacccacctcggcctcccaaagtgctgggattacaggtatgagctgccacgcccggccagttcctgttttaatagaaacaaaagacagtaaagaccctaaaggtcaaacctggtggtaaaatattttttctacatggtaagaaaagtaagtccatattttaggtgtgatttaagaggaaatgttacatattttaagaaaatactttagtgtactcattcatctcaccaaaggcaatcaaaacatatttattaagcttccctgatataccctgcacgatgttattcaactataaaacacttccttcccagaaagagcttataatccattaaaggagataaaactaactaagtgaaataataaagtactaaattataagaccttatgaaggttgcaggaatccagggtgctataccaagctcatgagtcgacacgtggaaaatatacccttttatatgcaataaggtttacaggataaggaaagaacttttcataaaactcagttttgaagttggtctaaatcactttagtgaaggaggagcaattgcatgtctaaaaattagaaggaaaaatgtaaaagcttaaataaagtctgcaagctcttccttttgtaatagaagaaaataaaggaaaacatgttcctgagagaggtgttccgaaagtgagcgagagcaggccagggaaagtcatttctctctgcttctccactttcttcctccccctttcccaaagtagagggttaacactcgaatctgttccaacagaaaattccagaaggaaggcagtgtttccccgttgcccattaaactgccccagcgttgatctcgctgctactttttgagtgaggcctgttctgccttccacattgggacatctctgactctttctcttttaacctccctggctgctttctatctcccttctttctgaccctgaagcctaaaggaaaatcatctcagccagttctcacacgttcactctcactcatcaccaattttcttgccattctgtgcttcattttgaaacaacttaggaccacacaatcaacgcgaagtcaaaggcagactgatatggtttggctctctgtccccacccaaatctcatgtggaactgtaatccccacgtattgaaggtggaggctggtgggaggtgactggctcatgggataatttctaatggtttagcaccgtcccccaactgctgtctcgcgattgaggtctcacaagaactggttgtttaaaagtgtgtggcacttcccccctcactctctctctctcctgccaccacggtgagatgtgcttgcttcctctttgccttctgccatgattgtaagtttcctgaggcctccccaaccgtgcttcctgttaagcctgtggaaacatgaatcaattaaacctcttttcttcatgaattacccagtctcaggtatgtctttatagcaatgtgaaaacagactaatacaccaagagaactcagcatcctcagtgggtttcactgccaaacaaagaatggaagaaaacagggtgtgtccagctcattacataataataacaaatgtaaagaaacaaaaattggaggggttaattcactgagtgatgtagagcagtaagagaaaatctattgcttttttaatccaggaaatacacaaagttgaaaacagcagtctcctaggagaaaatgtgaggcaaatatgactaaaagaactaaggctgaaggcaatttttctccaaactgttatcctcatttgggaattacttttttctctttaagaaaaaaaagaaaattaataaaatggaaaacattttaaatcacaaaagtttgtcctacggaaggttttcaaaatagtaaacaatctaattagagtttatatttccctaattagttctatttaactctggtagagattaaacctttttaaaatcagttcaaaactcttatttcaatattaaattttactctaatatacaggagaaaagcaagacatgaggggagggaaagtccttgccaagagcgtgcaacaatgaagaaaaacagaacaagaatctcctaccttccctgcaaaccaccaccgctgtccacgctcaccagtggggtggtacatgctcttccctaaatgcactttcatagggtctgacacacacttcattccatctctgctggtcactgtcccattcacgtgtcaagaatctgttcccatggcccttcctctatagcattcttcccgaatcttatgattcccttctctgaaattctacagctcattccttgaatctaatcattttcatactaaataataattacattttagaaataaactttatgctgggatattttttaaaataaagactatgaatactgtgactagcacaatatctgccatataacaggtgctcattaaatatatgttgaatggtaatttttaaacatcatctatactgtgtatagtcatcaaccaaaactattttctctcattaagtaatacctctattctgtttttatccccttgaaggtgtcctttttcatgccattgttgttctcatttttgttattgtcttttatctttgttaacttgttgctatagatagtgagttatttgaggatatgcagtaaaagaactcataagtaagtgtaaaaggcaaatcccagcccctcctttgagtgtcactctgcccatgcgtgcccctagttagacagaagagagaaactgcttatcctgcacttctacgttcctctattagcagagaccgaagtgtgaggtttacagcatgattcaactgccacattttttcctgcatagcaggtgctcttttttattatcattttattgagtgattatcaaatgggatagaattgcacactgaaatttcatgaactgaattattcataaaagtgaatttcagtatactgagcatcaacttaccatggctcagctaaggttcacaaatattttccttacagagaattgttgttgcaattttatttgtagtgcagggatgtcaaattggcaaagttctactattagtaatggatctacagtccatgaaaacaacactgtacctcaatcaacagacaggtttatctagcttttttctttttaagaagaaatcctcagattctggttacaagatttacagcatttcaatctcatgccctataaaaccttatgttcagaggttaataaaatgagattaatccagagatactgcatgttgaattcttttctcccttcaagcacaatatgctaaacaaagcacagtctacactacagaaggagagactctggaaacagctgactactagtggaggttagctgccatccagtggctgaaagtataactcacccattaaccattagcttgaagagctaaggaaatacaaaacagacccatgtctcatgagtacatcaaaggttatcaattatttacacttattgtctcatatttacaaagaagacagaacagtgggaaagttactgaatgctttaatgaaagagaagccagtcttctctttttcaattctaacccacaagaaacttgtctttatgttctgatgatttccctttcaaaaatttccaatttagacattttctctatctatatcatatggcccaagttaaataataaaataattataaataataaaatatatcttactgtgtggaagatggtacattgaagaggcaaaaacttttatctcaatctttaaagaggaaaatatgtaaatatatccatatagtaatcccaatattgatagttacatagtgaactctttgagttgattttgatcatttcctctcatttaaaatgtaacatcatcttttctttaagatcattaactgcttttaagtaattccaatacctgtatttttaaatatactttattattatgaaaataataaaaattgattggaaaatagaaaaaatcaccataatatgaacactattaacatatattcttctactccatgagcaataaatattctagctcccgttttcttaaaaataaaatacacacatgtatatgtatatatgtatatatacctttatttttagtttaaaatgtatcatgtacacattctcatattattgaatattcttcaaaatatgatctaacgattgcatagcatatcaattacataggccttgatttatttagccaattttttttttacttttagattggttccaatttttcactattataaataacagtataatggatatccctgcatacaaatccttggtataaatctctatttattaatttcaataaattattataaaattcatctctccaaaattatactctttgatttccatgagaaatttaatgtaattttgttcatctttacaaatatggtagatgagaaatggtaagttgctgttatcttcttgcaagtttaatttgcaaatctttgacaagtgaagctgaacatgttaaaattatttactgggtatttgtgttttgttttgtttttatttttgtaaattgcctgttcatgtcccttcctatttttcttctgataattttctttccattgattttatttttaagactggataaagataacagcacacatccagaaaaaggaataggtgcctcaatattactcttacatagagtagaattaaagacaaaggcattaaagatttggaccaagacagccattttattttcgtaaaaagtaaaattaactatgaatatatagtagctatgtgccaaaaaccagtactaaaataaaataagcaaaatctgttagaactacaggtaacattaacaaaaacgatagttaaaggatgttctaatagaatgttttaacaggaatatactaaaccttaaaatctcccccaaattattatcttacagtgccatagatagttaacaaaattaatcattagaacacacaaaaccttaatgcattttaaagagaagtcacacaaatcacaagctcctacaatgttatgtcagaaattaatcatgaaggaattttatgtttctcaacagcctttttgttgttgttgttgttgttgagatggagtctccatctgtcacccaggctggagtgcagtggtgcgatcttggctcactgcaacctccgcctctcaggttcaagcaattctcctgcctcagctagaattacaggcatgtgccaccacgcccagctaatgtttgtatttttattagagacggggtttcaccatgttggtcaggctggtctcaaactcctaacctccagtggtcagcccgcctcagcctcccaaaatgctgggattataggcatgagcctctgtgcctggttctcaatggcttttaattttagaaagagttgagtcctcgcagaactccaaactgcagatacaggccattttgaatataatgaatcccactgaagactcaagaagactgatagagagggaagaggcagacaagtgtggattctctctgtcttcgagaatgccaggtggtgaaggttggggagaggtgcccctcatcaggccaacttggccaaaccagccccaagtcagaaccaggcttcacatcttcatgccatgagtgcaggtcccttttcggaccagcccagcgcccaggacagtggggtccttgagaaaaggattggggccaccaaggcagagaaaaggtgggacctggaggtggttttacccccgtgggtctccctcttcattccttaccccaagtcctctccctggaattctgtgtgagttctatcaagattcctcagctgggtgtggtggctcacacctgtaatcccagcactttggaaggctgaggcaggcagatcacctgaggtcaggaatttgagaccagcctgaccaacatggtgaaaccccgtctctactaaaaatacaaaattagccaggcgtggtgacacatgcctgtgatcccagccactcgggaggctgaggcaggagattctcttgaacccgggagggtggaggttgcagtgagccgagattgcgccattgcactccagcctgggcaacaagagctaaactccatctcaaaaaaaaagattcctcatgactgagtccaggaaaaacacccccagaactggactcactcccagctacagtcaaaatgcaaagacaagaatagaaaaggagtgttctgcttccctacggcatgaggggaacgcttttatcttcaaaaaaaaaaaaaaatccaaatctttagtttttgatttagcatgctgcaaaagttctttcaatcccaggagatttaaaaaaaattgttgagttaggttactctggtggagcaaatgcaagaagcaaggtgaggagaaacgaggtggaccgtactgtgttacagtgaatgtgaggaggtgcacagatgagtgaaccccaacactggaggggtgaacactaggcactgatgggctcacatcgtcatcatcttgctggggtatgattgaaactaatatccctttttcagaattcctaactctctgggttggcaaactatggctcatgtgcaaaaactggcccattgtctatttttgtaagcaaaatgtgattggaacacagacgtatttattcatttctgtattgcccatggctgcgttcatgctacaatggcagacttgagcagttacaactgagagctgcaaagtctgtaatatttatttatctggtcctgtacagaaaaattcgctggcctctggtctaaaccaacatcacacacaacttggctgtgcctctcttcttacgtcagcataggggaacccctggccaaggcacagcccggctccatgctcacctccctgggagtccctcagtatccctcctcccacacccaccctctccccgtggctactccacacgcaccatgcctcacttactcatcacaaccagcctcatgctcagcacataggtgcccacgtgtgcccacttccatggggtcatctttttgatatcgagtattgtgagatgggattgggcttagttccacaagaagagagaagaactggaaaaggctgcaatagcttcctatcattccccctaccttcttcagtatcctgaaagcctctgaaatctccactctttccccaacctccaagggaggaaagaaattggaatgagtttccccaggcccagttctgctgtgggcagatttctttgagtcaggaaaggcaggtaaggaagaagcttctttgctgaataagtttttctatacctccctcccttgaccactttccagttcttttctgtatatatttaataatataaaaatcatctttttaaaataaaagagagtattactatacccattttccagatgaggaaactgagagtgagaaaggcaaagtacgtttccagtatgtgtaatttttaacaaaagtgagtgttcctattcccattttccaaatgaggaaactcagagatggaaaggtaaagcgagccgggcatggtggctcacgcctgtaatcccagcactttaggaggctgaggcgggcagatcgcctgaggttaggagttcaagaccagcctggccaacatggtgaaaccccatctctattaaaaatacaaaaatcagctgggtgtggtggcgggcacctgtaatcccagctactcaggaagctgaggcgggagaatcacttgaacccgggaggcagaggttgcagtgagccaagatcacatcactgcgctccagcccgggtgacagagcaagactccttctgaaaaaaagaaaaagaaaaagaaagaaagaaaggtatggtaaagtgactcgtccaaagcccacggacaaaatgatcccatcttcactacacagcattatgagccccttggtgagatgcctcccccattcctcctactaatccttgatgctcaactccctcccaacctgacccaaagcttcctccttcgagaagcctgccttgattgatactctctcctgatctgggtactcctctacatagaactcaatcactaacgcttttattatttgtttatattattttaattgtgtctgtttgtgctttgctttcaatgcaaagcaggtgccagtacatacatatactttttgaggttttctttattatcaatagctttattgaagtatacttgatataccaaaaaactgtacatatttaacatatacaatttcatgagtttggatatatgcatatacccatgaaaccatcaccacaatcaaggtaaaaatatatccctcaccttcaaaagcttcctcatgctgctttgtggtttttggttttgttattatgttttttgtgtgtgggaagaaccctgaacatgattgataagcacctgacttattgtatgtaaattgaattttttaaccaaataatatttttatttatatgacataacgcaagtttttcacaggaaagcaatatgactctaaggaatcatgaaaatcatgttttgataccttagaaaacaataagtttctcataaaacattcaatatgctgcaattttagcattatagtacacatctttgttttctaaaggttcttttggattgccaggaaccaaaaaaaacagtctcataaaacccagatgttaaagagaaactgaaccagacacttcctaaaaattgtaagacattttattcaagctactgcagttagagaagacagacttcagtactgagcttaactccaaatacagcaaaagcagctggagatttttagccaatgggcaggcatcagtagatggaaaattactaagaggaatttgatgagatatcaagtgtggtgggaaagaagaacttgattagatataaaggggatggaacgggttctccctaaactggcttagcaagattcctactaaaactgggcttggcaggccaaggacagggccaagaacccagctagtcaaaaagagggccctgacaaaatttggtcagggaagggagtccttgtcacaggtaatgagagtttaagacacacaagcaaagacaaactgtcccggcagctgctcggccagcctcacaggtaagtgccacgtccatgacaccccacagcagcggtgcatccaccacagtcgccgcgtcccaagagcagggagcatctccctgcccaagtgctccgccattttgagaaccagccaccttctccctctccctgtgtttatactgttcctatcactgcttggatccgctagagctcctgcttgatgtgagacaaagtaacaatcataaaaagccatatttgctcatttcttcttgccagaataatttcacaaagcccctgactctgagatgacatacaactctctaaaaacaaaaagacaaacaaaacagagcatatggtcctccatgcctcttgcctaaatcattacattccttaaaaaataaatgacctggtcggaagcggtggctcacgcctataatcccagcactttgggaggccgaggcgggtggaccacctgaagtcaggagttcgagaccagcctggccaacgtggcaaaaccccatctctactaaaaatacaaaaattagctgggtgtggtggcgtgcacctgtaatcccagctactcgggaggctgaggcaggaagaatcgcttgaacccgggaggcagaggttgcagtgagccaagatcacaccattgcacccagcctgggcaacaaagcgagactctatctcaaaataaataaataaataaataaataaataacctagtcttgttttttcctacacataagataatgtctgacaggattagtaattatacttccataatctataaccagatatactcttatacccgaacattaataaaattgctctccccactacccccctcctccacagtggcactatcatagctcactacagcctggaactcctggactcaaatgatcctcctgcctcagcctcctgagtacatgggacgacaggcatgtgccaccacgcccagctaatttttatgtttttttgtagagacgtgatctctatcctcctatcctcaagtaatcctgccacctcagcctcccaaagtgctgggatcacaggcatccacccctgcacacaaccgcaaacttcaattctgcttcaacataccttctaaacaagtctacagtaattttacatgtaccgatccctggccacctctacataagcagtaggctaaaacactgtccacagtagtctgataggactgttcctcagctataggccttggcctacagtcctcagtaaaactgtaaataaagctaactttaattctttaaacacttgactttttttttcctttagttgacaatcatggcaccccagataggactcagagcagacagcccagggtcacctagaacattgcaaggactgagcaccttagtaccaaaacgggccttttgagcccctctggctcctccacggttgcaagtgactgggtgagtctctcctgagtctcagacctcccacttggttgatggtcctggaatcaactcccagtgactgggtaaatggcaagaaaggaggttattggaatgttactgaaaaggcacacaggacagacaggaggatcaggctcagaaactagatgggaaccaagaggggctagaggcagagagatcgctcaaggtcacactggaggacgtggactccagctgcacttgactctcagccctgcctcagtggtcaccaaaattgggctgcaagtagccttgaccttagatcattccctcctgattccaagtcccagatcagtggacccgagtaaaggccctgaaccatggcagtggccatagggttggagatgagacagaactgacagaacctggtggctgagcagaagttggggatacaaagatctgagggtgatgccaacgtgtgtttaaagatatatacagtatctgaagtaggatcaggaatgagaagagaaaatagtgccaatattgtgaattaaacagataaatgcctttgggccccaggaccctttgtcatttctcaccctaaatctcctctcttttgtcccctttgtaccagatagtaataccttcaatgtccaaaacataccatgtgtctcccaatactgtgttccgtgaaaaatccctccacctcgtccactggggaagctcctgttctttgtttccaacttggttagtaattactccttcaaggtgctttccctaatgccagtccctcccctccatcatcatagcctttcattcttacacacggcaccctagagggtcaacatgtgtttctagaactctctcccattctaccagaatgagcccctcaagtgtttattattgagagggcattaataatattttaaaacctgtatgttaaaaaaaatgatatgtaagtcaacagacaaatccgtttttttaatgtcttcccttttattctctggataaactggacatgattgataagcacctgaattattgcatgtaaactgagttcttctaagtaaaataatatttttatttacatgtcataatgcaagtttttcacaggaaaccaatgtgactctaaggaataatgaaaatcatgttttcataccttaaaaaacagtaagtttctcataaaacattcaaactatatatagaacaactaacaaagtcttgtttcacatatcatcccaaaagacacgctttgtttaaggcattatttggcagagagaactgcatcagtctcttccaaccaatttcctccattaatctgacagttattcagtggcaaagtcctggagaatttctctttaatatcagttacattgttcatggggctggatgttcacccagttcctcctgaattaacagcaaatatattcgaaaatgtcctagccctcctaatactagatttttacatattcaaaatcttcactaacagctgtagtgagctgaatattattattattttattttttatttcaataggtatttggagaacaggtggttccatggatatcaaggataccaaggttccatggacaccaacaggtgtaaccatagataccactggctacatggataagttctttagtggtgatttctgagattttggtgcacccatcacctgaatactatccctcacccccctcccatcctttcccccaatccctaatgtccattgtatcattcttatgcctttgcatcctcatagcttagttcccgtttataagtgagaacatacgatgtttggttttccattcctgagttacttcactctacatgaataatggtctctaattccatccaaggttgctgcaaatgccattattttgtttccttttatggctgagtagtattccatggtgtgtgtgtgtatgtgtgtatgtgtgtatatatatcacattttctttatccactcgtcaattgatgggcatttgggctggttccatatttttgcaattgtgaattgtaccgttataaacatctgtgtgcaagtatctttctcgtataatgacttcttttcctctgggtagatacccagtagtggaattactggatcaaatggtagttctacttttagttccttacggaatcttcacacactgttttccatagtggttgtactagtttacattcccaccagcagtgtaaaagtgttcccctttcaccacctccccaccaacatctattttttggttttttgattatggccattcttgtggaagtaaagtggtatcacattgtggctttgatttgcatttccctgatcattagtgatgttgggcattttttcatgtttgttggccatttgtatatcttcttttgagaattgtctattcatgtctttagcccactttttgatgggattgtttgattttttcttgccgatttgttcgagttccttgtagattctggatattagtcctttgttggatgcatagtttgtgaagatattctcccactgtctgtttactctgctgattatttcttttgctatgctaaagcattgttttttgttttttgctttttgctttttgttttttgagacagtcttgctctgtcgcccaggctggagtgcagtggtgtgatctcagctcactgcaacctgcacctcctggattcaagtgattctcgtgcctcagccacccaagttgatgggattacagatgtgcaccaccacacccggataatttttgtatttttagtagagatagggttttgccatgttggctaggctggtctcaaactcctcacctcaagtgattcacctgcctcagcctcccaaagtcctggaattacaaccatgagccactgcacctggcctagaagctttttggtttaattaagtcccatttatttatctttgtttttgttgcatttgcttttggattctggatcatgaagtctttgcctaagccaatgtcaagaagggtttttccaatgttatcttctagaatttttatggcttcaagtcttagatttaagtctttgatccatcttgagttgatttttgtgtaaggtgagagttgaggatccagtttcattcttatatatgtggcttgccaattatcccagcaccatttgttgaatagggtgctcttccctgctttatgtatttatttgctttgtagaagatcagctggctgtaagtatttggctttatttctgggttctctattctgttccattggtctatgtgcctatttttacaccagtaccatgctgatttgatgactatagccttatagtatagtttgaagttggataatgtgatgcctccagatttgtttttttgtttgtttgtttgttttttgctgactcttgctctggctgtatgggctcttttttggttctatatgaattttacgattgctttttccaattctgtgaggaatgatggtggtattttgatgggaattgcattgaatttgtagattgcttttggccacacggtcattttcacaataatgattctacatgaattttacgattgctttttccaattctgtgaggaatgatggtggtattttgatgggaattgcattgaatttgtagattgcttttggccacacggtcattttcacaatactgattctacccatccatcagcatgggatgggtttccatttgtttgtgttgtctatgatttctttcagtagtgttctgtagttttccttgtaaaggtccttcacctccttggttaggtttactcctaagtattttatttcattttttgttgttgttgcagctattgtaaaaggggttgagttcttgatttgattctcagcttggtcactgttggtgtatagcagtactactgatttgtgttttgaagttctgctgaactcatttatcagtgctaggagcttttgggatgagtctttagagttttctgaatatactatcatatcatcagagaacagtgacagtttgacttcctttttactgatttggatgccctttctttctttctcttgtctgactgctctggctaggatttccagtactatgttgaatagaagtggtgaaagtgggcatccttgtcttgttctagttctcaggggggaatgctttcaacttttccctgttcagtataatgttggctgtgggtttgtcgtagatggcttttattaccttgaggtatgttccttctatgtcatttttgctgagggttttaatcataaagggatgctaaattttgtccaatgctttttctgcatctattgagatgatcatgtgatttttctttttaattctgcttatgtggtatatcacatttattgacttgcatatgttaaaccatccctgaatccctggtataaaacctaattgatcatggtgaattatctttttgatatactgatggatcaggttaggtagtattttgttacagatttttgcatctatgttaattagggatattggcctgtagttttctttctttgttatgtcgtgtcctggttttggtattaggctgatagtggctttatagaatgatttagggaggattccctctttctccatcttttgaaatagtgtcgataggattgatatcaattcttctttgaatgtctgatagaattcagctgtgaatgcatccatctggtcctggaatttttttgttggcaatttttttattaccatttctatctcactgcttgttattggtctgttcagaatttctatttcttcctggtttaatctaaaatagttgtatattcctaggaatttatccatctcctctaggttttctagtttgtgtgcataaaggtattcatagtagccttgaatgatcttttgtatttctgtggtatcagttgtaacatctcctgtttcatttctaacttagcttatttggatcttctctcttctcttcttaattaatctcactaatggtttatcaattttgtttatcttttcaaagaaccagctttttgtttcatttatcttctgtaatttttttgtttcaatttcatttagttctgctctgatcttggttatttattttcttctgttgagtttgggtttggtttgttcttgtttatctagttccttgaggtgtgatcttagattatctatttgtgctctctcagaccttctgctgtgggcattcaatgctaggaactttccttttggcaccacttttgctggatcccagaagttttgtcacgattatctttcacttcaatgaattttttaatttccatcttgattttattgttgacccaatgatcattcaggagcaggttatttaatttccatgtatttgcatggttttgaagattccttttagagttgatttccaatttcattccactgtggtctgagagagtacttgatataatttcaattttcttaaatttatcaagacttgttttgtggcctgtcacatggtctatcttggagaatgttcaatgtgctgatgaatagaatgtataatctgtagttgttgggtagaatgttctgtaaatatctgttaaatctatttgttctagggtatagtttaagtccattgtttctttgttgactttctgtcttgacgacctgtaactggagtattaaagtcctccactattattttgttgctatctcattactaatgtctactagtaattgttttataaatttgggagctccagtgttagatgcatatatatttaagattgtgatattttcctgttggactagtccttttatcattatataatatccctctgtcttttttaatggttgttgctttcaagtctgttttgtctgatataagaacagctattcctgctcgcttttggtgttcatttgcatggaatatctttttccacccctttaccttaaatgtatgtgagtccttatgtgttggtgagtctcttgaagataagagatacttggttggtggattcttatgcattctgccttgctgtatcttttaagtggagcatttatggcatttacattagtattgagaagtgaggtactactattctattcatcttgctagttattgcctgaatacctcattggtttttttcattgtgttattgtttcataggtcctgtgagatttatgttttctggaggttctattttggtgtattttgaggatttgtttcaagatttagagctccttttagcagttcttgtagtgctggcttgatagtggtgaattatgagcatttgtttgtctgaaaaagactatctttttcatttatgaaacttagttttgctgaatacaaaattattggctgataattgttttgtttaaggaggctaacaacaggatccaatcccttctaggttataggtttctgctgagaaatctgctgctactctgataggttttcctttataggttacctgatgcttttgcctcacagctcttaagattctttccttcatcttgtctttagataacctgacgactatgtgcctaggtgatgacctttttgctatgaatttcctggatgttctttgagcttcttttatttggatgtctagctctctagcaagaccagggaagtttacctcaactattcccccaaatatgttttccaaacttttagatttctcttcttccttgggaacatcaattattcttaggtttggcagtttaacataatcccaaacttctcggaggctttgttcattttttttcttttttctttgtctttgtctgactgggttaatttaaaagccttgttttcaagctctgaagttctttcttctacttgttttattctattgctgagactttccagtgtattttgcattcctctaactgtgtccttcatttccagaagctgtgattgtttcctatttaggctatttctctggaaatttttatcctgtatcatttttttatttctttaagttggtattcacctttttctggtgcctccttgagtagctttataattgatcttctgaattctttttctggtaattcagtgatttcttcttggtttgaatccattgctgatcagctaatgtgatcctttaggggtgttaaagaaacttgttttgtcatattaccagaattgtttttctggttccttctcatttgggtagactattatcagagaaaagatctggggctcaagggctgctgttcagattcttttgtcccaccgcgtgctccctggatgtggtgttctcccccttcccctagggatagggcttcctgagagccaaactgcagtgattgttatttctcttctgggtctagccacccagtggacctactaggctatggtctggtactggggagtgtctgcaaagagccctgtgatgtgatccatcttcaggtctctcagctgtggataccagcacctgctccagtggaggtagcaaaggagtgaagtggattctgtgagggtccttgatggtagttttgcttaatgtgctggttttgtgttggttggcctccagctgggaggtgatgctttcaagacagcatcagttgtggtagtatagggaggatacaagcttactctagggtcacctggatatgtattaggatttctcaggtggtgggcagggccatagagctcccaagagattatgtcttttgtcttcagctaccaaggtgggtagaaaaagaccatcaggtggggggcagtgttaggcgtgtctgagctcagactctccttgggcagggcttgctgtggctgctgtggaggatgggggtgtggttcccaggccaacggagttacattcccaggaggattatggctgcttctcctgtgtcatacaggtggccaaggaagtggggaaaagccagcagtgacaggcctcacccagctcccatgcagctcgaaagctagtctcactcctaccgtgggcccccaacagcagcaagtttatttccaggcagccggtgagcaggctgagaacttgcctcaggctacaagcctccctgttgagaaagcaagcagggctgtcaggttccatgcctccccacctggcgcagtttctatgctcatagctacactccctgttcaccccttccccgggattctgtccaggaaacctcacgtttggtcaaaattgttacaaagttcaattggaagtttccttctccctgtggtctttccccaattccactggcagctctctccaaggacccctgtgaaacaaagtcaggaatggcttccctggagaccaagagtgcccacaggactcttcccgctgcttcctctacctctgcatttcacttgactctctcagttcatctcagctctaggtaaggtcaaatccttctcctgtgatctggaccttcaggttccgcagtgaggatgagtgctcgggagcagactttccccctctcacactttgggcactcggagtttctcagctgtctcatggggccggcagcagcaagccgcttccttcaaagggtgtgtggattctctcagctttcctgggatgttcctgcagtagttcttggagcaaaagttcatgatgtgagtctccacatgctgctctgtccattcgagtgggagctgcaagttaatcctgcctcctatctgctatttctttagactctgaacattattattttgccccccaaaaaatgcccgtgttcctgggcaacatagcaagaccccatctctaaaaataaataaatgtttttcaaaatgtccatttctaatctcggaagcctgtgaatatattaccttacgtgacaacaggggcttagcagatgtgaatagattaaggattcagtgagggggagatgagcctggattatccaggtgggcccaatgtaatcacaaggatctccataagtggaagacaggagaggcaagttcagagaaaagttgatgtgataaaagaagggctgttgcagcaatgccagagggaggccaggagccaaggaattcagatgacctttagaagctgaaaaagggaccaaaacgattctctcctagaagctccagaaggaatgactgccagcattttgattttagcccggtaaaactgactttggactcctgccctctaaccactgtatgagaataaatttgggctgctttaggtcaccaagtttcttacagtaagaatatgaaattaatacaaccactaagtcttcgagagtgttcgttgccacatcataattcataagctcgaacccatgagatgggtgtgttcaggggatggccctgccagctgagctgctcctcttctgctgtggcttcaagtactttctctgtgcttcagtttcctcatttgtaaaatggagaggaggaggatgttaattataggacccaaatgagttaatcttcttttagaaaacccttggcacagagcagtgagatgtggatatatatagtcatatagagagatatacattgtgcaagttgtcagaatcaaaatggagtcacttatgttaaaaaaaaaaaaaaaacaaaaaacttggcaaatagaaccaaagaaggtcataaacagaaggctctcgtgtgcgaatgcccgatggcaagaacaaccacgaaagactctgcaaaatccacaaccttgcataaaagccattgcaacctcaaaatacttctgcaaggacatctgtccatcaactgcctgtctgacttccgactgacgtcactcttcttattggtacatgtggccaaggataattatctaaaaacaattatgtgatcatcctcacttttccttttcaaacttttgccttcctttactttcctgaatatgcacttagtttgctatgcacaggtattcccactgagatccctattcctgaataaacatcattttcttttgtcttttctttattttaattagttttttcttttcttttctttttttttttagacagggcctcactctgtcaccaaggttggagtgcagtggtgcgatcttgggttactgcaacctctgcctcccaggctcaagcaatcctcccatcacaagtagctgggactacaggtgagtgccaccacctgtaattttttgtatttgttgtagagatggggtttcactatgttgcccaggctgggcttgaactcctggactcaagcaatctgcctgccttggcctcccaaaatgctgggattacaggcatgagccatcatgcccagcaacatcattttcttttagagaatatccctctctattatttggattgacaacacatattcattaatacctgtgataggatggcatttgatgggttttaatgaacttgtctcatctaatcaaggtaaagttcaatagggatggtgaaaagagatttcctggcccaaaaccacccgctataagtcccatccatccttctctatgtccttcatgcccagggaggctgaaacattgaactggtgcctgcatgacaccctttgctacccaccctcttttcctggctttctatatccaaagtcctaaagagactacaatttccatgagtcggcagccacagcttcacaggcctcaatgagcatctttacccattaaggttccactactaccaccgctactcccccactgcctctgagcccaccttgccaggaggagacacaaggtggctcggaagccatggaaagctggtatcggtggccaggaggctggtaaggccagggcagccctatagcatgatgttccagggcttctcaagagctggggagtattgatgaggcacagactggccctctggagtccacagggtgagggagcaaataccgcggcaggcatccaggaggcagaactgtaggggcgttgatgaacttgggcactgcattagtctgttttcatgctgctgataaagacatacctgagactgggcaatttacaaaagaaagaggtttattggacttacagttccagtggctggggagccctcacaattatggcagaaggagaaaggaatgtctcacatggcggcggcaagaaagagaatgagagccaagcaaaacgggtttttcctaatgtgagatttattcactaccacaagagcagtgtgggggaaaccatccccatgattcaattatctcccactgggtccctcccacaacatgtgggaattatggaagtacaattcaagatgagatttgcttggggacacagagccaaaccatatctggcaccaacaaacaacagatgccagcccatagctctgtgccaggattaatttagtccttacattgctggataattgagaaatttaaaggattccaagtgagaagacagaatggacagggcgaaaatggggcatttaagagttctgaggcagggtttacttaccatatggaatgaaagtattcaactttccaacaattagtatggctgtaccagtacatatctgatgaatttcagccttatataaaattctgttttgcagtcttcagtgtctagtggatactgaagattggctcactcaacatccattctaatacatttctagtatttgtgctcttttgtatcataataacctgtagctaaaaactacatttcccagactcctgtgcagctatcttgcatttagggttccatatataattttgctcctccagtcagctaaacttgcacaagattttgaatcagaactaaattctgccaggcatggtggctcatgcctgtaatcccagcactttgggaggccaaggcgggaagactgcttgagcctaggagttcaagtctgcattaatcatgccactgcactccagcctgagaaataaaacaagactctgcatctaaaaaaatttttttaaaaaagaactaagttctgaggagagagatacagtgtgagacattgaagtccaagtccaagataatcacaagcacactttgtcctagatttagttaaaactaacataagggaatgcattagaattatgaaaataattctttgtgcaagaaattaagggtaagccatatgggctttttattattagatacagtagttcccccttatctacagtttcattttcctcagttgcctgcagccaacagttgtccaaaaatattaaatggaaaattccagaaataaacaatccgtaagttttaaattgtacactatactgagtagtgtgctgaaatctcactcacactcgtgctgtgtcccagccaggaggtgaatcatccctttgtccagagtacccatgctgtatacactacctgcccatctatcactcagtagctttctgggttaacatcttaaaccatctcaggaagggtaagcataacacaataagatgtcttgaaagagggaggccacacttaacttttattacagtatattgttgtaattgttccattttatactaagttattgttaatctcttattgtatctaatctgtaaactgaactttatcataggtatgtatgtatagaaaaaaacaatgtgtgtgtgtgtatatatatatatatatatatacacacacacacatacacacacacacacacacacaggatttggtccaggctgtggtttcaggcatccactgagggtctcagaatacattcccggaggataaggagggattactgtattcatgcaattacaaagacttcataccaactgatgaaagtgacttcatcatctatgaaaaataacatttataagtgtcacataaaatatattggtctggttatataaaacttccaggtattttctggagagtaaaaatattaaaattcaaatttattttgtctcaattccctaaccttgaacggtgtgtcactaaactatttttagacttctccacaaggtggggctactcccaagctattctgttgctaaggagggacgcagaggtgctctggaaatgtttcattacagtgtcacttcttttagcagtcttggtaggaaggcttattaactgcaactctaggaatcactgggagaggagctgtaatcaatatttccagcatccttttaagagctgtaacttctcagcctctgcttgtccatgcaatgatcactcaggtggaggcttgcccaggacatctcccaggttctccgggacctcactggaaaagccactgtgaaggacgtgggacgcacatgtctgtctctcccgtctctgtccccagctcctttctcagcccattcaggccactctaacacattaccatagaccgaaaggcttataaacaacagaaattcatttctcaccgctcaggaggctgggaagtccaagatcctctgctccctcattctcacatcccaagctgctccaagtcttgcacacagaccttcctaactttcctccctcccctcaattttcccctcctcctccctctttcctggctttgactgaatcctccccctttcttgcctcactggttcactgccagactagcaactccaatttctccgtcgaaggcggaggaaattttccaagatctcacacatcagcatcctgggtcccagcccaggatgggatccaatcccaaatgggatccaactgtacctggacacatctggacatgagagatgagcaggggaagtccttggtgggggctgggagggttcataagagttgaattatgggagggttttgagggattttcttccctttatcttattttggccactgggaaagagtctcaaacaggggagaatcatgagagggagagaaagagaggcgactctctcggaaaacattccaggccctaaacctgactcaggcctgactcctgtgggaaaaggctgtgtatataagctccatgggggactctgtgagagctgagtggaagagcaggtgcagctttgaggcccaaggggccaagcatcgtccctatggaggggagaatatggagcactttcatgcacagacacactgtggcttcaagcttgtaacagcacctgcctccggccaagagagagacctcgcaccagagcccagcacccttcaccaccactgcagtggttaatttcatgtgcccactcagccaggcatggtacccagatatttggtgaagcactactctagatgctgctgtgaagacatttttagatgagattaacatttagatcagtagacttccagtacgggagattaccgtccagaatgtggttggacttcttccagtcagttgaaggccttaatagaatgaagacagaggactccatggaagagagaattccacctctagactgtctttggactcaggctgcaacatctgctctccgtagtctccaggctctgtgtgtctatgtgtatatatgtgtgtatatatacagtcacataccacataacgacatttcagtcaacgatggactgcatacatgacagtgtcccatgagattataatgccatatgtttaccatgccttttctatgtttagatacacaaatacttaccatcgtgttacagctgcccacagtactcagtacagtaagctgctgttcaggtttgtagcctaggggcaataggctatgccatatagcctaaggatatgcaggctatagcatccaggtttgtaagtacactctatgatgttcacataatgatgaaattgtgtaatggcacatttatcagaatgtatctccatcattaagtgaatatgactgtgtatgtgaatttagacataaatacacatcctagtgattctgtttctctagagaaccctggctaatacaatgtctgccacctggtctcaccactctactctcacctggccagcctcctctgccctccattggctcccagttctactctgagtaaaagccaacatctccacgaaggcctcgagaaccccaccccatttacacagacaccctagttccttccccctgctggtctcatctcctagtctctcctcgtgactccctcccaccacctacactccaacctagggctttccggctcactgttccctttgcagcaatggcctcccctatatgtacatatacccaaagcctacatgtccagcaagtccctcctcaaacatcaccttcatcatgaggcctactcacccaccttattcaaaatttcaattccccccaccatacacgcttgaggctccttaccttctcctttctttcttcctatagcatgaaccatcttccaacatataaacaaaatgtgttggtttaatgttattgtcatcaccctcaactggaatgtaagcttccccagcacatggattttttagttccattcacaatgtagcccaaactcctaaagccaagcctgaaacacagtaggtgctcaacaactatgtgtgaaatcaatgaacccctccttggtcccacaatactaccaccaccagccccagcagctcccttctcatcaaaatgcctctaaacaatggtttctatgacttccattgcattctccattctctcttgaattcaccccaacctggcttttgtcccctcagctacatggaaacagctcatcaaggcactaagaacttcacgtggctaaagcctattgatcttcatcttactgatcaactgcatttggcaaacttgatcaactgcatttggcaaagtttgtttggttttttgtttagtttgttttactgatcaactgcatttggcaaagttttttggggttttttttttttttttgagatggagtcttgctctgttgcccaggctggagtgcagtggagcaatttggctcactgcaacctccgcctccttggttcaagtgattcttctgcctcagcctcccgagcagctgggactacaggcatccaccaccacacctggctaatttttgtatttaaagtagagatagggtttcaccatgttggccagaatggtcttgatctcttgaccttgtgatctacctgcctcagcctcccaaagtggtaggattacaggcgtgacccaccgtgcccagcccatcccttcttcttgaaatgccttcctcactcgaccaggacattccttctcctgaccctgcactgacctgctggcttctccttctcagtctctcacccctcagacctttaaggttatgttggctcagagcccaggcttcagcccttctccattcattctaaccccccaggtgacaccagtgaacctccaatttcttatctccaaccctgaacgttcctccaactccagacatggatgtccaactccctgttctctgtgtggacatctcagattcgggcatcgaactcagcatctcccacatcatgtgccatttccgtcccaaacccactcctctctcggtcttccccctccttccattgctaaggcaaccagccttgcggtctgctttctctcatcccccttcacttctaacccaccctgaaaccccaccagctctgctgcaaaatatagcccaaatctgaccacctcctagctcatccaccactaccactctgggccacaccaccatcatctctcacccaaactactgcagtagcacccaaatggttctatctttccccttccactttcccacacagagaccagaattgtcctttgagaatggaggtcagttcatgtttttcctgctagcccccacaatcatcccaatacctctcctactccaactcctaccacttttcctctttgctcactcccctccaggcactgggcctccctcagctgttacattaagatgccaagcaagcttaggccacaggacctttgcatgtgatcttcccacatcttggaactccatgtaccagatagccacatgattctctcaagtccttcaggtccctgctcaaatgctcccttaccagtgagccaacttctgatccccactatataaagtagcaagccctgactcccacccactctctgcaaccttctccagctcccttgcttcacttatttttgcccacagcctttgacatagtacatattatccccactagaatggaagctaaggagggaagggtcttggtctgttgtgtctgcggctgtattcccagcacccagaatagcccctggttcatagcaggtgttcaaaacgtgtgttgagtgaaaatccagatgattcagatgtcagtgatctaggaaacacatttctgaagaaaatgtacttgatcatgagctctttaaggtcacatatgtgtcttgttcacacttgtgccccagcacccagcaccgtgcctggcttagagtggaacattattaaagagactaaggagtggatggagctgaatgtcagttattcctcatgcctcatacttccttgtggaggaacttcaggtagactcacactcctggcctctctccccatcccttgcctgtgggaagaagcaaggtaagtggattttttgatgtggcactatgaaagaagtggaatgtgctggctctctcccccatcttccaagcagttgctgtctgtctgctctcatcggtgctaccaggacagcccctaagagggagggtccatccatccagatggtggggatgtctgaatggctgtagacttctaatcagctttatcagtaataacagatcaatatcttgatctccatcagtctgacatcatcttgatctctgaatccttctcggtcaaggaggggaaagaagagttacagaaaagtaaaactggaggtcacagtttagatgtacccaaggccatccacccataaccatgtggccaacactgaagtcatcctgatttccttgagatgctagaagtgctggctctaatcataactgaaacacaaggcgtaagctttacatccttgtcagcacgattcggtgaaattaaaccaataggctatagacaaatcagccctaacagttctacttgccctaaaaagaatgttcatgtataacaaccaatcaagaaaaaggtcaaaatacttccctcgttatgcttcataaacactgtgctgccaaactgcaaggcgagcttcttaccacctggtttgaaatctcccggatgaagatctatactttctcttatcgtatgacaataaactttcaattttttcctaatttcatctgattgtattttggttaaaggaaattatttgttacaccctcatgcccaagttagttgtctttattttctctatttgcctcatcctaccccattgctcagcctttcagtatgtgcatacacacgtagacatacgcattattgcatgagtgagtagacatatgcactattgcatgagtgagtagacatatgcactattgcatgagtgagtagacatatgcactattgcatgagtgagtagacatatgcactattgcatgagtgagtagacatatgcactattgcatgagtgagtagacatatgcattactgcatgagtgagtagacatatgcattattgcatgagtgagtagacatatgcactattgcatgagtagacatatgcactattgcatgagtgagtagacatatgcactattgcatgaatgagtagacatatgcactattgcatgagtgagtagacatatgcactattgcatgagtgagtagacatatgcactattgcatgagtgagtagacatatgcactactgcattgctttcatcatcattttggtttccttctgcctttttgcaagaggcagagagaaatcagcaggtccctcacccttggagcaggaagaccatggcaaggccttgtggtgagctctgccttcacagcctctattgctccccttctgctttctcttccttccatctcttggtgaacttagaatccctccacaaccttggtctcctgatttcccaaaaggggcatatctggtagattaggcagccattcttaaacctggcaggcatttgaactacctgggatgcttgggaaaatactgattgtcaagcctgctgcaaacccactgcatcagaaccaccgcacaaaagccctaggaatctggatttttctgactcctagttgatgctgatgcaatcccaagaccagtcccagcagcagggtggacacaagtgcccagctgcctccatgctggatgaaggtgagggctgagaacaccttccaaatggagttcattcctcttccactgagcttgtgggtgagggtgaccctccagacaacaccccaccctgctggttcccatccaaacctggagcctgaagtcgttaaatggctggggcagtggttcttgaacttttagttctcaggaaccccttacactcttaaaaataatcaaggactccaaagaacctttgtgtggggaggttatagctattgatatttactgtacaaaaattaaaactgagacatgtttaaaacacaagaatacacaaacacattccatcagcatcagtgtgacgatgctgcccacatcacagagcccctgggagacagctgcacaggcaaggtaggataagcacgtgcatagttttgacctctaggaccgtctgaaaggatctggggtcctggaccatgctttaaaaacctctaggctatgggaatgagcagagccccccaggcttcctggaggacactgatggaggcatgaccaaattctggatgacatcatttcctgtttaactggaagaaaagagagtcctcaaaaatggcatctacaaggcaatcagcgaaggttttgtggaagctaaaacgccagaaccactccaagcttgcctcttggctcaatcactcagacaattttcagacgcaagcgctggaaccacagaaaacaactgatacagtcagcagactactggcccccaaagacctccatgacttaatccccagaacctgtggcattttcagttacgttaggtgggaggtggaagtagagttgctaatcagctgatttacaaatggagagattaccctgggttatccaggagagctcgatgtaatcataaggggctcttaaatgtggaagagacaagcaggagaggggggcagagaaagacatgacaggaagcatgacggagacatgcaatgttgccagctttgaaggagcctggagccaaggtatgcagccgcctctaactgctcaaaaaagcaaagatttgtagttctccttgaagaggtccttcacatcccttgtaagttggactcctaggtattttattctctttgaagcaattgtgaatgggagttcactcataatttggctctctgtctgtctgttattggtgtataagaacgcttgtgatttatccacattgattttgaatcctgagactttgctgaagttgcttatcagcttaagcagatttggggctgagacgatggggttttctagatatataatcatgtcatctgcaaacagggacaatttgacttcctcttttcttaattgaataccctttatttctttctcctgcctgattgccctggccagaacttccaacactatgttgtataggagtggtgagagagggcatccctgtcttgtgccagttttcaaagggaatgcttccagtttttgcccattcagtatgatattggctgtgggtttgtcataaatagctcttattatttttagatatgttccatcaatatctaatttattgagagtttttagcatgaatggctgttgaattttgtcgaaggccttttctgcatctattgagataatcatgtggtttttgtctttggttctgtattttacactgttggtgggactgtaaactagttcaaccattgtggaagacagtgtggcaattcctcagggatctagaactagaaataccatttgacccagccatcccattactgggtatatacacaaaggaatataaatcatgctgctataaagacacatgcacatgtatgtttattgcggcactactcacaatagcaaagacttggaaccaacccagatgtccaacaatgatagactggattaagaaaatgtggcacaaatacaccatggaatactatgcagccataaaaaatgatgagttcgtgtcctttgtagggacatggttgaagctgcaaaccatcattctcagcaaactatcgcaaggacaaaaaaccaaacattgcatgttctcactcataggtgggaactgaacaacgagaacacttggacacaggaaggggaacatcacacaccggggcctgttgtagggtggggggaggggggagtgatagcattaggagatatacctaatgtaaatgacgagttaatgggtgcagcacaccaacatggcatgtgtatacatatgtaaaaaacctgcacgttgtgcacatgtaccctagaacttaaagtataataaaatatatatatatatatatatatatatatatatatataaagcaaagatgcagatcctcccaagagcttccagaaagatgcagccatgactgcatctgactgcatttgacttgatttcagcccagagagatccatgcctgaattctaaccagcagaactgttagataacaaatgtgtgttgttttaagccaactaagcttgtgatttgttacaacagccaaaggaagcatatacccctggcaaaactgaccagcacctgaacactgccccaacagagaactcaccagaagacccttgagtcgggaattccttcctgtgggtagaacttggtataaacaagtaagccaagcaaggaacttacaccacagcccagttaacaacaggatgcccatgagaacccctgacccgactcagctccctaaccctgtccacaaatggcccgggctctgtgccaatgactaatctccaaagtattcagtgaagcgtctgctccattcgggattttttcagatgggcattttggtttcatcagccctgctttctcccgctccgtgactttgcatcagttgtcatgaggatgattaaataatttagcacttagccccctgctgtactccttggcctggatcatgaccacaccgaaggagtgcccaccagcaagagacctggagacatccccagtaagtgcaaaagctggacacagtcttagggtctcctgccggaggcggaggggatgaggggaaatgcattgcggctccaagaggaatcgctggggagtgaatattggaaggactgtgtgtgtgcattctgagcttcccagcagcccaggggtggaaaatagtgtgtcaatcactacatcagcctagaatacaacatcctccacttccctggtaacctcccctctactgcctctagaccacttcaagtcattccagaaatggctgagccctttcaccctacagggttgactggatcagaggagaaccccgggccaagctggaccaatcagagtttccatccctgaatttggaattggagctaagctagaacctgtctctttgatggcagtaaatgtgaagctcaaacactagtgattggcttctctctccaaaaagactatggacacaaacaaagccagtcttcagaaagacaggaacaagaatgatgcagacacatcatgtgtgcagagatgagagccctaggttacctgcatctgcttcttgcaccttcctgagacctggcatcatcactacccacgctgtaattccccgagacaaccctggcccaggcccctttcactgctttagtaggtatacattttttgcaagcaaaagaatcctaactcagatatcactattgtaagggtggcaagcatttgttagaaaacaaagtaagatccataatcgatatttacttcgttcctctatagattcctgcaagcagaatctgggatgaacagtctgcatgcctctcgccacctgtcccagggattccctgttccacaagacacttgggatctgcttgtcatgcatcatgcgtaactaatagtgcagaggaattaatacagttaagtgaaacgtccgtcagtgggaagccggagcaagggaaaattctccttcctttcccctcctcgactgccctggtttcatgtggcctcatggcagaagcccgccagactgctacctggatgcaaccagctaaataacctgccctcatattgattctccctcctcccctgcttctccacacttttccctcactcttgccttcctgggattggacccctcataaatttcataacacaaatccttgcctcaggctctgctttttagggaactcaatccaagacattcttggttaaaatgaggtctatggtacactcagacactgaatatagtagagatgaaaaagtcttggctagttttctgataactgaaaatgtaatatatactaaattaactgaagctgtaaaacaaccggtacccctccaagcagattacggtgacagctactttagccacataacactaatcaactgctcacaccagagaatgaaaataagatattagcaaataaaccaagtttaaggcctcaccacctctcaaatacaagagaattgaatcttgtataagaatctaatcttgccaggcacagtggctcacgcctgtaatcccagcactttgggaggctgaggaaggcagatcacctgacgtcaggagttcaagaccagcctggccaacatggtgaaaccccgtctctactaaaaatacaaaaaattagccaggcatggtggcgcacgcctatagtcccagctacttgggaggctgagacaggagagtcacttgaacccaggaggtggagattgcagcaagccaagatggcgccactgcactccagcctgggcaagtctcaaaaaaaaaaaaaacaatttaatcttgtttaatcttaaataagattattcaataggacccttcaaatgtctacttttgcctgtagaaaaaaaatgaacatagagtcaaaaactagacaaacctgtcacatggaaacccaaaccaaaataggatcaaattcaaagaagccatttcatgggaagccgctaggtggtgagctttcaccatctttgcctgtttaaaggttcactcccgggtcgcctccgctcttattttggttgataaggatttgctattttgacaaactgaaatttactatgctatcatctgagaatttaagaaatctgaaaattcaagcagtagaaaatcgtagtatcatagataaaataaaagtggaatgaatgtaaatcgtagagagttgtttaagttgcccatcactatacaaactttgatgccactgtccctttggtctcccattctggagagggaggcatttgtatcacaggatgtttgaggagggctgtggctctgttgtactttaattggaaggaattgtgcttgctgtttacaggaggtgttatgaaaaccaaaacaccaatttttttttttttttctttgagacagagtctggctcgggtacccaggctggagtgcagtggcatgatctcagctcactgcaacctctgcctccagggttcaagtgattctcctgcctcagcctccagagtagctgggattacaggtgtgcaccaccatgcttggttaatttttatatttttagtacagatggggtttcaccatattggccaggctggtctcaaactcctgacctcaagtgatccacctgcctcgctcagcctcccaaagtgctgggattacaggcatgagccactgcacccagcccaaatcttttttttttttgagacagagtcttactctgtcacctgggttggagtgcagtggtgtggtgcgatctcacctcactgcaacctctgcctcccgggttcaagtgattctcctgcctcagcctcccaagtagctgggattacaggtgcctgccactatgcccagctaattttttgtatttttagtagagacggggtttcaccatgttggccaggcctggtctcaaactcctgaccttgtgattcgcccacctcgacctcccaaaatgctgggattacaggtgtaagccaccgcacctggcccaaaaagtcttttagaacagcatttctgaaatgcagcccggggagagatggagggtgtgtggtaagcagggtcactggagatccaagaaaagcagaaagagccgtgtagtggggaatgggttgcttgcagaatggaagtgaagtgtagggatattgtgataacaacagtgggtggaactatttctttctaatgattcatgtgaggaaatattctacaagaaaaagtgcagcttcacaataagaaatccataaaatcatttactggagtgctatacaatgaaattctatgcagccataaaaatggttttgaagaagcattttaattaagtcgaaagacatttatgatatgttgtaaaatgaaaaaaaaaatccggtcccaaaaaagtatgatccaattttgtaaaaaataaatttttgtaataaataaataacgtgtgcatacatgtagagggagactttttttttttttttttttgagacggagtctcactctgtcgcccaggctggagtgcagtggcgcgatctcggctcactgcaagctctgcctcccgggttcacgccgttctcctgcctcagcctccggagtagctgggactacaggcgcccgccatcacacccggctaattttttatatttttagtagagacggggtttcaccgtattagccaggatgatctcgatctcctgacctcgtaatccagccacctcggcctcccaaagtgctcggattacagtcatgagccaccacacccagccgagggagactattaatagtgattaatatttctgagacttagaggtaggtttccagatttttttaatgttctttttccttggtttacttgtcttattttcagtcactagcattactctataccaggccctgttctaagcacttcataaatactgactcacttaatgttcacaacagggctgcgaagtaggtactattaccatccccatttttatagattaaaacattgaagcacagagaggttaagtgacctactcaaggtcacacagctaatgagtggtggagccgattcagacccaggaagtccagctccagcttctgtgcacttaaataataaaacatgagaaaaagtaaattaaaagcataaagaaaaagcaaggaaggaaggatggaaggaaagaagagagggggcagggatggggatagggaagagactcacaagagaacaacacacagttgttctaaaaactttaaaaaattggggcccggcggccaggcacggtggctcatgcctgtaatcccagcactttgggaggccgaggcgggtggttcacgaggtcaggagatagagaccatcctggctaacatggtgaaaccctgtctcttccaaacacacgaaaaaattagctgggcgtggtggcgggcgcctatagtcccagctactcgggaggctgaggcggaagaatggcgtgaacccgggaggcagagcttgcagcaagccgagatcgcaccactgcactccagcctgggcgacagagcgagactccatctcaaaaaacaaaatgaagtaaaataaaaaaattggggccaggcgtggtggctcattcctataatcccaacactttgggaggccaaggcgggcggattgcttgaggtcaagagttcgagaccagcctggccaacatggggaaaccccatctctactaaaaacacaaaattagccaggcatggtggcgcgtggctgtaatcccagctacttgggaggctgaggcaagagaatcacttgaacctgggaggcagagattgcagtgagccaagattgcaccattgcactccagcctgggcaaaaagagtgaaactccatcacaaaaaaagaaggaaaagaaaaagtgtaaccagaaaaaagataacattgaaatatttaaccctaaataaattaactgcacagagccagaaacatgcaaataacaccttttaaataagaggcagtttgagtttttttctaaaatccctcctgcgggctgcttcccctctcagagcacagtaggtgtcgggggctggattgacttcttgccagttgcaagtcttgactttgtctctctagagcatgccccaacctgactggcatgaaagctctaatttttctttttaactaggtaaaagaaaaccacattgtgaaaagagggaaagggaaaatgcctaagctaagagcaaagcaaaccttaaatgttagtctgcactatttaaaaactttgtctccttcaagaccagagagctgaaagggaacaaatgaagtccattgaggtctacggcaaaaaagaaaacagttcaggtggactaagatggctgccctgcttagtactgggttgagaaagaagatatgggctgaatcgttccctttggactaaatgcctgcttgtcagacagacccagacccaaggagccaagggtagggattagggggaagaaaggaaggaaaagtggaaggaggaggaggaacagaaggagaaggaggaagaggaggggaggaggggaggggagggggaggaggaagaggaggaggaggaagaggagaaagaggaggaggagggggaagaggaggaggaaggggagagggagattgtatacaaggatgaggaaggagtcaggaggaaagaggagtcatggagaaacgagggaggcgtgaagacagaacagaggtgtgagggggagcccttcattttcttatgactgaggtttacatgttgagaaaggggatacaaatatatcttgaaaacccatgtagcctaaaaacgggaagagaactatttctttttctctgtccctcagcacagactttaggcaaaaatctccatctgcgaaagagataaatgtgtctaccccttaaaaacagggtcaggattaaattctgtaaagaactttgagtgtcatctctaacaagcatgaagcaaatcctccagtacacgaagcagaatgaacggacttttaaacagtaatcttcagataaataaaactggtactagacaagagatgaagacaaacacccaaagagctgcaaagtagcttcacaaactcacagggaatgaatcaaggttccttttgcccatttggcttacagtttccattgaacaagtatattttaaatagtcaaggattagattgtcttaaaataatattattcatgtcactgcaaatgccaagtcttgttcttcaaaatctcactcttctgcctcaattgactgattcttccatctcctccacaagcatcctaatcccaccaaggcctcaaaccccaacaaaaaaaccaccatcgccccagatcactcacaaaatcccacaaatcacatttaagaaattcagaaacagatagacataagaatgagaaggaaggaaagcccatgagctctcttttcagaatttttgtatcactttcttgtaaaggtcatttgtacctaattttgctttgaccaaaatggatgcaaattttaacctgatttctttgcacttcctaatttactagtgatgtgctaggccctgttttatttcactttggtgccagtggcctaaaaacctgactttaaaagtctagttttcagaaactccactgcaagaatacattttcatatccaggggattcccttgtaatggagttgtacttacataacatatttaatgaacaactatcgagtgatcggtattccactctcctctaatgtcattatttcccaatactaaaaggagatcaaaaaggtaaaaatacattattggccatttttaaatctttataataagatttaagttattagttcactgggtgtatatttccatacagttaccaagacataattaaaagtcccaaggtgaagcttaatcagcctctcccctcttaaaccaatcatcactacagagactgctaggcagtgacccagttacttcttcagatgccttaattagtcccagaaacaccaaagctcttttttgagaagtggaaatctatttctgttattcattaacacccttaaagcatattctgcggctattagacataagccaatgaaagggcaatggaaagtcatagacacagagcatgattaacatcctcaatgaagaggcaatgggtgtccacttttttccttagcgatgcccgtctacgcatgcttagctttccaatggagaatgcagaattctaacatagataaaattaggatccaaagtcattatgaagttaatgaacaaatgtaatcatgatgcagatgctcaacacattcagaaaggagttaaatactctgagtttttatcactgtctctaaattttctctttaagcaggtggaacatattttaaagataaatggagtggctgggagggattctcatttttaaggttctaggtctaagcaagcctgagaaaaggggacccaatacccaaagattctgagattaattttaccagctaacaaaaaaactcatatattctaccccactgtactattacaaatatcacaaaatatagattacatagaatttagtcatgaaaagatcatacggttaatatgtaagtgtaattgccctatatgctcagcattgacttagacataatcgtaagtatttccttaagagcttaagggcataaataacgtgaatcttatatcccgtcttccaaaaaagcttcacatgcatgagcacagctataaaaagagactggcttcgtgggtggttgtggaatcagcttgcctaatgtacagacgtgccccacgcaatgataaagccagaaattggttgtaatgtgctggcttcttgagattaatctgacccaaacacacagtccccaccctccccaagacttcagcagatcccagacggctaagggtgcaagatcacctccagctgtgaccttcctctgagggaaccaggtatataatgcaacccattgctcaaattccacgaagtgataaagtggcttgtgaagacagcagacctcctcagaggtcggaaggaggaaggcaatttccaggtgagcctcaggcatgcctgctgtcaggccgtcctctgctcacctctgacccgggggatcttcccatgactcctgccccgcacgcatcccagcctccgcctacaggcttcccactgcacttcctcccgcacgcctccacctctctgcctctcagccacccaccggctggccctaagatggtggcactgctataaatcattctccatgctcactctgcctttgaccccaggtcttatctcctaactctcctgacctaaccagagttccccgagcccccaacaagcaaagacaacttcctccccaaaaaggaattttgccgctgagatcatgaattatttacactgacctagaagagtacgatcatcattctgtaaaggccaatggtagataaattcaagaaacatagaccttaaaaattactactgtaagcaacttacagtcttaccatgcaaaataacctgaccatgaagaacaaagagtagaatcctgttataaaatgacttattacgcatttctgatatgaaaagatacctaaaccctgacacaactacttacactcaaagcctgacctgacacagaaaataaggttatctcattcttcagtagtattgctagaaaggagtcacaccataggtcaaatagtctcttctgctcataagcttaaacggaaggggaacccacaagctggttggagatgaatgacctcaatttgagagctcttcacccgcctcttccccttggctctgagcacagatgctcagattgctgctcacctaatttgtctactgccattaccgcatttgcctataaaatttcttctgcctgcgtggctagctgttcgcctgcttaggttcactgggaacagctgcttgtgttcattgccacaatccgtctccagcagcattcatccatcacacatgagtttcagcaaacaagaatccacgcaagccagaagacccgttccaggagttcagggtggcaagcttgtcacagacaggacctggggtggctggtagaggccaatttgagactacacaccacattgacccttcccatgcatttcatgccataataatcacatgtgtttttgtgctgagtcagttttcgtttctcatttcatctgtgtaggtttttcagcagtgcttggcaagcttgtctttccaatgaggaggctgagaactaatgccctattttcagtttcttcttaagtctcccacattgccacatacagtgcaccacatatacagtagcgggcaattacagacaatgccctgatgtccaaacccccaaagtcagccctcaggataattgtgacaaaagcaaagttaatctttagctcttttcttccatccttgtatcctctttctccctcctgcttccctccttccattgcacgagcttccatgtcaccagggtagcaactgacttaggcctacatggactgcatctcgatttagtggggcctgaggcttatgcaaactgaagggtccatattaagaaagagaattagaaaattatgaacacaaagccaggtattaaactgaatatttacttagaaacaaaaaataaaatataacaaattacaactttttttaaactgacaacacaaaatccaggttaaaaaaaaagtagcaaaatgttttaattaacttcctgaaagacttccatatcaaatatacagatgatatggacagataatacatatagatgatatagatatataggtgtgtttttggccacaaactttttgaccctctctttattcaacaacttggtaatattttccagagtgaatacaaaaataatttagtccttccttcagcagagttgactggaacttgacttttataatggagagatggaatgcaaaaaacacacagcttcacagagagatgcatggctctttgcagtacagtttacagatttgtaccctacaaacacaggaattctgataaagcctactatacagaattcctaccataaaggaagaaaggtatggtgtgtttacaactgtatcactgcattatcagaaatagccttgacggtagaaaatttccagttttggttgacgagattccaattggccactctgggcacctctgatgattaaaggtgtttcccatacaatggctttctggctttctggctttctggctcatgcagttcaaaactattctctcctccacagggtagtttcgcttccatgccccacctcctaatactattattgcactgggcatcacatttcaacaagaattttggagggacacaacacttaaaccacagcattctcccgccacccccgaccccgaattcatgtctttctcacatacagaatacattcattccatcccaatagtcccaaaaaactcttaactggttccagcttccactttaaagtctaagtcccaagtctcataccaatagcatctaaatcagatgtgggtgatattcaaggtatgattcatgtgaacctatgaaatcaaggaagttatgtgcttccaaaatataattttgggacagacataggatagacatcccccctccaaaaaggagtaataggaaagaagaaagaagtgacaggacctgaccaagtccaaagttcaacagggcaaacaacattaaaccttaaggctgactccatctcccaccttctggtcactctggggcagacgttagacccccaaggttctggacagcctggccccatggctttgctgggcacagcccacggggcagctctcacggttggagtcttgtgcctgcagccctcttaggctggggttgcacactgatggctctataattctgggatctcaggggcagccccaatcccacaacttcactaggcattgccctagtataggctgcctgtggtggtcccaaccccaccgttctgccaggcattacctactggggactctctgtggtggtcctgcccctgcagcagttctctgcccagactccaacactctccagggcatcctttgaaatctaggtggagacagccattcccccacagctcatgcactctgggtgcctgcagagttagcatcatgaggataccaccaagctttaccactttttcttttggaggggtggccctagtagagccacatccatggtgttctctcctgaacatgttttctcattttttacaggctaagaattttccaactttttaggttctgcttcccttttgattataaattccatttttaatttatttctctcttttcatattttattataagagtcaagagaagccacaacacatcctcaacatttggcttagaggtttcttccactaaatattctgccttccacaaaacactatgacacaaaaacaattcagccaaattctttgtcactttataataaggatggcctttcctccagtttccaataacatattcctcatttccatctgagacctcatcaaatgacctttactattcatatgtctaccaacattctgcagtcaaatctctacccctgagctataccccctctaccaacattctgatcacaaccacttaagcaatctctaaaaagatacaggctttctctacagctctcctcttctacaccctcaccagaattatcctttatttccattcatggcaatgcagactttttctagcctgctcctccaaactcttccagcctctgcccatttccctgttctaaagctgcttccacattttcaggtatttgttacagcagcaccccacttctggtaccaatttctgtcttagttcatttgggctgctgtaacaaaataccttagattggataatttataaataataaaaatatatttctcacaattctattttttttttttttgagacagagtctcattctgtcacccaggttggagtgccatggcgtgatctcggctcactgcaacctccacctcccaggttcaagcaattctcctgcctcagcctcccatgtagctgggactacaggcatgtaccaccacgcccagctaatttttgtatctttagtagagatggggtttcatcatgttggccaggctggtcttgaactcctgacctcaggtgatccatctgcctcagcctcccaaagtgctgggattacaggcgtgagccaccatgcctggcctatttctcacaattctagaggctgtaaagtccaagatcaagatgctggcaggttcagtgtctggcgagggctcactctctgttccatccatggcaccttgttgctgcacctcacatagtggaagggctgatgggactaacagacttccttaagccctttataaggacattactcccatttacaagagcagagccttcacgacctaataacttcttaaaggccccacgtcttaatactattgcagtgaggattaagtttcaacatgaatttgggagggacacagacattcaaacaacagaactttacttttgcagattttacaaaaacacatgcgcattgaacacattgcttggcccttcccacgtaagtgaagggctctgaaagccaagcttcaatagctccagtgtaaacccaactctaggctacctattctgagttgggaaagtgaataacttttattaagtactttatctcaccttgtattttacatttactgactcaatttattctaaacattatcttatgaggaaagtaacagttccattttacaaatgaaaatgcctagcatattctttctgagaggatgacaaaaaatagtccaaaaaactcttgaaatgattgtttctagtgagggagctagtgggcagggctgggataaatacatgttttgaattgcacacacattcatattgcttgagaatttcttttcttttttccccatggccattgattacttcttttttcttgaaacggggtctcactctgttacccaggctggagtgcagtggctcaatctcagctcactgcaacctccgcctcccaggttcaagcaattctcctgcctcagcctcccgagtacctgggactacaggcatgcgccaccatgcccagctaatttttgtacttttagtagagacggggtttagtaatgttggccagactggtctcaagctcctgaccttaagtgatctgcccgccttggcctcccaaggtgctgggattacaggcgtgagccacgatgaccggcctgccattaattactttttaaaattttattttactgtagtaagaacatttaacatgagatctaccctttcaacaaattttcaagtatacattattgctaactataggtacaacattgtacaacagatctctagggcttactcatcctgtttaactgaaactgcatgcctcttaattaacaattccccactttctgctcccccagcctcctggccaccaccattccactctttgcatctatgaatttgagtattttagatacctcatctaagtggaatcatgcgttagttgtctgtgactggcttattttacttaacataacctcttcaaggttgttgcatattacagaatttccttcattttaaaactgaatagtattccactgtatgtatacagcacacttcctttatccattcatctgttgatggacatttaggctgtttccacatctcagctattgtaaatactgctgcaataaacacgagaacactgctatctctttgggatcctgatttcagttcttttggataaatatccagaaatgaggggtgcctggatcatctggtagtggtatttgttaattttttaagaacctccatactgtctttggtagcaactgcagcattctgcatttctaccaacagcatgcaagggctccaggatttccccatctttccaacacttgccctttgttgttgctgctgttttatgatagccatcttgacaggtgtgcggtaacacctcattgagggtttgacttttacattaaaaaacaatttatcatgtgttttaaaggaaaaaagaattcacactaacagagaaattactgataataggttcatgcatcataatactgttacgggttgaactgtgtcccatcacaatatatttggaaaccccaaccacccccaaagtacttcaaggtgtagccttctttggaaatagggtctttgcagatttaaccaagttaagatgaggtcactagggtgggctctatccaatctgactggcgtccttctgaaaagagggaagttggacagagacaagcacagaggaaaggcaatgtgaggacacggggaggacacagccgtgtgactggagtgatgcagctaggagcaaaggaacacctggggccgccaggagctgggagcaaggcccggaaaaagccttcggagtgagcacggcccttgccaacacctggatttcagctcccagcctccaaactgtgagagagtaagtttctgttgctctatgccacccagtttgtgataatttagtgctgcggccctagaaaatgaatatgtttctctcatgatagttatatgatgagcatttttttaatgtttgttggctgcttgtatgccttcttttgagaagtgcctgttcatgtcctctgcccacattttaatggagttacttgtgaaataccatctcatacccatcagaatggcttttgttaaaaagccaaaaaaaaaaaatggatgctggcaaggctgcggggaaaagggaatgcttattagaatgggaatgtaaattaggccagccactgtggaaagtagcctcgtgatttctcaaagaactaagaagttaactatcgttcaacccagcaatcccgttactgagtacatacccaaaggaaaatacatcattctaccaaaaagacacatgcactggtatgttcattgcagcacggattcacaatagcaaagacatggaatcaacccaggtgcccatcagtggtgaaatggataaagaaaatatggtgcatacactccatggaatactacatagccattaaaaagaatgaaatccgtcctttgcagcaacatggatacagctggaggccattatcctaagcaaactaacacagaacagaaaaccaaatattgcatgttctcacttataagtaagagttaaacactgggtacacatgaacgtagagatgggaacaacagacatggaggactactcgaggggagagagaaggagaggacaagtgctgaaaaactatttattgggtaatatgctcagtacctgggtgaaggattcattcacactccaagcctcagtatcacacaatatacctctgtgacaaacctgcacctatcccctaattctaaaataaaagttggaaaaaaagaaaagtaatgcaattttcttcccttgagatacttagtgattttttgttttttttgttgttgttgttgagacagagtcagagtctcactctgtcgtccagactggagtgcagtggtgtgatctcggctcactgccaactccgcctcctgggttcatgccattctcctgcctcagcctcctgagtagctgggactacaggcgcccgccaccacacccagctaattttttatatttttagtagagacagggtttcactgtgttagccagaatggtctcaatctcctgacctcatgatctgcccgcctcagcctcccaaagtgctgggattacaggcatgagccactgtgcccagcctagtttttttcttttctttttttttttttaaggatactttataactgaaagggatgactttagtttggtaaaatttgaagcaaaagagaagctgaggcaccaatcataccctatacagacagctaagcacattgtgtaaggcagatgttgcccaccactcagcccattagagagctcatgcaccatcaaacccagaataaagcaataagcccaatggtgatccaaccctttgctggtgttaatttgttttttttttagacagcgtcttgctctgtcgccaggtgggagtgcagtggtacaatctcagctcactgcaacctccacctcccaagttcaagtgattatcctgccgcagcctcctgagtagctgggactacaggcgcgcaccaccatacccagctaatttttgtatttttagtagaggtggggtttcaccatgttagccaggatggtctcaatctcctgacctcgtgatccgcctgcatcggcctcccaaagtgctgggattacaggtttgagccaccatgccaggccatgaattttaatatctttggctattcatataatactgaaaaaaatcagttagaaaaaacaattcagatgcatagttctaatgaagtgcatatgtgtatcttttcatgggtgcacatctgaagagatcattatgtttggggagtttttctggctatctgatgtttttatgtttttttctaaggttaaaaattaaacacataaatgtacttttaaagttgacaatatcaaaaaattggaaaaattttgaggctgagtttacataattctaaaaccggatcaacttgactaaatttagtaacttcaacgagaaaaaaaaatgaagtttatttatttggtttgtctggcaaaacaatatgtgtttaaatagtattctgtaaacaatgtttaatcatcaagatattaccattataaacatagatccatattttcaaaatacacagatacatacacacacagtagcttaaaaaaactacaagtatttttgtttagcagatcaaaagttcccactaatgctagaaatttgcagtgtctaacagaagaatttgagtttacttttttaaaaagattttccttactttaattaattttagggtctacttcttgatataatctttcaaatgtacttactttttattaataaatatatatatttatgtttgttcagaaaagccactttggcagaaatcaaagaacaaccacaagttgtgcttataagaacaaaatcattttaaagaacaaaacacaactacgatagtaattgaaaactgagcaatagatgtcttttttgataaacaaaagaatgtacaacttaaagttccagttgatacagcccctggatgctttgaagcaaaaaggttctgtttttaatgactagcatttttatagcatttctgatagtcacctaataatagaaatacatcattctcattgtcctttttcattttgtcttaatagcagtaaattaatctaactgatctatttctataaattatattcttgctattaactataaatctgaagaagaaaacatcagagttacatataaaattcttaaaaatgtttccacttgataataaatattcccttaccaaaaaagtttgggcctgggagaatttcatttcttgttttttgatagtgaagaaaatggatgtgcatttttcatcctatattgatttgaataatagagattcacttataatgtgagcagtactttgccttctttggtaggtaagatctaatggcaaattaaaagccacttaagagattacctttagccctggtcagaaagaaggcaaattagtccttcctccctctcacctctctgtcatactccattcatgacttctgaggcagacagtggttccaaagatggccacaaaaacatcccatcccacatgctcatccttcagtgtgagcttgacattcttcccattgagaggtggggtctccacttctcaatgcagagtggaggagagactgtcactgctttgacaaatagattacagtggaagtgacgtccaaggctgggtcataaaagtgatgcggccaagccttgctctctggaatactctctctttgaagctttcagccaccatgaaagcagcccactgccctgaggccaccctgctgggagcaggcccaaagtgacccatgtgaagacaccacatggagctgtctgagattacacaaagagagagaggtgctggatcagccccagctattccagcctcccaagccccataggagagacccccatgccagaaccacccaactcatcccttccccagtttcctgacctatggaaatcggaagagaaaatacaatgattgttgctatttcaagtcactaactttgggagtaatctgctgtgcagcaatgacatcaagaacaagctccaactttctggaacttcctctttcacttgaaaagaaatgcttcgaatattgctgcttcgtgtctgtttaagtatcttttattgtgaaacagggccaccaaatctaggtcaagagtccccctggcccagctgttccttatctgaaagagaaaaagagaggagaaccctgtgaaatatcaggccacatggagagcaaagggagagatcagttacagccacctttctctgatgagctgcgggctagctaattaaaggcttttgctgcctataccagagaggggaaagaaggtaaaaggcctgagtaccaaacaacagagttgttttgaaatccaagtaatgtggagtcagaaaggcccaggagttaaagaacaaggagtccttttctattccctttttcctattaataatgcaccttgcattgcaaaagttatcaatacccaatggcagcagcacactgtggtgcaaagatctgggtttcatcactgcacttacaagctgtttgactttgggcaagccacctaacttctttgagcctctgcattttcatcattgaaatgaaaccaccacacttactctgtgaggtgaaaggaaactgcacatgtatgtagcatgcatagcacagagcaggccttcagaaattatgactacttttccatctttcttttctagtattggttatgctgctcattagctgtgtgactttaggcaactgacttaacctctctgagctttggtttaaactgtgaaatgatgggttgatctcaatagcctctcaatctcctttattattttcttccttagatttctgcgatcacctcctaacttgtctctccttctcttggcccatcgtgtcccaaaccatcccacgcatgcttccagagccaccttggtactcagcaaggcagctcatatttcaaggataagtcccaaaactcagcacacgagcctcttcatggtgggacttgaaagtccctctgcagcctcagcctcaacatccttctatcactctcccctgccccagctgcaccaaaccactcagtcccccaccagtggcaagccctctattcctttgccagcctcctcccctttgccacattgttaccttccatttcatcatctaacctcaactcaagcatcgccttccagaaaaccctctttgaccctcccaggcaggagtctgttctccagctttctatgacaaaaacagtccagcgaatgcttccaacctagaacttaacataatcattgaaatggcctctctgtttcttccagctcagttttaacttccctgagggcaggtacttgtccatctttcatctcattatcctcaacatcacaggaacacaaaaataaaggtttgtgggacacagaatgctgagccaacaacacacttaactgctgctgtgcctgtggccaggaattcacaccacttcagctccttgaggggttaacagactctgggcgtcctaacttgcatcagctgatgagaaaaatcttcaaaatgcagcacctgaatgtgttccttttaagtcatcgttgcacaatcgataagttttggtaaaagactttttgaaagaccaaaaatatggtgttttatttttcttccttatattctggagtttgcatttaaaattcacatccagaatcagctttgtttcttaaaggaggaaactccatgaacaaaagcacacagataattttctagcatggaaaaggctgagaatgagtctggaggggaaatgggaaaacagacagggtaggagggagcatcccacacctgagagctggacagggctggcagaatgaaggaggcagccggaaggcaaaaccaccagggacaagggactcagcctcttggggatcactcccaggggagcttattccattcctcaagtcctgattcctgcagccccctgttccaaacccaccccccttgcagacccacaccttttgtcttgcttctttctcccacccaacacctccccacacccaaccctggcgttgtgttcccatcacccattattcaaaaagatgaagtgagcaagagtccagaccttcgctctgaatgacttgagtttcagttcatccctgacatatacttgctgcgtgcccttgaggcaaccttgagctttaacctctttgagcctcaattttcccacctgtaaaatccagttgacataccagcgcgaggctataacagggactaactgagatgaactaggcaaactgcttagcatagcatggcagtcagctcaggatgccgtcaccaaatcccacagacttggtgcttaaataccagaaatttgctttctcacagttctggaagccacaagtccaagattaaggtttggtttcttctgacgcctctctccttggcttgcagatggctgccttctcactggatcttcacatggtcacccctcggtctctgtgtgtcagggttctaatctcttcttacaaggacaccgatcatatcggattggagcccacacatatgacctaatttgaccttaactacctctttaatggccctgtctccaaatacattccaaggtactggggatttaggaattcaatgtacaaacctggagagggcataatttagcccataacacatagtaagcacttatgctgtggtacttatcaaaacctgccttgtcagttacaatgctgatgtccttttactaaattctaagtgctgtgggctgactgacaggagggcttggtcttttttattctttcttattgatgatcacccaggccctatctggtcctcggccctggctgcagcatctcctcctgcctcctgctgctgcctccacaatgagctccactctgagcctccagtggccttgggtcttctcagaggtcacttcttctggctggacagctctgttcctcctctggcctctcctggtctctttctggatgtggaccaggccctccacgccctctccatagccctgcaaggctgtcagctccacccaggcgaggactcttgtctgtttcttccctgacatatcctcagccccaacacagttcctgatacttagttgatcttcctttggggaacattgctagagtcagcaatgacaccgttctctgagctaggccttgcccagttctttgtaatgaacaatcagatggacatctcaggacatcactgcatcacaagctctttcattgtgtagccaacaggctaaacagtgttcagaaacgatccacagagctttcagccttccaagagtatgactttgtttttttttccaatgtccaagcagtccagaaaagtcacacccactccctggggtggatacagagctgaggccacatcctcacagccaagccctggtggcccaatctggaagcggcttcaaaaaagaaagatattctcatattctgactcttcatgttacctcctcagagcagaaatgatgacctatgggagtctgatcataattctattaccccatctgggataggtacaatggcaggctttctctattaaatagacattaaaatagcataagctttggacagattcctcataagaatctgacaactatcacatgtgcactctcctttctcaatacactgactccatctcctggaaggcaggccactgatcttgctgtaagttacccaaaaacagtggacagcggtcacaatttgttcatctcatttggtcctcacaaaaaaagaggggaagcatcattaattgtgtaatgaatgttaggagagctccagcgtcctaaaggggaatttgaaaaaaaggtctgtcagaaagcatgcagtatgtaggccaggtgcaggggctcatgcctgtaatcccagcactttgggaggccgaggtgagcggatcacctgaggtgaggagttcgagaccagcctggccaacagggcaaaaacccgtctctactaaaaatacaaaaattagcaggtgtaatggcacatgcctataatcccaactacttgggaggctgagacaggaaaatcacttgaacccaggaggcagaggttgcagtgagccgagatcgcgccattgcattccagcctgggcgatagagcgagaatccgtcttagaaaaaaaaaaaaagaaagaaagaaagaaaaaagaaaagaaaagaaagcatgcagtatgtattttagaaggaaggaaagaaggaaaaagaggatgagggagagggaaagaggaagaaatgagggagagagggaagaagacaggaatgaagaaagaaagagggagggtggccaggtgcggtggctcatgcctggtaattccagcactttgggaggccgaggcgggtgggttacttgagcccaggagtttgagaccagcctgggcaacatggtgaaaccccatctctactaaaaatacaaaaaagtagcagggcttggtagcaggtgcctgtgatcccagctactcaggaagctgtggtatgagaatcacagaagaatcgagaattgcttgaacccttggagatggaggttgcagattgcactactgcactccagcctgggcaacagagcgagactctgtctcaaaaaaaaaagaaaaacaaaaacaaaagagggagggcaaaggtggagagggaaggaaaaatggaggaagaaaagaagaaaggaaaggtcatattccccagaacctttccacagtactttaaacatagtaggtacttaataagtatttatggaattgaactgaactgcccaggtatctgtaataccattttctcaactccagcctcacttcctaagcattttctctagagagaggtaaacagaaaaagaaagcgttcattccaccagttctatgcccttcaccccatgcatcgggcctggccatgggccgggcctgcccctgcaaggacaggacaaactgatccatgtcctgtctcgaagctggtttcctggcaggactgtaactcaacattctgggaaatacaaatatccctggtaggtaactcactcttgagttgaagccgtcggtttttattcataaacaaagtaatgagtgagcagttgctcaactctttttttgtctgtttgttaaaagaaaggccataagaagcaaagccaaatgcaaacagaacagaggtataaataaacagccgctctggtgagtgccaggaaagagcttagcgtgactaaaggagaaaatgtaacaggtaaacttcctcctagcatttcttatgcagcaggaaccaattcctccaaatagccatgctcactgtatccttttcccaatactgaggcaagccttggtcacaccatcaccaggcacctggggaaaacaaacacaagggaccctgccttcctgcgagaattgaacattctgtgaaagtgacatttcagggatgcaacaatttctacaccttctatttgcttgagtgtctatttgcttctatcttttctaaataatataaccacaaaaatccatatttgcagaatgcataatcaattattagggctaccaaaatcctttccaaatcaatcttggactagtggcactaacctgccaatatgagggttaagaaaatcatgcagtacaggaaacagaggaggactgggccataggtttgtttcacgattgctggtcttcactttgatctgcatatgctcatttaccaccttccaccatacttccagcttaagtaaaatggggattgcttactcagctggggagagcaagagttgtaaaacagtgtttacaaagatgtgcctgagtgaacagaaaaccgaaaatatttaccaaaggatgctcagtgtgtcttaggagaagaatgttgtgcaaacatttttgaggtcactattcttcataattttttctaactataaattatgtatgtataaaatctgtatattcattatagaaatgttaaaaataaagaaaattaaaatcctctttaattccactagccagagataatcagtatcaatattttggtgtatgtccttttattctgctttctatagatatttatataccgtttttattttcataaaattggaacctattgcttcaatgatttacttttttcactcattaattgtaaacattttcccatgttattaaatgttttctagtaacacttggagggaggggagaggtctttgcaaatttcatagatgaaaagaggtatgtcaatgtaatttcctagtttactatggaagttaaataagagatatttgataattttcaaattctttaagttcaactcgaacagaccaagagaaaattagaggcaaagagcatagcgctgaaacctgaaagcaagcataattaataaaatataacaacccagatgaaagctaatagccatgctttatatccttaaaggggaaaacttggtaaatttatgtaagattgtattatatatggatttaaaattaagacatagaaaaaagtcattggtttattggtattagaagtaacaatgtcacctgtcatttcagggtcccattttctttgacagaaaatgagaacagtcacttgaaatactaaaaagagctaacgagtatgtcttcaataaacacaaaatatagtgaaaattccaagtatttatgacataaattatatgaaaatgagaatattaatatgtgtctaccataaaaggatacacacaaaaataaaagccaattttgagcaacgtaaatatctacagagaggaggaaaacgctgaagtattatttgcataatctagatacattgctcttaattcaacaagtataaatttatatctttaaaatcatgacaaagtgcatattttatcgattagcataatagatccctacagttatatgactatagtgtacctgatgaaaatatatatgaatgcaatcgtccttgaaaataaatgcaaaaacaagtactgaacttggattattcttcaatccacaatattcacttaaaaaaaaaaaaagagccagactaatgaaatgaaagttgatgtaaatgtatagcgtgtgtttccagctgcacctgctccgatgcgcaccgaggcaaatgtaagagacagaaagaacccacccagcggggctttctctgcacaccatacccctccctctctccaggggaactaaacattcgcttctgtccaaacccaagggctaatgagagctggtaacagccaacgaacgacagacacaaaagcgaccttcgccacacctggatatctctgatgctcgctatgggacaatgggtggattgggtccacgtcgcagacaaccaatggccttttcagcagcaagaggaagaggaggaagtccctgaacttagtgcgttttgcatttcggggtgccctggtaggcgtgattgacaactaccccctgaggaaaaaaacgtgcgaaattccagaaacagcaatcccagccctaaaaggtcaagaaagtgcttttggcccccaaactctgaaaaccccggaccacaagccgagcccctccctggtctctgccgccaaccccgcgagccagggaaccccgggccgctcggccgcgcatgcgccgcggcggccctggctgggcgtgggagccgcgtggcccgagcgcgcacagtaccagtttgtccatggcgctgtgctgcggcgctccgctgggactcgtagcgctcccccggtgcagggaggaccccgccgcagccgccgcgccctgccctcgtctgctctccggagtccgctcaggccgcccggctagccggctgtttgctgctcctgccgttgccatggcgacgggcaatgctccgcctgggcctggccaccgcccccagcgcggcgcggcgcggctcggctcggcgcttccagggctccggctcccgagctacttgcatgctcggggccggctccggttctggggaagcccagagcttccggcctgccactgggccccagatgccgtttcttgactattttccattaggtttctcttagctctcccctgattgtttagcatttgtttgaatgtggaattttgagtgtttctagctttaggaggaaaaaataattcaaaatgaaatttagaagatttcaacattaattcgcacagtcttgattattagtcttagactgtaagttttagattcttctcatagcttccgtgtctggtaccttcacagctatttctccagctaagacctccatagaaacgtttaactttgagttttaatctataggtaataaagataactttctaaacactgtacacccatcagaataatacctcattggcatgtatgaattccaagtaaatttgccttaaagcactttccaaaaaaatttgaatagaaatatttcgtatctgcaaaatctttctcatctgggccagcactgtccaatagaaatataatgcctgacacatgtgaaagtttatgtttttaggagccacattttaaaaagtaaaagaagcaggtgaaattaattttaatagtatgtttcagtttcttcattcattaatgaagtcattactatgtttcagccaaaatattatttcaatatgctaccaatataaaaattattcatgagacagtttacattcttttatcgtactagtcctcgaaatctgatgtgtattttacacgtacagcacatctcaatttggactagccacatttcaagtgctcaatggccagtgtgactggtggctactatattggtcacagcagatccgctaggccagtgctttccaaactttttggcaccagggattggtttcgtgaaagacagtttttccacaggtggggcagggggtggtttccggatgattcaagcacattacatttattgtgcactttatttctattattattgtattgtaatatataatgaaataattatacaactcaccgtaatgtagaatcagtgggagtcctgatcttgttttcctgcaactagatggtcccatctgggggtgatgggagacagtgaccaatcatcaggcattaagattctcctaggagtgtgcaacctagatctctcccatgggcggttcacaatagcattggtgttcctataagactcttatgccctggctgatctgacaggaggtggagctcaggcagtaatgtgagcgatggggagcacctgtaaatacagatgaagcttcattggcttatctgcctctcacctcctacgatgaggtctggttccttaacagaccacagacctgggttgggagcccctgcactagactatgaactctaggaagaccagccccagatctccatgaggcggggaggatttcgtctccttgtcaggcctgctaaaacctgattaacttttttttttttttagacggagtttagctcttgttgcccgggctggagtgcaatggccaagtcttggctcactgcaacctctgcctccaggttcaagcaattctcctgcctcagcctcccaagtagctgagattacaggcacctgccaccacacccagctaatttttttgtatttttagtagagatgggttttcaccatgttggccaggctggtctcgaactcctgacgtcagttgatccgccctcctccacctcccaaagtgctgggattacaggcgtgagccactgtgcctggccttttatttttttttttaaattgagacagagtcttgctctgtcacccaggctggagtgcagtggcaccctcttggcttactgccaccttcacctcccgtattcaagtgattctcctgcttcagtctccgaagtagctgggattacaggcgcacgccacagcacccggctaatttttgtatttttagtagagacgggtttttgccgtgttggccaggctggtcttgaactcctgacctcaggtgatccctccgcctcccaaagtgctgggattacaggtgtgagcaactgtgctgggccctaattaactcttgaacaagtgttcccattcccaccagagggagaaacatccttaagtggcaaaaacacttttcagaaactgagaaaagtagaaatgacattccagtcgtctgcttttgtagacagtttgtgtaactttgcctgcaaagggtatctttgccccgtggtacctctcttgttagcctgaagaggaagccagcctgggactcaaggtcgctgggctccttgctgctgtcagggaatgcacagtgtcattgtcctgcctccctcactagaatatcatcagaattcagtgtaaccctcataatcgccttagaaggttttagaaccaggccctcaagaaaacagtgtttgttttaacagaggtaaaaactctgcttggtcaaaatatgcagcttcaagggaaaagtctgtccatagagggcaggtctaagaaggggacatgcaagctaatacttgtctaggtaattttatgtattaactcattttatcttaaaacatcctctaaacttggccattatcatcagtgcccctacctattacagatgagacacagagaaagatgaagtggcctccccgaggctacataagtagaagagtagaaggagctgggagccctggttccacctcgtgcctctggactctattgagatgacagacagtatggaaggtgggcggtggggcaggcgtcgagggaggggcatcttcagggaagcttctgtgttgggcacttctgtgctgacacgagtctttctgatttcagaaagagaccgggggtaaagctgggctaatacaatcttatagttccctgatctgtgcctttttaggcaaaatgtgacctacacacttttatctttgatgttcccttcctgctgaaagtcctttgctcccagaaagatgtatgctgtttaggatccccaagctagagtggaattccttgggtctggcctgggtttcagagcttccccagccatcctggtctaccattaatactgaacaactccctcccccgggcactaccccccataggaaccccttgtggctttcctgctaatattatagattaatttctgctgtgagaaattgttggtcagaacaagatagctggctcaggtggctctcacacccttcctacagctatactcgtaaacttgaccttctggagatggaaccagctcagtgatgggaaccttgagtgagatgactggctggtggggaagatgctggaggtgaaggagcttgcaggctcctttgatcttgcctgtccagaccatggccggaaatgatcctaccattgaaggaattagattaaactgcctcaggaaataattccatttatttcttttcctaaaaacaattttttttaaatggaatcttgctgtgtcgcccaggctggagtacagtggtgcaatctcagttcactgcaacctctgcctcctgagttcaaacgattctcctgtctcagcctcccgagtagctgggactacaggcatgtgccaccatacctggctaatttttgtatttttagtggagacagggtttcaccatgttggccaggctggtcttgaactcctcacctcaagtgatctacccaccttggcctcccaaagtgctgggattacaggcctgagccaccatgcccagcctcctgagaaaattttaaagtaagcctcaatctaaaacctccactcaactggtcttttaacatgagatttatccttggtgccttcattgcctagcacacagtaggtgctcagaaacaactcttgaattttagaagactaaataattggacacataatgatttctttcttgtccacccacatagacatgaagactaatcacagagaagtacaaaatttcagatctaagaataaccaattgagattatgttttattttatagaaaagactataactttatgcggccgggtgcagtggctcatgcctgtaatcccagcactttgggaggctgaggcaggtggaccacgaggtcagaagttcgaaaccagcctggccaacatggggaaaccatgtctctactaacacaaaaattagtcaggtgtggtggcgcatgcctgtaatcccagctactcaggagactgaggcaggagaattgcttgaacccaggaggtggaggttgcagtgagctgagatcgtgccattgcactccagcctgagtgatagagcaggactccatctcaaaaaaaaaaaaaaaaaaaaaaaaaagaaaagaaaaagagatgatcattttattaaaaagaaaacaaggactgactcactggaggtcacatagctatttattgactgaaacaggactagaaaccaagttttctttttgtgttgtgttttaatacactttaatgcttaaaaatcatacctttcattctctaggtctgattttcaggattacagagctttacagtgctctctcagctcactagcgctccatgcaagtcatcatttttgcccattattacagtcatataatagtaacctctttctattttgcagaagagagacagagtttactaaataaaattttattgacagctttactttcataattttgggggaaaacttttgttgcctgtcataaactgtgggctagcaagtgtcaacatacaatgaaggaattaatcagttcaaaaatcaatattaattcacgtgataaacttggcagtggcagaagtcactgtttgttggctcatccatccctgtttcaatgtctttgcctgcctctagcagagcaacaggaaactgtcaatatttcccggccaccttcatagctatgggtggtgctatgacatgattctggcttaaatgacagtctactagggcgcctgggaatccttttgctttcctgatgaaagaggcagacccagctgtctctttcacaccttcttccagctggaacttggccctgatgcctggaactgttgcagtcagccgtattataaccatgagggcataaccattcaaattacagaaatgatagccttgacatctctgaatctctgaaccaacaataacaggtgcctctcccaaacccacttgttacatggggaaactgaacccctgtctatttaaagcattgtcaattgtgttttctcttgcccaaaactaaaagcattcctaatcaatacagcaactatcaactattctcagatatttttgtgggtcgattttattttacaaatctaagacttttaagttgtataagcagaggttcatttcaccaccatcccaaccttactggaggaggggtggcatgagttaaacaatcagtgaatgaaatctcaaattggtttggctcaggtccacccaaggacagatgcttggtgagtggcatctgttcccctccatgactgcccccagcaacctgggtgtccagcatcccactctctgctttggaggtaggggataagatggcttacaagtgtccttggatgttgaatcaggaatgtccaccccatgtcaatcagatgagcttccaaagtctccaggcacaggcaggtgtcagtgctgtatgagcagatgcccaggcgttggccccccttgggatgcttttgcctgatggtgatgagtagggctgcaggcaggctcccctcctcattcatagatgctcctttaaggatctgtggctgacgatggacagcactcactccttgcaggcaccgttttcctgctggtcattgtggtccacaagcccatgggtagcatcttcaggtccctttagccacttggcggctcagtctgctcctcccggtctctcccagtcctgctttcatgctgataacagctaagaactccatgatgtgtgccatggcatctaggctgctactgccatgctgccttccacagacgagtggtaccaaaaggcacagtagtggatatttgtcctctttagctgactgccatccaaatcgccttcctgtacttggagaatttcctcccaagcagagccctctatcccccatagaaactaaaagtaccaagtgctttcacaggcacacttacaactagggcatcatcatgtgacccagacgtgactaatcaaatgcacccaccttggacttgaatcaggagctggttaacccaaaacacgcgacagtagagagtatattccaacagaggtggcagtagcaacagcggcattgagtttgcaagggcagcttgggcagcagtagcctctaagtcacgtgtccaggagccagtatggcttgtagcaatgtcctcagcacactggtttcatggcaggatgtttgactgtgctcttgggtgcaaatgacatatccacctggccgttttccaagcctcgccattcaacgttatcaactattctgagctgcctgatatccttttaataaattctttttttttttttttttgcttcaatcagtgatggtcaatctctattgtttgcaattaagaatcctgatgcatttgcttttggcaatttcattgtaaaatctttgtccatgcctatgtactgaatggtattacttagattttcttctagggtttttatggtttggggttttacatttaagtctttactccatcttgagttaatatttgtataaggtgtcaggaagaggtccagtttcagttttctgcatatggctagtcagctttcccagtaccactcattaaataggaaattctttccctattgcttgtttttgtcaggtttgtagaagatcagatggttgtagatatgtggtcttatttctgagatctctattctgttccattggtatatgtgtctattttggtaccagtaccatgctgttttgcttactgtagccttgtagtatagtttgaagtcaggtagtgtgatgcctccagctctgttctttttgcttaggattgtcttggctatacaggctcttttttttggttccatatgaattttaaatttgtttttttctaattctgtaaagaatgtcaatggtagtttgatgggaatagtattgaatccataaattacttcgggcagtatggccattttcattatactgattcttcctatctaaaaggatggaatgtttttccatttatttctgtcctctcttatttccttgagcagtggtttgtagttctccttgaagaggtccttcacatcccttgttagctgtattcctaggtatttttaattttctttgtagcaatcgtgaatgggagttcattcatgatttggctctctgcttgtctattattggtgtgtaggaatgcttctgatttttgcacattgattttgtatcctgagactttgctgaaggaacttcagcttaaggaacttttgagatcatgttctttgcaaggacatggatgaagctggaaaccatcattctcagcaaactaacacaggaacagagaatcaaacactggatgttctctcataactgggagctgaacaatgagaacacatggaaacagggaggggaacaacacacacccgagcctgttagggggcagggagggagagcatcaggataaatggctaacgtatgtggggcttaatgtgctatatgtgatgggttgatgggtgcagcaaaccaccatggcacacgcttacctatgtaacaaacctgcacattctgcacctgtatcccggaactgaaaataaaataaaatttaatttttaaaaaaagaagaatcctgatggatacacccacacatttgatactacaagactgtttggcagtatttgtgtaatgtactttataaaagtttgggaatgctaattaacaaaatgaattatgaaaatagagaaggagagatgtaaggtagcatagtatacataaccttctcacaactggggagcaaattttaaaagttaagctcttcaaagggagtctctttgtaggaaggaggaaggtggtttcctagttcctagccttgtttaccagtcacaaaggtgtattattatttagggttcggccagagaaacagattcagtaagatgtatatgtatgcatacatgtatgtgggcatgcacacacacacacacacacacacatacacacacacacacacacacacacccatatatgcaaactgtatatattttatatgtgaggagatctatttcaaggaattggcttacacaattgtgtgggttggcaagttggaaatctgtagagcaggctggaaacttgtgcaggagctgaagctgcagcccacaggcaatattgctgcttcttcagagagattcagtttttatcttaaagcctttagacaatgactacttgctgacagcattctgctacaaaacaaacagagatatattttaaagtgctgttatttgcaaaatattattaataaaaatgcttctataattaaaacttagaccccagaaaaaaataaaatcttatgacatagaaagctaagcacagaagatgaatcctttttttatccatctgagaaaatataaaactgccacagaaggattaagctaaaaaggaccctaccaaaaagaaaacccaaaggcttttccactggaccttatatttgtagaatcatggcttaacaaaatatttctatctaaaatggagaaaatactaccaacaaaaatagtgtctggacctcaatatctaatagtaaaattcaacaagcagttttgggtttacaattacactaaatgctaaccatgtaatacatataataaaattgcatttacttctgccaaggtgcagtgttctactaaaaataataaagctgggtgggtggggtggctcacacccgtaatcccagcactttttgaaaccaaaatgggaagattgcctgagcccaggagttcaagaccagcctgggcaacatagtaagaccttgtctctacaaaaaaaaaatttcttttattattatactttaagttttagggtacatgtgcacaacatgcaggttagttacatatgtatacatgcgccatgttggtgtgctgcacccattaactcatcatttagcattaggtatatctcctaatgctatccctcccccctccccccaccccacaacagtccccggtgtgtgatgatccccttcctgtgtccatgtgttctcattgttcaattcccacctatgagtgagaacatgcggtgtttggttttttgtccttgcaatagtttgctgagaatgatagtttccagcttcatccatgtgcctacaaaggacatgaactcatcactttttatggctgcatagtattccatggtgtatatgtgccacattttcttaatccagtctatcattgttggacatttgggttggttccaagtctttgctattgtgaatagtgccgcaataaacatatgtgtgcatgtgtctttatagcagcatgatttgtaatcctttgggtatatacccagtaatgggacggctgggtcaaatggtatttctagttctagatcgctgaggaatcgccacactgacttccacaatggttgaactagtttagagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtgttttggctgcataaatgtcttcttttgagaagtgtctgtttttagccaggtgtagtgtttcatgcctgtggtcttagctacctgggagcctgaggtgggaggatcacttgagcccaagaggtcgaggctacagtgagccatgatcacatccttcccctccagcctgggcaacagagcaagaccctgcctaaaaataaatacataaaaacaataataataataaagcttcataaagtggatttgctgttttatcaaaacaatattttccacctatatcggaatgtagccaattcatttttaaatggttggaaacaaataatggtgaaaaataatctgtccaagaaatggctgctttctggcacttggatgaccttactaatactttttaatattgaagtgttaaagcaatttctcagccaattgaaaaaaacgtgtcaaagttttattctgaattctccacagagaagaagcaaccaattcaaagatgtcccttttgttagacgtcttagaaaaaaagaaaagagaaaaaaaaagaaacaactaaagaaacattttccaaacttggaaataagaaaaaggaagcttttgtgacttttgagtcttagagtggagcattattaattatcccatccaaagatgatttaattctttaggggaatgtacctttgaatgagtatttatcactgactaggtcacagactctgtgaagttatagggtaactcatagatttctgttcagtaaacatgaaaatgatgtctgtctgggcgcaaagataatcatggatgtggtactctgtgcctgtattgactcaggaggctgaggtgggaagatcatctgaccccaggagttcaaggcccacctaggcaatatatatggtgagatctcatctcaaaatatatacacgttatatatatatatacacatatacatacatacatatatacacacatacatacatatatacatatatacacatacatatatacatatacatatatgtatatgtatgtatgtatgtgtgcatatatgataatcaaaagagttactattttattgtcatgggggacattaaccagtttgatagctatctttacactcttcactgataataaatacttcagaatgtcctctaattcttaagccagatggatctctcgttaatgagttgaaaaagcattgacatatcctgttgtatatttatatgagaatcatgctttaaaattttttaatgatactttgttatgatacggtatcaactatgcctggtgacatcagacttctcaaaaggcagatggtcagttgggtgggtaggtagataactttccaaatggattatttaaccttcttcaagtgtgtcagactactgctcagaaacgctaatttcttcccaaaaggagttataaattgtggcaaaaaatttctatagcagaccttgtttgggacagttttctttctcagttgccattttgaatttggaaaacattatatatacgatctaccaccaattgacaaaaataaccatagaattacactctatcacaggattacactgggggaggaatatcagaaagaaaatatgccagagaattcctaaaattgggcacttgaaaaatgtttcctgccaatgaagaggaggccttgtcacatgcctctacatgcttcctaatctatagtctcctttctgagaacacaagccagaaagggaaagtgaatttcaaaacgcctcatctttgtcaagctgctttgatgaaaagtaacagaaactcattcaaattgtcggaaggaaagagaatgaggtacagggaagatgtaggaagaatcacaagtaagggtgggaggaatagcatggccagccagaagcatccagccagcagcacctgtcagtggccccagtatgaccccctcctaatctctgcttctctctgcataactctccctgcagaccttggcttcgacatgcacacagcagaagcttgctaccccatgacatccaagttttaaaatccttagttcaaacacccacaagagacagactggcaagtgtgtcttaaccccaattcttggagggaatcttagggctgctgttcaccttggtccaatcagccctgaccagtgaagccagcaggaccaaggaatccatccctgtgagagggaagaagctatcagagaaggaagggcatggaataaggtgctgtcttggtctgctcaagctgctataacaaaataccatagactgggtggcttcaacaacagacatttattttctcatagcttttcaggctggaagtccaagatcaggatgccagcatgaaaactttctgttgagggctcacttcctgccttgcagacggccacctcctcaccgtatcttcacttggcctttcctcagtaaatgtgcatgtagagggatcgatctctctctctgtttcttcctcttcttaaaatgccgccagtcctatcagatgagggccccatgcttatgacctcacttcacctgaattacttcctagaagccctatctttaaacacagtcatgttgggggtatgacttcaacagagaaatttgggggaacctatttcatctcctagcaagtgtcttctacaagctgaaagggacaatttcaagaatgccgaacctttcttcccactctttcagcctccatctcatgccataatttttcattactttctttattcattcattcatcaatcaaacaatgccagacactatattagggaaaaaagatgaatgagacaccctccttgcccttatggatctccctggccaaagggagagtaagatctataaatgccaaagaaagagtacaacactatatgcatttagaggaggtatgtacaaagttttctgggtgcacagaagaagagaatatgacaggaactcaaggaactcctgaccaaggggatctttgagtggccctaacactgaagaagacctacttcccactgtacaattgtttagtctcttcagtacttttttgttatcattagattttttcctgggcaaattgtgaaacctttctccagagttgctataatagggatgctttctctttggaatctatactccttaaagccttttactctcaacaaagaacatttgtagagcccactagattccttaaacaagtaaagaaacttttagttcgataaatatgaccattctctttaatggtcaaacatactagagcttcagatttctctcaaaccagttccttattggatccatcaaacaattaaagtgccatcaccacatatttttatacatactacccttagattaagatcatcaaggtcagtctggatagaaacttttgtttttttgagacagagtctcgctctgttgcccagggtagagtacaatgtaacacgattttggctcactgtaacctctgcctcccaggttcaagtgattctcctgcctcagcctcccaaatagctgagattacaggcatccaccaccaagcccggctaatttttgtggttttagtaaagacggggtttcaccacgttggtcaggctggtctcgaactcctaatctcaggtgatctgccaacctcagcctcccaaagtgctgggattacagggtgagccactgcgcccagccagaaacatttttttaagtaattgaattacaaagttagatgagatttaagatatatgaagacttaaataaaattaatatttatttaatgtgatttttaaaatttaaatgaatctcaacttatatcacttgccattactattagtgcgataatcattgttcattctctcaggtttttctcaccagggcaaaaatggtgtaacaagatctttgggaaaccgtttcctgctggggtgaccctacaaatcccctgtttttaggtaaacttgtgaatagactaccttaagattctagatgcacaaagtctcataatttagactcctcaaaactggatgtttttgataacaaaaataagaattggtctccaatgtgtctttttgctatgtgtaaagaaggagtttgctaagtaaatggatcgtgtattcaaaatttgtttgaaggaaaaaaatttagcctgttgaatcttcctataagtaattacattttttaaatatttgtaggcactccagagaaccatgtattcataaatcattaataagttaattggaaagcattcttacgcagtcatcaaatctgattccctgaggactcctgctggcaatgctttgctatcctaggcctaattgctgcgtatatttaaaagtaataaacactgtacttaaaaaaaaatctgaagttcactcatttgtctgaattagtaagagatgcagatatgtgtgtgtgtgtgcatgcagcatgtgtgtgtgtgtaaatatttgaaaatccctttcagttttccttatctgaattgccctgccctctccctagcagtttgacaggagtgaaagtgggatgcccccccatagttgaccaggccaggtaagccctagcttgcctttaggacagttttgagaaggtgaaattcaagcaggaagaccttatctgttctgccaggaggctgaatcatgcagattgcattttcaggttaagcagctagaaggaggaacgggcctggcaaactcaacataacacattcaactccaccccagtttcaccctaatggcatcttttcttggtagtatttgaaaaagagtgactaaagaaatattttcctttctgttttatttattcttatctatttgatttttattctttgatatcataagatagccccgtctaaattttctccaaactatcatttatcgagtggcaccaatgtttgggaaaattcattgccagcaatcaagcatgatgtgctctttttagaaatgttcattgattttcctctaaatcattgcaagggtggatacgtacattttacaacatgaataaccagaaatgagagtcaaactcctggaaaattcattgacttggttcaggttaaacagtggatcctccacttgaacattcattatgaaaacacagtgatgatattactcttttcaaaactagtcttcattaaatggatttttaaagagtttttggttctaagaaacttgattctgtgtacaccagtaactttttttttttttttttttgagacagaatttcactctgtcgcccaggctagagtggagtggcgtgatcttggctcactgcaacctctgcctctcagtttcaagcaattctcctgcctcagcctcctgagtagctgggattacaggcaccggccaccacgccccactaatttttgtatttttagtagagatggggtttcactacattggccaggctggtctcaaactcctgacctcaagttatctgcccaccttggcctcccaaagtgctgggattacaggcatgagccatcatgcctagccaccaataacaattttattaatatctttgttaatgtcaaatgacacgtgtcccttaatacgtggcaatatctgttttccagactccacgggcagaaggtactaggatgtacgagaaggtactgtgttctcagtgtaatgtagcattatttcagtttgcttagagctgtaccacaataggggatgccgtgaagagggttaatgttcgagctactttgcgtgtgcatattttaacaagatgtgatttaaaactctgggaagcacagatggttgatcaagtgcaagaactgtgatagatggaagatcatatatgaatgctaagcccaattacaaacaacaaatagcacccacaatgttgtcactttggtcattctgcagcaagaagttaatggcagatgacattaccattcaacaatatatcaatcagttttgtgagagactcatcctctccacattctttcctccttttggcagagtttaagagtataaagtgtgggaagttcattagcctctccccactcattctaggggtactttccaagacccttccccattcaagtcaagtattatggtcattagccaactaggaaagccatagccaacccttgctgttgttggattgcccagttaccatctctcctttctggacatctcacctcctttttacatttagcctgctacaccccctgcctgtggagccccgctgcaggacctgtccttttccagaccttgaagtcactagaaggagaatgtattagtctgtttttatgctgccaataatgagacaacattggaaaatcatggaggacatgattttgtccccatgctatgtacattgaagtttctccagaaacctgtataggaggagggaaggtaaagagagaggagaggaggcacgaaaagatgctcaacatcattagtcattagtgaaatgcaaatcagaaccacgaggagacaacactttacacccactaggacggctgaaataaaagacagacaacaagtgtgggtaaggatgtagagaaattagaaccctcattcattgccggtggaaatgtaaaatgtgtacatcaactttggcaagcagtctagtagttccccaaaatgctaaacatagagttatcatgtgacctagctattctactcttttaagtatagacccaagagaaattaaaataatatgttcaaacaaaaacttggatgtagtgtttatagcagcattattcataaggcaaaatgtggaaatataatctaaattgctgaataatattccactgtatggaaataccatgttatcaacccaactgatgaatggagaaacaaaaaatgatttgttcatgcgatggaatattacttggcaacaaaaaggaatgaagtactgatacatactacaacatggatgaactttaaaaatacaatgctgagtgaaagaagccagtcacaaaataccacatattgtatgattcagtttatgtggattctccagggtagacaaatccacagaaacagaaagtacattaatggtttcctagggtaagggagggggcagatagagagtgactgctaatgaaaagaggttcctttctggcgtactaaaaatattgtaatatttggcctggcacggtggctcatgcctataatcccagcactttgggaggctgaggcaggaggatcacttgagcccataagtttgagaccagcctgggcagcatggcaaaaccctgtctctacaaaaaatatgaaaattagccagatgtggtggcgcatctcagctacttgggagtctgaggcaggagaatcacgtgagcccaggaggcagaagttgcagtgagccgaaatcatgccattgcacttccgcctgggcgatgggagtgaaaccctgtctccaaaaaaaaatttttttcgaaaaattagattgtggtgacagctgcacaattgtatgaatatactcaaaaatccttggactgtgcactttacatgggtatattgtatcatatttgaaatataagtatcggtaaagttgtaaaagacagaggaggaaacacattccatgtgacttaaggttaagttaaacacgttcttgaatgtaaactatctgggaaataacatcccccaacagacataaatctaacatgagtagccttttctagcagcaacaggtgacccagtttctcccactgtgggaattaaacctttgaatttgatagataggagggagccaccccattcagaaaattatccttaacaatacttataggtttggtcagaatgactgaattcacaccacaggatgaaaactaaaggtagtttacaatatggttgattaaacataattagacacccgaaacgataatgacacagaggaggaggaagtggacttagagttagtaatttctgccttctccacgaggaaccctgtgggggtaagatcatgtttctgttctggtccagccagatttttccttgccctgattcatcctggttccgcctggtgctgctctgcaccccacagggctctggtctcagtctgatcggtcctcagatgtccctttcttgttgcagagcccctattatttgcagaaatttctcttcctctgcacgaaccttactcatcctctgcgacctgatcagcagcatgcctaaaacaatatggaccccaaaaggatctgacattaatttcttactgcccctaaaatggcttccatttctctgtaggcgctacctcctactctacccttctactggaacctcagctggccacagagggcccttctgtctgttctgtctcccccatgctggagcctgtgatatttctctatttggggcagggagaatgatttagctcaacttgcctccaaatcagtgactgggggctcccttagatgtccctggaaagaacactggcacagcgcttgaccctgaatggtgattgtatggcgtgccctctggtacctggcatagagaggacaattagggtgctgtgtggggctctttgttctcctctgccccatcctctttttctccctgatggcactttggacccctggttcttcagaatcaccaggtttgacctggactctgcagatgaggtcctaagtaggaaattcacatcgtgacagctcagatttctcttttgtctcaagtctttgggatgggagcagagagctgaacacagtcttattagtcagaaggaaggggaaggagtctagtgggcccaaagaactaacggggcaatcatacctatcacccccaaagcatagatagagcaaaaagttggggtcaagacaacatattctgcttcgtaactgcctaaatgctgatggcaagaaattttaactgagctgagtgattccaccacaaattcatgctttccgtctcacagctgggttctgaatgcttcttgacaatcattttcctaatcactccatgatttcctttccattcctctctgcagctgttacaaaccttcccacttgtctcagctccccacctccactcctaccctgctctctcctcaccatggatgtcaccttcagtgagaaggagacactgtgggctgccactccagcagcagcccttccttcagccccaaatcccttccttctgctctgatttgggtcactttctcctctggtctttcttagttaaaggtcctgaacatcaccaagaatcagccctccaccccttatagaataaacaggtttacgcgaaggtggagactcaaatcctggcaccgccaccaccagcttgggagccctaggcaagtgataacctcttagtttcaccatcgataaaatgggagtcataagagtacctacctcattgggtaattgtaaggatttcattaatttttctgggtaaagaatttaagacattgcctggcacaatataagccctatgtaagtgttcacaagtattattatgctgtgtatttgttaatgtgcattacattatgtgtgtgtgtgtgtatatatatatagtttatgtattttttttaatttttgagacagagtgttgctctctctcagcctcccaagtagctgagattacaggtgtccaccaccacgcccagctaatttttgtatttttagtaaagacggggtttcaccacattgatcaggctggtcttgaactacttacctcgtgatccacctaccttggcctcccaaagtgctgggattacaggtgtgagccaccacgcctggccacattatgtatattaattaatgtgcagtcatttctaacatgtgttaatataaataatggttattaggagttgtgaatcttcaaaaggggaatgccatatcactgctgccaaatacctgttacccaggagcacctactgacacttccccagagcagtgttctaccatacacctgcctgaaatcaatgccttcttccttgcctgatcttccaccaaactcctacctagtaggctgtcactgagcctcttgctcctgcccccatgctctctccttacccctgtaatcccagcaccactctcataactctgtgaaggacacattccttatatgactcctaaagaacaaacctatgggacttgtcttgctccttttcctacctgaccaccacagacttggccacattcatgaccacctcctttcaactccttttaaccttgacccccggaacattactctcctctcgttcttcatcaccctacgcatattgtctccttcatcagcctcattatttccctcaaccctagaatgcagcttctgctcagtgcctgctcaccaccccccatccctccaccatcactccttgggtctcgtaaccttacaggccagtgtcctcaggacagtcctagtctacacctgttgtcccgctttctctccccaaagtgtctcatgttgtatgacaaattacagagccactctctctatgagagaggtcctccacctttgcagcttcagcagcacctctagacagcagtgatggtagccaagcagctgggacagcccacttccgtgccccctccattcacagtgcagacaattgacattttcttcatctcatgtaaggagctatgtaaatgcagccccttttccctacttccagccagattgctgccctcaaagccctcctttatagataaactggaactgccactgaatacaaaggactcccaatgcatccgtccattccttacttctaccctaagactcagactagcatattcagcttcctgatggacagtgccaatcaatattccccagacacctaaaatccaacaagtgcaaaagtgaagttcatgtcatccccctccactttccacttgattctcccctacttcctgtgtctgcttacagcttataccagctatattataccctcctcatacccccaccaaagggagacggccacacctgcagcacagggatgatttgtgccatagaagcccatttgtctatttgcactcaactagagcacatcaacacatttttggacccccaagcgagaaacctcccccaaatcttctcaacttttctctcaatgccacatcttgggaccaagccctgcagttggcctgtgtcccttgaatttgtttttatttgcattgccaccactattgtctcttcttccatatcggtcattaattcctaacccaatctgacttctgcccttttactctactgaaaaggtctttgccaacagccttctggctgctaaaccccatgggttcttttccacccttttctactccacctcttgcagttttaattcccttgaccacactcataatcctgaaatagtttcttcaacttccaagcctccatattcctctgagacaggaggaagagccgtgttgagggtaagatattcgttgtgagcacgttgagtgtgagtggtgtatcagacatccaagaggatgcgtcctagatggttggtatatggatcagaatctgtgctgtccaatatagtagctaccagttacatgttgctatttaaatgtaaatcaattaaaatgaaataaaatgtaaaatgcagtcctctctaccaagtttcacaactcgaaagtgtagatggcctccttagctcccctgctcccttaggcccccacacgcagtgagtcaccaagtctggctcccttaaatatctttattattagattcatgccacttaatgtggccagtgacgcccttcctgagctggcctcagctcattcctccctctcctccccagccacaccccacttgatctctatgcccagtgacaagctctcttttgctgttcctcccctcacccaacctcttgtcctggttaaattctagtcatattttaaggctcatcttctcctctagcgagttttcattgtaacctcaaaattagattatgtgcccctttttgtgcccttatagtgcccaaagtgtcctatcacgggagagttcacagtgcactgaaataaactcttttattttctgtctccccaggaccagctgtatctacagtacctagaaccatgcctggcatacagtaggcacccaatacatatttgatggatgaattaaggaatgaatgaatgaatgaatgaatgaaaagtaaattaatgaacgaaaaaactaaacagtaggtgttatcagggaaaactgttaacgtcattactaattatggatcctagaaaaaataacaaaagatagaatgaattacaaatttgctttggtggcacccaagtgatactaattacagttatttacattacattaaatcttactttttatgccaaatgaccatgcagtaaaagtaaggatatcattaaatatgtatatcattaaatgtgtcagatcaacatggttgagttttattttgttataatagtgaagtatgcacatatgcttagactacatcaattattgctgatgtctgttgtctgttctcacccttgaacaagtttattttctctgttcctcattccatagcatctccaacattgagagcattgtgaaaataagcaacaggcagagaaatggatgatcacttctgaccgtgtagaatacaaagcaattatgagccgattgtaattctgatgctgttgatttgttattcatcattataatgcacctgacagcaacataggctttcacaggcgccattttatttagtcatctcttcagctctgaaagtaattatggttctcagagagagttttagcgatttgttctagatttgttctaataaatggcaatggcaggtaaagagcccatattaagacaggttgggcagaaacagtacatgaagtcaattatatttgaaattacacttactaatgcctgtaaaatgtgtttgtcatacatatctcattcaatcaataatgatttgggtattttaacccatttttgcagataaggcaactgtattagcccgttttcacactgccgataaagacatacccgagactgggcgatttacaaaggaagaagtttattggacttacagttccacgtggctggggaggcctcacaatcatggtggaaggtgaaaggtacgtctcacatggcggcagacaagagaagagaactattgcagggaaatttacgtttttaaaaccatcaggtctcgtgagacttattcactatcatgagaacagcacaggagagacctgcccccatgattcaagtacctcccaccgggtccctcccacaacatatgggaattcaagatgagatttgggtggggacacagccagaccatatcagcaactaaggcttagagcggttgggtaatttgctcaaggtctcaaggacgataaatgatgacttttgaacatgggtcctttggctcaagaacccatgtggtttttgttttcttctatttcacttggtttatgcctaatggcccatgttttatcaggaaggtgtgaataaagacatgtcctagccaggaggtgctagggctgaaggtttgagggaaagtagtagaaaaggtttcaaacagctgctttgagtgcctgctaatggcagattatggaagcccaatgttgagggtctagtaagggtaggttatggaagcctgacacgggtgtcttggagctctctccctgggactcctgtgcttgtggtgctgtagaaccaagtgttggcacacagtcagcaatcccagctgagccttgccttgcagccatccccactgaggtgctagacttacaagggaagctgtcctggaccctccagaccagtccatctgccagccgaatacaacaccaccacctcagccagcactacatggaacagaacaatggagcagctgagccctgcccaaactcctcacccacaaaagcacaaagagtaaaaatggctgttgttttaagccggtcagttttggggtaatttgacacatggcaacagataaccagaatataccacaagttcattttgtagcttccttctcttcatggtgccagacaaatcatagccaatggccaggctaacaaccagtcacaagaaaacaaactctcccctcttgcacatggcaattcacacacaaaaacaattacagtgattttgcatttcttacaaatagcctatccatgggccgattcgaaatgttgcccataaaaccatttttcctttgcaggttataaacactgataaaaaggaaacatgtcctctccgtgcagactgagccgacaggacggacattcttttgatcattttaccattttcatgtttgacacacaacagctttttcactgttcaacccaaatttgaagaggaaacaagataacatctgtttccttcaccatccttccatgcatttcatagcacccagatatataggtgctttgctcacagggatcacgctattcaagttcaccttctgatgattctgagatgaaaatggcatttgctatagatccctctcacagggtaggccgggaatgcagactagctaagtagggagtgggaggcaattactctaacctcagtggacaaaacagttccccaaactgcagaattagcagagcacaaacgctgcagctgtttgcaaaggcacccgcggtatttctgacatggcaaatcatgctggtgatgtcagactcttttcttaaacaaaagtgaaatgtgagaaggtgaaaatacgtgactgctggaagatgtttttccttgtttggggactgcattcgcaaatgactcttgtccaggaccctgggttttccccaggtcttttaaaggtctacattcctttagaatccttcactaaacctaccagttggctccctaacttcccggttatctcaccgctctgtcatgcaagtcactgagcagggaaagtgactcataggctctaaagaaaacctaattcattgaattaaacattggaaagaatctaagtgagtcactgtatccttcgcttggtctttaggcagcaccacaccttgatcattccagccagaagggaggtaatcatatttttaaaaagctgcttggagaaggattatttacaacgataataaatcccatttctatatatacctatattccgaaaacaacagcaaaggcactgcaaaattaaaccccaaaatacaaactgaagagcagaaatatgcaaagccttgagcctagctcacaccgcttctgtgcaaattagaaaaaggtggccccccaggttgaaggaattaggaaaaagcacccacttggggcagcagctgctgacagccatgtttgggggcctggtgagtaagcaaatgggctggatctccactcacccccctgccctgccctccagcccttcccctaaccacctccacccctgcttttgtgcagagaacaaattccaggaccttgtgcagtggcgtgagaagaaggacatggaactttttatgactccccctccccattttcctggtaaaatctttttttccctacttttgaccctgttgttccttattgctaacacttggaaacactgattttttttttaatttgtcacgctgtactaacagttgcaggctggcagttcatgtgtttttatccaaccaggtacccagcaggtgctcgagaaccattacaaaaagaacgaataactctctcagagggaatgagcacagcctccagttctaacgtctaatgctgtccttgctttaaactgaaaggaagagtgtgatctcacctctcctggggaaaaacaacagacctgtagacaagttgctctgcagagcaaaattccaggcagaaaaggggcatccttgagcacacgggtttctgcagccatgagatctgggccccgcgctggcgctatcacccttgcacttgcctcttgtttaggtgcctttccagagcgttctccctcacctagtagcacattagagggaccatcaagaaggggagcatcatttcttacccctcagagccctctcacagacaaggaaggggctgcccttccagggctgggggcacagccccatttcctcttagggagaagatcagattcacagcacagccaccaaaaccacttccccagggcagactttcccagcctggccccagcctggccctaacctggcattctcggcatcccaacaagccagagacagctgccctgtgaaccccatcactgataggagaggccaagcaggaggtcagaaacagaaagtccgggggccagttcactcagtccacatggtgtcttttgttgttgttagctgttaatatttaatggcctgatcccatttatatgaaatatccagaacaggtaaatccatagaaacaggcaaattggcagctaccatgcctggggtttagagagaataggaagtggccgatgtaatgggaatggggcttccttttgcagtgaagaaaatgtttggaactagatagtggtggcagttgtacaaacttgttggtgtaccagatgccagtgaatcattcactttaaaacgattacttttaggctgggctcggtggctcatgcctgtaatcccagcactttgggaggccgaggcaggcagatcacttgaggtcaggagttcgagaccagcctggccaacatagtgaagccccatctctactaaatatacaaaaattagccgagcgtggtggcagacacctgtaatcccagatactcaggaggccgaggcaggagaattccttgaacccaggaggcggaggttgcagtgagctgagaccagccagtgcattccagcctgggcaacagagtgagactccatctcaaaaaaaaaaaaagttaactaatttcatcctatgttaatttcagctcaatttttttaagtaaatgaaaaacaacaaaaaaagagtcagacatttttcctattagatttctagcttctcttgagaaagtagaagatctggccatgtccacctaatccccgcgatgcagcagctgcctgtgaggaagggacatttgctgtctgggttgcccctcacccacgtcctcatctcagcttgtgacccctgctcctacccacaaggaagctgcttactttccccagagagtaaacagagtccccactgagctaccatcttcagatgagtgggaggcgagagcatgactcagggtctaagcacacagccggggtggaacaaatatgaagaggccatgaggcaggggtcaggggagtcagaggcaggatgaggacccaggtgttcctaattacgctgcatctccttccccgccagcccgctccgacctctaacctacctcgttttccttcccagcttttactgctgacttactgtgtgtgtaagtttcctggggcttttatcacaaattctgacaaactgggcagcagagacaacagaactgtattgtctcacagctctgcagactggaaatccaagatcaaggtgtcagcagggctgtgatccctccaagggccccaggggagaaaccttcctggcccctccaggcttttggtgatccaagtgttcctagacttgaggcagtatcaccccaatctctgcctcccccttctcccatctgtctctgtctcaaacctccctctctattctcttttaaggacatcagtcattggatatagggcccaccctaaaaccaggatgttcttatcttgagatctttaacttaatacatctgcaaagaccctatctccaaataagatatactcacggttatctaaccaggggttagaacttggacatattttggggagacaccattcaacctattacactctgtatcgatttgcttactgtgtgactcatgtcatgtgtcatgagagtagagactttgcccgtttttttccatgtcggaaacccatagcctagaacaatgcctggcacgtaggctcgcagtaaatgaaaagaagaaatgaggaagcatgtgtgtgggatgatgtttggctcaagccaagtcagcaatcacaggaaggtacaacaaaaccaatccagcacatgaaaggcagggacagctatccgatgaacccaaggatgagggtcaccagatacacaaggaggcaccaggttaagaggagaagtggtcccacttgagtaagaagtttgacattgaaaccgcagcacctgagctgttggaggttcttggcatgactgctcaagacggtggaactggtctgcagtggtgttggactctgcaccaagtaggggctggacaagtaaacttcaggaagggttaagcctaccttctactcctgctggggctgccgctgtgtttgtcacagtcccagcctgggtttttaactcactggaggagtgatatccaaggtatgggccaagtgactgcttcagagtcacctgggggatgtgagttaaaaatacatcctcttgggcctcagcccagaccttctgaatcagaatcccagggattctgagaacactgaagtttgagaaccaataaaatgcagtatttaaatgatgaccacaattgcagggaacatcccacattctttgctacttgctctggtcactgtcttcagctcaggtagctaattggtgagcctgcccagtttcttgcctctctatttttcctactgtcaccagagttcgaacacatcagggatggcactatttctgtcctctaaagccttgaggggtttctccattgtctggagaatagacactgttggttgtgcacacaacagctgttcctcctttatttggtactaacagaaccccagtttcattcaggcctcgaggagaaatatgatcacggaaaggggctctacccctacacggggaactgtgatgagttccattcagtcacgctaatgcccttgtcatttgccagcgatgggttccgaggtaggcaggtgacccagatctgtccaatgggacatgagaggcacctgctgggggcttctgggaaagattctccaaccctgataaaaagagacacaagaacagaaaaaatcccccaacatccccccttgcaggagatgcctgtagttcccggcatcaaatcccttagcccaccttaatttcagctgcagtggtgatggacattctgagtcacagtgatttttattccttccgtgacaccccactggtgagggagagagtcccaccacagggtaatggggatagctaagcactcaactcccaacacccaacactggacagatgcgctgccagcagtttatcaatcacacatactcacagcctgtggaagagaacacagcacactccacactaagcggggcccagggaacagagggcacttgggaacagagtgaataagcaggggctgtgggaagccgtttttgtagcatcaagaggatgaggcgccccctgagtcccatgggaggatgcgcttggcttatttgaataattccctggtctggcagggaactgaatcctatactcaggataagaataaggaggaactgtggctggtcacagtgataaggaggattgtttggctagggaaccttatctgtaggagcagagtggaggggagcttaccctcctactgtcaggtattgaggcagcacgtagtactgaaccttcacttcagaccaccataatggagagcatcttcacgagctccgactcaccttgagccagcagtgcaccaccccaagcccacattgagcaccttgactttttgcctttgagttttctcctgcactgccccactgccatgccaaacacctgcattcaaaaccctccaagccgctggggaacaggggcactggaagaagtctccaggagcatcatcttcaggtgaacaaattctgaccatgttctgcgtgattcccagagaccacggcacctgcctccacagtgagcccttacgctgccttttcctcccttcctgcctcatggtccccagttgctcactcccacttctggaccagttgccaaattatatatcaggctctgcttttaggggaacccaaaataagacactcttcctgtatttgggcacaattttatgagaaaacgacgtcttgtggatttgagaggctgaagctgaggatgaaagtcaatgtgctggggatggtggaatggaagcatgggaagagctaggaggccttggtgacatccctaagaggctggattcccctcacctgctggttccttcctctgtgcttgttgggacagcagggagagagatgacagaccccatgccatcatctagggcaccttccctggagcaccctaagtgatcacagtggtgtttgttccacagcctccatgccagtaggaggcaaaagaaacgttttcatgttaggccagtgagcaatgccaggagtctcagctggatgtgtcagctgtcatgatcattccaatctcgctggaatcctgcaggaggaggggagaacaccgaagtcctcatgtgccatcctatgccaagaccgatcccaaatttcatatgtggtgaatgcaagtatttgtcacatctcaggccgttctccttccatcttcttgtcttcaactgccacctgaatttcactagcatcattccagccacagcattgtgggggaagttctttgtcatagttgcacaagcacagttatagtcattagcgatggagtttctcatgacaacagcctctaaaaataagccacgtccaagcatgtcagcagcgtgtcagcaactgccatgcaactgacctgagatttcgcatgaaatatgtaaaatgtggagtaagacatgggttctgaaagcccagctccccggtcctctctgtgctcagcaagaatgtgagcgattaaagatctatttttactctttggaagacactaattagcattaagtttgatttaccacagttaggcaaaatcattgtttaatgagccaccttcacaagttagacggctcatgttaccctctgatacggtttgtctctgtgtccccacccaaatctcactttgaattgtaatccccatagtccccatgtatcaagggcagaaccccagtggaggtaattggatcatgaaggtggtttcctccgtgctgttctcatgataatgagtctcatgccatctgatggttttataagcatctggcatttcccctgcttgcatttctttctgccaccctgtgaagaaagtgcctgcttcctcttcatcttccaccacgattgtaagtttcctgaagcctccccagccatgctgaactatgagtcaattaaacctctttatttacaaattacccagtcttgggtatgtctttattagcagcgtgagaacggactaatacacccacccagaggaatgaacaaacatgccccacaaagcctggcgggggagtcgggagaaggatctcctgcatgtttgcagtgatttactcgcatgaactatttgtgcatgttgtcgggttttaccttgctctctcttgtgctgcaacaacagctacaaaagttctagacacttcttgacacgtgctggattgtcccgatttgctgtcctatagaattcactgagcatctaccctgagctgaactcagggtacaacgaccaataaggctcaccttcagcatccaagctgtctggccttgagtaagacatagctcctctgtgtctcagtctcctcctgtgataaaagaggacataacacccagcttcacggcatctgactcgtgccatcttgcagggcccacactgcaaagctgcaaagtgccatgtgcttggttcaatgctcttctgttgccatcttgaaattcttaataatttgaacaaggggtccaacattttccttttttcactgggccccacaaattgcataacctagacagagttttataaggattaggtaggggaacgtacttaaacacaaaagtaacgcaaagcttcacacagaataaggactttaaactggcataaccggctgggtgcagtggctcatgcctataatcccagcactttgggaggccaaggcaagcagatctcttgagcccaggagtttgagacaagcctgggcaacatggcgaaaccccatctctacaaaaaatttaaaaattagccggatgtggtggcacatgtctgtagtcccagctacttgggaggctgaggtgggaggattgcttgagcctgggaggttggggctacaatgagccttgattacaccactgcactccagccttggtgacagagcaagaccctgtttcaaaaattaaataaataaaatataaataaataaatacaatggtataatcaccctgattaggtagttaaatctaaacaaatgtattttcttacccatctaatctaaataccataacttaaattctgcctcttgcccacctaatctaaataccataacttaaattctgcttaactttctttaatgaatgttatgcatccatctcggacctcaactttgaatcttaatttccaaatagttgacatgatttgctttattttctccctatcacttttgtcaaaagttgatcctttccacaacagctcctgttgacttgagaactgtatgcataaagtcctttggtcatactaataaatattcaatctgttgttccaatttacctttcttccaagaattgaccaatttttatcaaaaggctgatagaaataaaccatacacaaggggaaaatattgggttacaaatataaatttttttcttatctccccaaactgataacctttggtatatgtccacaatcccttatccacaattctgtcacttataaagccctaaaaatttggaaataaacttgcagcaaatatatttagtgacaaaaccaaacctaaaattgatatggggagatttgtagtcgtttataatcatgctgtgcatattacatcacatccctcgtatatactgagttatctttctaaaattaaaaacaattctgggctgggcatgttagcttacacctgtaatcccagcacattgggaggccaaggcaggaggatcacttgaggccagaagttcaataccagcctgagcaacatagtgagactccatctccacaaaaaaatgtaaaaattagccaagcatggtggcacgtgtctgttgtcccagccattccaggggttgaggcaggaggatgacttaagcccaggatgtgcaggctgcagtgagccatcgtcatgccactgcactccagcccgggcaacaaagtgaaaccctgttgaaagaatgaaagaaagaaagaaagaaagaaagaaagaaagaaagaaagaaagaaagaaagaaagaaagaaagaaggaaggaaggaaggaaggaaggaaggaaggaaggaaggaaggaaagaaagaaagaaagaaagaaagaaagaaggaaggaaggaaggaaggaaggaaggaaggaaaaggaaggaaggaaggaaggaagaaagaaagaaagaaagaaagaaagaaagaaagaaagaaagaaagaaagaaagaaagaaagaaagaaagattctgaattttggaacacttccaatggcaagttttggataagggactgtggtcctatgtcaggcccacactacccctttcagagctcactccccaactagtgaagcaaagcattaaagacacgccctgggccaggcacagtgtctcacacccataatcccagcactttgggaggccgaggctggcggatcacctgaagtcaggagttcgagaccatactggccaacatggtaaaacccccgtctctactaaaaatacaaaaaaaaattagccgggcatggtgacaggcacctgtaattccagcttcttaggaggctgtggtaggaaaatagcttgaacctgggaggcagaggttgcagtgagccaagaccgggccattgcactccagcttgggcaacaagaacaaactccaactcaaaaaaagaaaaaaggaaagaaaaaggccctggaactcaaacagatatgtgtgcaccatgttcacagcagcattattcacaacagccaaaaggtggaaacaatccacgtcatcaacacatgaatgtatgtatatacacaaaatgttgtatacacatgtacaattgaatattattcagccttaaaaagtaatgaaattctgacacatgctacccgtggataaccttgaagacattgtgcttagtgaaataagccattcacaaaatacaaatactgtatgaatcactctatgaggtccctagagaggtcaaattcatagagataaaaagtagcatgggggtttctagggaaagtggggaaatggggaattcgtgctcaatgggcacagagtttcagtttgaaaagaggaaaatgttctggagataaatggaggtgaaggttacacagcaatgtgaatacacttcatgccactgaactgttcactttacagcacctaaaatgatcaattttatgttatgtgtaacttaccatatttttctttttcttttttttttttgaggcagaatctctctctgttgcctcgcttggagtgcaggggcacaatctaggctcactgccacctctgcctcccgggttcaagcgattctcctgcctcagcctcctgagtagctgggattacaagcgcatgctaccacacctggctaatttttttgtatttttaggagagacagggtttcaccatgttggccacaatggtctccatcttctgacctcgtgatctgcccacctcggcctcccaaagtgctaggattacaggcatgagccactgcgcccggccccacatttttcctaatggcaggccctagaatatctgtcctcggagtactgaattcccctctccacctgccctacttctctgtccctggccaccctgaactgatcatcactctccatcaccaccagcaactgcccccactgacgccctccagacagagacatcagttcacccctctcctggcttagtattcacctggcttcacttcctagagtctcagattgataaactggcaacaaacccatttctagcaaggcactaaagcacacccaggtgtcctatccctgcaggcgtcccaaacccagggccacctgcaccacaggctggtctccagcttccagtcacctcccttacaccagtgggaggtgttaacatgaaggaacaaggagctagatcctcatctagttgatctgcgtcccctgtgcattagcttcttatggctgctgtatccagttaccacagatttcatggcttagcacaacataaatatattctcctacagtccaaaatcaatttcactggagtaaaattaaggtgttggcagttctgtgttctttctggaggctctagacaagaatctctttccttttccttctggctcctataggacacttgtattccttgacttgtggccctgtcctccgtcttcaaagcacctcacttccacctctgtttccatcatcgcacggccttctgtctcccactctgactcctcctgcatccatctgtcttgcaaagacccttgtgatgacatcaatctcaccaaataatccaggataatctccccatatcaagactcttagcttaatcacatccgcaaagtccctttgccatgaaaaggaacacagtgacaggttccagggatttcacaggttccagggacgtcttgggggaggaggggatttattcagcctgctacaccgtaattggcaggctagagcctcacatgcaaaatatgagttcttttttttttttttttgagatggagtcttgctctgtcacccaggctggagtgcagtggtgtgatctcagctcactgtaagctctacctcccagattcacaccattctcctgcctcagcctcccgagtagctggactacaggctcccgccaccatgcccggctaattttttgttttgttttgttttgttttgtttgtatttttagtagagacgaagtttcaccgtgttagccaggatggtctcgatctcctgacctcgtgatccaccccactcggcctctcaaagtgctgggattacaggcgtgagccatcgcacccggccaaggtgacaaaatatttcttgctgttagttgcaggagagagaaaagatgaatactgatccacgtctgagagagagacaaaaattcaagttggagaatggtccagatacatcaccaaagcaaggaggactgtaagtggatatcagaacctgagtgcagagacaagagacagatctctgtttctgaaaacatggcaaggaaaataacctaaatatcctctcactatcaagcattagaaatgttgaataaaatatgacaaatatctttttaattcatagccaacctcctaagcaaggaagggatagccccagggccaaaaccaataagggaacagaaagccaacatggtaaatatgacctgatgctggggttggtctgtgggaattggagaggtggcaagtttttgtaaccagggaatttatgttttcattgccacacatgaacagtagagaaggttttgggtgtgtcccaggtgaggaattggaactgaggtccctagggtagtacaggaaaaagaaatacccattagcctgtggagatgataaggaaatgtcttgtttttgcctgaacttgaaaaagagtattaataatttccctaaaatttttaaattacggtctcatcctcatgacttgaggttctaattttgcactatttgtgtggccccagaaactcaaaacccaagaaatcaattaatgttaaaagtggtattttctttctctaaaagtattcttgttgctctaccattcttcctcctcagatcagtatcatcttttgctttggggagaaaaagtggatgtcgcataaaataataaaatgtaaaagtgttacaatatgtaaatgtcccaagacacagtagacacaattttctgtgaataaaacacttttaattggaaagaaacagatttcttatagaaaagtaattttgctctgaattccaaaagaactttccttggaaacatgtttacaaacattagccacagagcttaaggaagacattaaaaaccctactggctgggaggaaggcacttggacagagagaggaagcagacaataagggaactataaccaaaggcccacaaagggaattaaaaccttgggagataagaggcatgggtggtagacacattcaccatgaccaccattccacagatagatctgaggcagtgtttgcaataagaactgttggtatttaagtcttctagcatatcattctttgtgtaaaggacaaaatacccaggaatagttttgttttgaggtataattatgctatttcagatgactcagctggaatcaccagctttattccaatttcttagttctctcttatgtctgccctttatttaccttcctacctcaacccaggcaccctacatacaagaaccccaccactcttcttcaccactaagctcaggcaaactgctatcacttcccattttcattggctactccttaaaaaaggttgtagtctactaaaacataaagtaattacaaaaatttaacagatattaattccatgacaaaaactacagaatatggctaagatacattaaagaatatctaaatagattaagaggtataccatgttcatgaattgaaagattcaatattgttaagatgttcattcacctcaaattgatttacagattcaacacaatcccagtgaaaatctaaaaagcctttttttgaaattagagattgatgtaaaacttattataagttttacatggaaatccaaatgacttagaacaggtaagaaactgtattagtgcgagaccctccaaaaacagatgtcaacagattgatgcacaagagatgtattgaaagaactgcctgtgaaagataaaaggaggccaggcacagtgactcatgcctgtaatcccaacactttggttggccaaggcgggtggatcacctgaagtcaggagttcaagaccagcctggccaacatggtgaaaccccgtctctactaaaaatacaaacattagccaggcatggtggtacacacctgtaatcccagctacttgggaggttgaggcaggagaattgcttgaacctgggaggcagagggtgcagtaagccaagatcacaccattgcactccagactgggcaacaagagtgaaactccatctcaaaaaaaaaaaattttttttaataaattaattaattaaaggagaggcagcaggagcagccagggagagaatttagaccgtgatacaggtctgacacctgtgaaaggagaaagtgaaggaaggactgactagaaagagcctgatacaaaagtatcctgccttgggcaagatggcccgtttaaaataaccccaccataatcagccattggctgggagcagactggagaagagtggcctggtatgaatgccctggtggatgtacagttagcttctggaggctgtcaatcagccatgctctccatggcagattcccttgaaggagagagtctgagtagggtatctccatggctgccaaaacaatttttataaagaagaacaaagttgaaggacttaggctacctagttcatgacttactataaagccacactaatcaaagagagtgtggtattcacataaaagcagaaaaataaatgaaataggagagagaccacttatagggtcaaatggtttttgacaagggttccaaggtaattcaatgaagaaaggacagtcttttcaacaaacaccacaggaacaactaaacacagtatccaagtgagaaaaaaatgtacactctccatcttgtaccacatctaaagtgggggtacacctggaaagttacaaaaattgattcatacatctaaaactaaaagctaaggcttttagttttccataatatttggagaaaatattatgacttttgtgcaggcaaggattcgttaggcaagtaatagaaagcactaactatggtgaaaccccgtctctactaaaaatacaaaaagttagccaggcgtggtggcgggcacctatagtcccagctactcgggaggctgaggcaggagaatggcatgaacccgggaggcagagcttgcagtgagccgagattgcaccaccgcactccagcctgggcaacgagtgagactccaactcaaaaaaaaaaaaaaaaaaaaagataactgtgctttattaaaatttaaaacttccactttttgaaaaatgccactacaaaaatgaaaagtcaaaccactgggtgaaaatattcataacatatacagctgacaaatattttgcattgaaaaaatgcaaacaactcttacaactattaaaaaatattaagaaaacaaggcaactagaaaataggcaaaagatttaaacagacacatcaccaatgaatatatacaaattgtcaataagcacatgaaaatatgttcaatatcactagtcaccagaaaaatgtaaattaaatccacagtgaagtgctactacacacgagaatgactaaaattaaaagactggttgataataccaagtgctagcatgggtgcagagcagctgaaactcttgtacattgctggtggaagtgtaaaacgtcacggtcactttgaaaagcagtttattatgaagttaaacatattatacttatgtacgatcaaactcctaggtatttacttaagaaaaaggaaaacatatgtccacaaaatgacttatacataaacattcatagcaactttactcataataaccaaaaactggaaacaactgtccctcaaaagatgaatggataaacaaatagtggtatatttgtgcaatagaatacaataaaaataagcaaatatgcccaaccacatgtacagatctcagaaacgttatattaaacaaaatgatccagactccaaggaatatatactgtatggtttcgtttatgaatttccacaacaggaaaaactaacatagagatcagtggtttagttgggtgagagggaggaatgattagctgcatagacaaaaagggacagttctgggttatgaaattgattgattatctgattaaaatggtgattactagagtggatacatttgttaaaattcatcaaactagatacttcttgtgcatttttattatatataaattacttctcaataaagttgattatatttttatttttaacaaaagagtgaaggccaggcatggtgtctcatgcctgtagtcccagctgcttggaaggctgaggtgggaagatcacttgagctcgggaggttgaggctgcagtgagccatgatcactccactgctttcagcctgggtgacacagtgagactgtgtctcaaaaaaagggtggagctctccatccaaagtgcacagttctaagtgctggaatctgagtctgcagcagagggaaggagctgcccaagagtgtccttcccagagttccacttggaagagggagcagctgtctactggctgatgtggaagaagccacagagcttgtagcttctcgtttgtattacagtagcatccgtgtttaacccttgtattttcccttttttttttttttttttgagacggagtttcgctcttgttgctgaggctggagtgctgtggcatgatcacggctcactacaacctccgccttctggtttcaagtgattctcctgcctcagcctcctgagtaactgggattacaggcacccaccaccatgcccggctaatttttttgtatttttagtagagacgaggtttcaccatgttggccaggctggtctcaaactcctgacctcgtgatctgcccacctcagcctcccaaagtgctgggattacaggcataagccacacctggccaaccactgtattttctaatattacatctttatttgatattttgtactctgattgtaatttttttttttgaaatttactaaatattagttttaccaactttctaaaaatgaacacgttcattcaacaaatattagttgagtatctattatatgccagtctccattgtaagcgctaggaatacagcaatggggaaagaaggaaagtaataattattaaaatgctctccataatgcattagatgatattaaatactaaggagaaaaacaaatcagggaagaataacaaggaagtagggaggaggaggcaggggaggagtctcaaattcatacagggtgctgagaagtgacgcctgacgaaagacctgcaggagatgagaagttgatccaagcagataacagagggaagagcattcaaggccaagggaacagcaagggcaaaggccctgaggcgggggtacacctggagagttcaaggacagcaaaggggtctgtgtaactataggccagtgaacaaggcagagttgtggaagacgaggtcagatatgaagaggagggctagagggtcatgacagagatttgacatttactctgaggtgagctagagagctgttaaagggtttggagcagaggagggacatgacccaaccagcccattaacaagagcacaggctgatgtgttaggactgaactggagaagacaggtggaagcggcgagcccagtcagaagactatgcagtcatctaggagaagctggtgcctcgggtcaggatgggagcagtgggcgtggggagaagtggttggattctgaatatatatgaagatagaaccgatgatatttgccggtgggtcacacgctgggtaggagagaaaaatgtgacctcaagaatgacttggaaaggtgcgatggttcgtgcctgtaatcctggcactttgggaggccaaggtgggcagatcacctgaggtcaggagttcgagatcagcctggtcaacatggcgaaaccccgtttctactaaaaatacaaaaattagctgggcatggtggtgcacgcctataatcccacctactaaggaggctgaagcaggagaatcacttgaactcaggaggtggaggttgcagtgagccaagatcatgccactccactccagcctgggtaacagagcaagaaagagcaagactcatctcaaaaaaaaaaaaaaaaaaaaagaaaagaaaaagaaatactccaagatttttttatttcagtaactagaaggatggagttgcaggaacgagaaggatggagactgagatgaggaagactacaagaagagcagatatagagggaagattaggacctcagttttgaacaggttacatttgagacaactatttgacttccaaatggagacagtgagtaggcagtaggacattgttatcacaggagaggacagctctgtgcatgttactacccctgaagaccttccagtgggacaatatcatcaacagtgaccttggtgatcctgaccctgtgtgggcctaggctaatgtgtgtatttgtgacttcgtttttaacaaaaaagtttaaaaagtaaaaaaatttggccaggcacggtggctcacacctgtaatcccagtcctttgggaggccgaggcaggcagatcacctgaggtcaagagtttgagaccagcctggccaacatggtgaaaccctgtctctactaaaaatacaaaaattagccgggtgtggtggcgggtgcctgtaatcccagctactcgggaggctgatgcaggagaatcgcttgaaaccagaagccagaggttggcagtgagccgagattgtgccactgcactccagcctgggcaaaatggcgaaactccatctcaaaaaaaaaaaagttaaaaagttaaaaattgtaaaaatagaaaaactcttctaaaataaggatataaagaaaaaatatttttggacagctgtacaatctgcttaaagctaagtaggtattacaaataagtctaaaagttcataaatttaaaaagttacagtaagctaacgttaatttattattgaagaaagaaaatcttttataactttggtgtagcctaagtgtacaatgtttataaagtctacagtcatgtacagcaatgtcctaggccttcacattcattcctcactcactcaccgactcagccagcacagcttccagttctgcaagctccattcatgttctgtatatgtgaaccatttttcatcttttatactgcatttttaccgtaccttttctgtgtttagatgtgtttagatacacaaattcttactattgtgttacaattgcctatggtattcagtacagtaacatgctgtacaggtttgtagcctaaggagcaatacgctataccacatagcctaggtgtatagtaagttattccatctaggtttgtgtaagtacattccgtgatgttcgcataacaatgaaattgcctaacgacacatttcccataatagtatccccatgattaagcaacccatcactgtatatatattctattggttctgtttaaactgaggaccctgactaatgcatcaagcaagtgcaatgaagtgagagagaagggacagagatgtttacaaccaactgaaggtgcaatttcagcaggataaggagggatgtgaacacccaagagcgacagggtaaattcctgggggtaagctcagtggattgtgatcccgtgggcttgaaggattgctggaggggggcattatagggagttacaaagtcaattctaaacactttccaattaacattacacaacataaatactgaaacagctgtttccatttttctccagacttgcaaaggtaagactgctgctacaaaggcccggcagacagtgccactcttccctcctggagcccaggcagaaggcagcctcagaaggttggggtgggaggtgggaaggaaatgggctgccttcagcaatagtgcagatgtggagtaagaagggcccaggagagccactcacaccccaccaagcatcgtggagatccagggactttcccatagccctgcaagggccaagtagtaactgagaattccctcagggtgcctgctgggggtcacctgtactggagcagaggagcacattggccaggggtgacagctcagggatgggagccagaaggacgttgtggctgggtgaccaggcagcagggcaggggcgcaagctccctgggagtacccagtatgcagagaaagtaagacgaggttccacccaaagaagagaccaagtatgaggacacatagctcctcccaggccagctcagaggaccagctgcctgaggacaatgcctcaatgttccagaaacttctccctgccccagggacttctctgggtggagaaggattactcagggacttctgatgagaggagaaatcatgaaggtgagaaactttcataagaacttcaaactttgaaatgagtgagaaatttactcaaaagaggctttcgtctttaaacagaaaatacagaattaccttgagtggcaagattgcttttccgagtgaaaacagagaatgactgttacggagatttttttccactgaaaggaaaaggctcatataacaaattccagaaatctggttacccttctgcatatctgagtggtgactctcaattctcattgctctacatgcaaatgaagccatgctatataaaacagctcttcatgttgacagaattataaaataatattggaataggaagaggcctcaggtcatctaatttaatggttctcaactgagagcgattttgccccccagggaacatttgaccccacctggagacatttttcattgtcacaacttgagaggtgctgctggtatctagtgagtggaggccagggatgcggctaaacatcacccgatgcataggacggcccccctgaacaaagaattctgtgttccccagtgtcagtagtgccaaggttgagagatcccagtcaaatccaaaattctacctaggcatgcagttcttcagagaactccctcctggctcagtcagcctcggcttcagaatttccaaggtaatatggaatactatgcagccataaaaaagaatgaaaccatgtcctttgccaaaacacgtgtgcagctggaggccattatgataagtgaattaatacagaaacagaaaataaaataccacttctcacttataagtgggaactaaagagtgggtgcatatggacataaagatgaaaacaatagacactggactacagaagtggggaggaaagaagggggaggagggttgaaaacctacctgttggggatgatgttcactatttggctgatggggtcaatagaagcccaaaccctagcattacacaatatactcatgtaacaaacctgcacatgtacccctgaatataaaataattgaaggaaaaaaataatttccaaggtaatttgcccactgattaagtcatggaggcaagattttttcccagctctgcctgagcccagagtctgtgcttcttaaaccactctgtcatatgccaaggtcagtcaaaacagggacatacgcctgtaatcccagcactttgggaggccaaggcgggcggatcacgaggtcaggagatcgagaccatcctggctaacacggtgaaaccccgtctctactaaaaatacaaaaaattagtcgggcgtggtagcgggcgcctgtagtcccctctactcgggaagctgaggcaggagaatggtgtgaacccaggaagcggagcttgcagtgagccgagatcacgccactgcactccagcctgggcaacagagtgagactccgtcttaaaaaaaaaaaacaaaaaaaaaaaacagggacgttgcacttgtggtattctgaatgcccagatggtgggatgtaaagagttgtcctgaaagatccccttcccaaaactctctctcccactaacctgccacagtacctggactccgtcactatgaatccacccctgtggatgatggcttcctcgcttgaggagcatcctatgacaatgcaggcactccacacagatttgaaaaaaattactctacgtacagtctaagactgacactgtctgttgaccttgggcaaggtactcgacctccctgtgcctcactgttctcatctgtaaaacaggaataataattatacctacctcgtgaaggtatgaagattcaatgaatgattatatgtaaaacaccaagaatactgcctgacacacagtaggtacaattcgtggttgttgttaactgcgttttcaggcaatcataggggaaatctgtacgggccctttaaaaagcctggcagaaagccaagctttaaaaaaaattagtgactacaaaagtgcagcttctgcagtttcttttcaagtcagacaaactgttcaaaattgaacaagcattaataagaagttgaagagtggaaggcagtgagtgatggactattaacttggtggccaaagaaactccaggttagagaaaaagattgtcgtggaggttgatgcggactcagaaagtagcccacggaacttctgtgcttttcccttagccacaagaggaaactaagcaaagaggtgaacaggagtttgagaactaacccatgtgtttgggagaaagcctcatgtttcagcagaaagcctgcttctctctgacagtgcttggcaagtctaatgaggacagccaagaagataaagtagacattgccctgatcagcagcaaacacaccctcagttccagaagaagtggaaagcgacatacctggcggaggttatccgtgggcctttggatgcctaagtgtaaagtgggagagaaataaatatttctcctaagaagaagaaagaaaaagagtgtaggatgagccgtaagaaagggctgtgtgagtacctagatgttgatatttctggaaaatttcttgcctatcatcttacagatttgttctggatttttttgtcatggtaaaacacacataacataaaatttaccattttaaagcatgcaactcaatggcattattgcattcaaagtcttgtgcaaccatcatcactctctaattccagaacacgttcatcaccccgcaaagaagccccattagcagtcactctccactccctagttccctaactaccattaatctattttccgtctctacagattcgcctcttctgcatatttcatataaatgtgatcaaacaatacgtggcgtgagtctgacttctttcactcagcgtgttttccaggttcctccatgttgtaacctgcattagaactttagcctttttatggccagataatattccattgtatggatatatcacattttcttttccattcagctgttgatgaacatttgggttatttccaccttttggctattgtaaataatgctgccataaatattttgtacaagtttttgtttgaacacctcattttgattcttttgtatacctggactggaattgctgaagcatatggtgactccatttaacttattgaggaactacaatctattttccacagcagctgcaacatttgaattgttatggatttttgccaactgaattaggaagaaataggaaaacttggagctatagggaaacattgccattggcccctttgcaaagcaatctggcagtgtgaggaacagtgtagcttcatagaaaaaggatggaactcaaatccaatatacctggggtccaatatctagctctgccgactactagttggcaaaacaattaaccttccctaacctcagtttcttcttctgtaaatggggttcttcttctgcttcatagtattatggtaaagattaaagagctttgtcaaaatacctggcacctgataggcaccctctaagttctagctattgttattataatgtatactgttttagaaagtataaagagactgaaaagtcctgttatttaactggaaaattccgcccttgaaaacctatgtgaagaaaatcaagtctaccatttctactaaggaaaaaaatccttcaaaatatatgccatattatagataagccagtagtaccattcttaagcaagaaggaaatgaagaaaaccaattcttcagcaccagctgtgccctgggttctgggttaacttcttgacatattcatacattaaacatgcatttattgagcctgtattacttactacttaatgaactaggccctggtgatacagcagtgaacaacagagacacagttgtgaaagaaaaataaatttaggagcccccaaatcactaagttaaagagaaaagtcaggctgggaacttcttagggccaaactgcctcccattctactcagtcacccctctgctcactgagataaatgcatatctgattgcctcctttgaagaggctcatcagaaactccacagaatgcaaccatgcaaccatttgtctattagctacctacttcctggaagtcctctcccctgcttcaagtcttcctgcctttccttcaagttgtcctgcctttccagactgaaccagtgttcatcttgcatatgtcgatcaatgtcttatatctccctaggatgtataaaaccaaaccatactctgatcacgttgagcacacgttgtcaggacctcctgaggctgtgccacgggcgcacgtcctcaaacttggcaaaataaacattctaaattaactgagacctgtctcagattttcagggttcacacagtccctgccctcaggaagcttatattctagcaggaaagaaagccataaaacaattaatagtaacagctaacatatactgagcacatgctttgtgccaagactattctaagtcaggtgttggcaaactatgagccatgagccaaatctggcccacctcctgtttttataaataaaataatattggagtaccgccatatccactcatttatgtattatcgtccatgtttgcttttgcactatggcagcagagctgagtaactgagacagagaccacaaggcccacaaaacttaaagtatttaccatttggtcctttacaggaaaagcatactaaacctctgctctaagcacaacaggagttgtccttagacataggtacagtactcttattatgctcattttgcacatgaagagacaggcacaggcagacaaagtcacttgttccaagtcacacatgtagaaaatgaaacaaatctatagtttagtctggctataaaactcatgctttacaatctatactattctgcctacccaaacaaatacacggtcatttcataacaactgtaaaaagtgttgtgcaacagaagagtatgtggcgcctcactgaattgtacaaccgaggctaagatttaggatttaaagggtcaggaagagttggagtggaaatgggacacattccaggtgtagggaacagtgaatgaaggacttgagatgggaaagggctggcccattctaggaacagtgtagctggagacagatgggcctatgggagaggcaggaggtagatgatgtgaggtcgggtgggccaggttgaagattttgaaccttactctaagaccagtaatgagccattgaagggtcttattcaagaacatgctaatattagatttgccttatttcaaaggtggctctggacagcgtggagacaagcttgggatatgggaactaaaagcaggagagactcattagaaatgatcgccaaaatccagatgagagacagtggtggtttgaccagggctaggatgggagagggaagagacagattcagaaggggaatggagcagaatcagtaagacttggcgcctgactggctatgatggtgagagggaaaggggtcatggttaggcatccaagtttctggcttgggtatttagtatgtattgcttctggcatattggtctgggttttgaactgtaacaatggaatctgctgtagctagtttggaaaaaaagagggttataaaggggtatggagaatctttgttagaaagagtagatcaaggtctaggctgagtttccaggaacgactccctggtgaaaacagcaaggagactccagaacagggctgcctctgctcacacctgtgtcaacaagatggagatgcccggtcctaccctttccagctccactgagaagcaaaggccctggtgcatctgatcggttggattggtggattctaggtcacatgactgcatcctagcagcaagggaggctgggaaatgcagtccacttttcttttgtgttttggtttgcatgttgggggaaaaatcaaatgtggagaagatgttctagagattctgagctgcttcagggctgggtgcagtgcctcacgcatgtaatcccagcactttgggaggccaaggcgggccaatcacttgaggccaggagttggagaccagcctggccaacatggcaaaaccctgcctctactaaaaatacaaaaattagctgggcgtggcagggcacgcctgtaatcccagctactcaggaggctgaggcttgagaatctcttgaacccgggaggcagaggttgcagtgagccgagatagcgccactgcactccagcctggccgacagagcaagaagactctgtctcaaaaaaaaagattctgggctgcttcaaagggcacatacctgctatagcagatagcagggaattagggtgagggttaggtgttagagttagctgagatcacagctgacatcacttagaaggaaaacaccaaaggtggagctggtttgagaagggaaataggggtttatttctggacccattgaatgagcagtgcccatgatatccaggaggcagctggagagatctcgtttaatcctcaaagcaaactatgaaatctacgttaaaatccacttgctctaatgtcacataagaagaatgtggaaaaaataggacatgaatccacgatattttggctccaatagccacagttttttcgtatctcataaacactgtcttccaacttcattatcgtccttttaacctctgcctgtctttagttaatataattaatacttttaattctatttttattctatttttattactcccaatttgacaaacaccttggaaatttcaccatttgtccctgtcaaacacaaagtcaccactgctctccataagtcatgctgagatcacaggttttgcactctatcctttctgctcaactggactagggcaatgtgccccgtgagaagatgcatctgaattgtggttttcagaacaaagctgaagtgggcaatgtttctcttggcactaccctttaaatcaccaccaaaattgactcagccttccagaggattggcctaacggcctcattcatgctcaagaaagagtctatcatattccaacaggcttttctgtagaaatgtcatgttgattctacagtttatataaaaatgcaaaggacttaatttaaaccaaaacaattttggggaaaaaagaacaaaattggaggacttatattacctggattgcaagacttactataaagctacagtaatctacacagtgtagtattggcaaaggataatcataagatgaatggaaaagaagaaaacccagaaatagatgcacacatatatgatcaattaatattcaacaaaggtgccaacgtgattgtcttttcaacaaatgctgcttaaccagctgatatccataaagaaaaaagagaacctccacatttagctcacaccatacacaaaagctaactccacaaaggatcttaagccacaatgtaggagctaaaactataaaacatctaggaaaaaacagaagaaattctttgtgaccttagaaattaacaaaaaattattaggatacagaaaagcatggacaatgaaagaaaatattaatgaaatggacttcatcaaattgaaagctcttgttctctgaaagatactgttaagaccataaaaagacaaacaatacaccaggaacaaattattttaaaaacctagtggtttttcttcttatggttgagttgtaaactatagtagatacatatacatctgacaatggacttatattaagaacgtatagatatgtttacaactcaatcataagacaaaccacttgattttttttcaatttgcaaaagacttcaaccagcttcactagagaggatacacaaatggcccacaagcacatgaagggattctcaacataattagtcatcaggaaaatgcaaattaaaagcacaatgatctagcatcgcacacccactagaatggctaaaattaaagaaacaggcagtaccatgttggcaaaaaagtggagcaactggggttgtaaaattgtgctttggaaaatagtttggcgttttctttaaaagtgaaacatacacttaacatatgacccagaaattctgcttctatacatctacgcaagaaaaatgaaaacatatgtactcaaaagatttgtatataaatgctcaagcggctttctttagaaaaaaatgtgttatatccatgtactaaaatatatccccagaaatataaagaaatgatatactggcacatgcaataacatagatgagctgtgaaaatgttattactagtgtttcaatctttttttcatgatgcccctaaaccaaacaaaatacataaaagttcaatttattaactcattaggcccaaacaacatcaaaatagtggttcctatggcatccaacagatctgtgtttccctcaaaaatttaaaacatccatgatacaccatgaatttgctgtagcatcccagagtaccctggcagagtctgagaaccatggggctaaattaatctagtgactgaccgaagaacaatggttgcctggagctgggggaaaggaatattagggaactttctgggatgatggaatttctctaaagtttgattgtggtgccagttacattcttgcatacatttgtcaaaactcatcaaagtgttttgctaaaatggatgcattttattagatgttagacgtagatacctcaacaaagttgacttaaaggccagcatttcgagagactgaggcaggaggatagtttcagcccaaaacttggagaccagcctgggcaacatagggagaacgccgtctctatcaaaataaaaataaaaaggtagccaggcatggtggtgcacacctgtagtcccagctactcaggaggctgagctgggaggatcacttgagcccaggagttcaaggctgcagtgagctatgattgcaccactgcactccagccttggcaaaacagagagacccaggccggacgcggtggcctaagcctgtaatctcaggactttgggagcctgaggcgggtggatcacctgaggtcaggagttcgagaccaacctaaccaacatggagaaaccccatctctactaaaaatacaaaattagccaggcatggtggcacatgcctgtaatcccagctactcaagaggctgaggcaggagaatcacttgaacctgggtggcaggggtcgtggagagctgagatcgtgccattgcactctatcctgggcaacaagagtgaaactctgtctcaagaaaaaaaaaaaaaagaatgagaccccgtctcgaaaaataaataaaagtaaatttaaaaataaaagtaaataacactcaaagatatctattctgggtatgaaaacatatctcatgtatgctcacgtatcccctcacatacacagtcaggcccactcctttttctgcttgttcatagaattgctgcactatattttgtgattggccccactagctgactcttagacttgattgttacctccttcctttccctgtctcttctccacccctgacaattgaagatgctttcatcatttatttcccctgtcccccacccctccccaacattcagatatgagggaatgctgtgaatccaagttgaacagcaagaaagaagccacaagaatttcaaaggcacttgtaggcatgaaccacgattacaaatgaaggatgtggtgtctgggtatacaatagcttgcatagagtacatgcttgttaagtgtgtgttcacctgggtttactgaatttgctgagacttgaaggtttctcagatacactatcattattattgtaataacttgaaactacctcctgtatagcctatgtgactaccatttattaagcatctgcttttctgatagacactacaattagcgctttcagttttctgtcatgaaatcaccccaactctgtgagatagatattattatcttcatttacagatcaggaaactgaggctcacagctgttaagtaaatggatctgttgcacaggtactaagtgaaggtgctgtgatttctattcccgtctgtctactcaaacagctcattgtcgttactatgcctcgctagctaaccacgtgcctctgatctgagtgttataaaagagtagaaccttattatgggaatctgaacctcatgatatgtcagactaaaatataaggagtgatgtagtttatttaaaaaaaaaatacatgcgagaaaaagctgctgggaagattctttctcatagtttttcatagtaaactctaggaaaatgaaatataagaatcatttctctctacagtaccaataatcatcaaaatttatgttgggtgattttccccccttattttcctcaaggtttgtgctttaacctttaacaaatgtttgcaataaattttctctagctaaacattgtttcatcgttggaacatttcctacaagcaatagttttgtcttatcttgggaactagagctggaaggggctcagacatctgcaactttaccttccttccttgcagcaggtaattctttgcctggatgaactgaatttatgctgcttttaaagtccccagaaggcactagcacactaggctcagaaatgctttctcagagccagggagctcttcttgggtctgacatcagtctcacattttgcagttttagcttgcctccacttttttgtacctccacggttgatccaagtctccttcatcctggattaaatcgcaggtactctgcctaggtgccccttgatgcctcgtcaatgcctttgttcaggtgtctttcatctcttgagatgcccactggctacccagggctacctgatgactctcacaacaaccttggtattcaaggtcatggcctgagcctcctctgatgggagtccttttataacatctgtcctgtctgctggtccagtgctggtggatgcctgttgtccacacaattattaagagtgctccctttctttcaccctcaacagtgtcttggtttgcttaataaattatacaatccccttatttgtaagttatcaagaatcagggtgatttccctgaaccttccagctttaggtgctccacatgaatgatcagagactagagagagtgattcagtgcagagtgctcaaaagctgcactgggcaatgtggtcatcaataaccacatgcagctactgagcacttgatgtacagctagtcctgattgagatgagctgaatgtgtaaaatgcactccagattttaaatacttagtacaaaaaatagataaaatggcttgttaataatttttgtattgattagctgggcatggtggtgcacacctgtggtcccagctgcttgggaggctgagacaggaggatcatttgagcccaggaggtcagggctgtagtgagctgtgatcgagccactgcactccagccttggcaacagagcatgaccctgtctcaaaataataataataacaatatttattttgaaataacatttttggtgtgtctgagtaaatattatacatttactttttttttaaattgagatggagccttgcgctatcacccaggctggagtgcagtggcactatctcagctcactgcaacctctccctcctgggttcaagcgatcctctggtctcagcatcccaagttgctgagattacaattgtgtgccaccactcctggctaatttttgtgtttttagtagagacggggtttcgccatgttggccaggctgatctcaagctcctgacctcaatgatccacccgcctcagcctcccaaagtgctgggattacaggcgtgagccactgtgcccatcttatttatttttgagacagggtctcactctgccacccaggctggagtgcagtggtgcaatctcagcttactgcagcctcaacctcccgtgctcaaatgatcttcccacctaagcctcccaagtagctgggactattggaaagtgccaccacacttggctaattttttaatttttttttttttttagagacaaagtctcgctatattgcccaggctgatcttgaacttctgggctcaagggatcctcctgccttagcctcccaaagtgttgagattacaggcaagaggcatttcctgtgcctaatatatttattaagatgtaaatgtaattaaaattaaaaatctattattaaaattattttacttctttaaatatggctactagaagatgtgaagttacacatgtggcctgcattctgtttctgttgggtggtgctgctccagatccaataattcattcccaggagtggtcccactactgactttccctttccttccacaaactaacattgggctgccaaagagcagatagtaacactttcaaatattgctcctcctgggccaggcacagtggctcacacctgtaatcccagtactttgagaggccgaggcgggcggatcacgaggtcaggagttcgagaccagcctgaccaacatggtgaaatcctgactctactgaaaatacaaaaattagccaggcgtggtagcccatgactgtaatcccagctactcatgaggctgagacagaagaattgcttgaacccaggaggcggaggttgcagtgagcctagatcatgccactgcactccagcctgggtgacagagcaaaactccgtctcaaaaaaataaataaataaaataaaagtgaaaataaatagagggagaaatggagaaaagagaggatgggaaagagaaggaaagagacagaaagagaagagaggtacagaggaagagagcgtgcaggtcctgggaacacatgaggagtgagtggcttgggtcaatccccgtcaactgctttaatgtgtaagaatgtgcagccacagtctccaacaatcatactgtcttatcaagagccagggctctcttacaacagttgcaatctggaatgcacagtaaatgactgggtcttcaggagagttttgggtttatgatcaaagccagatgtcacctaactccatctagcctgtgaggacaggctgcctagcgtcccactccaagggaaattcctctccattccttggtggtaatagtgttatagcttccttggcatcatagcgtttctatcttcccacttttctaagaacctgagaagggcatagaggtttgagtgagaggtctccctctgaaaagggatgccacatttcctccaagaattttatcttagcatctgagacaaatggtaaatgaaaatgtaaccccaaagcagaactgctccccatcaaatagttggatctcatttttcagactggacggggcttggatttgccatgtaatctacaatggggcaggttgttggtgcagctcactcccttgaaccccacaaagccaatatgtggcctcacagtttagacttccagagagggtgagatcatccctgccacacaagttagcacattctctttgatgcccttgcaaacccggcatcccccctcaagacactctatgcctgtccgaaaataaaaccctttgatccagccccttcgtgtgtcctacaaaccctcagagtcttcttcattagttctcactctgctggctctgcagagagagggcacagaccctggcacatgcgttacccagaatgggagctcaaacagtgggtttgggttcagctctgccctttctcctctctctgccttccccggcagtgctgggggcagatttctcctaaggtagctgaaagcaaacataatttgccagcacaaagtcagttttctttggaggacctcccagactaatccacgtgaaaatcatcacctccttctatcatgatggccttggccccacttccacggtaagtgacgcatttcccgtgccctggctctgctccagcacattggcttctctcttggttggctttccacttatagagggtctcccatgttaatagacagtgctccttccgtgttcccaaacttccaacacgtactaatctttgggattcaagattgaaaaataagaattcttaggaatcttcaggcattcttaaatgcataagctattaaataacttttctttttttattgtttgagaaagagtctcactctgtcactcaggttggagtacactggcacaattatggctcactgtggcctctacctcctgagctcaagcaatcctcctgcctcagcctcccaaggtactgggattataggcatgagccaccacacccagtctattacataattttcataacattttgttggtgtgttttaaaatcacaatgagtgactacaataaaagcaaagttcaacgtaattttttttttttttttgagagtgggtctcgctctattacccaagctggagtgcagtggtgcagtctcggctcactgccacctccacctcccgggtccaagcgattctcatgcctcagtctctcaagtagctgggatcacaggcggtgccaccatgcctggctaatttttgtatttttagtagagacggggtttcaccatgttggccaggaaggtcttgaactcctgatctcaactgatccacctgcctcagcctcccaaagtgctgggattacaggcatgagccaccatgcccagccagctcatttatttttttaatgatgaaaatacatggtcagtttcacaaagaattgtaacctgcagcaatattcaatcactgaaagacaccagcaaacactattggaaggtgtttgaataatattacattcagatctactagcaaggtttacaacaccactctcaggtgtcaaaattgcagtgtaagggtgaattttgtttcaaagttaatttttcttgtaacccactcatagcatttatataaagtacactatgcatatgaacttattagtatttattttagttgcaaaaatgacttgctgttttcaggagacaggaccatgaacacacacatgacagctacaagcaacactgactgattaaattgtgaccacttctctcctaaactaggacttttgtcctagtttctggaaatgtcaacccttttagctcattttgtgctgctataacaaaatactagcaatgcagtaatttataatgaacagaagttgattggcttgtggttctgaaggttgggaagtccaagatcaagggactgacatatgatgagggccttcatgctgcatcatcacacagtagaaggcagaagggcaaagaaagaaaaacagagagtaaaaggttctgaactggtccttttataaggaacccactccaaaaacaacaaatccactcccacaataatggcattaatccattcttgagggcagagtcctcatgatctaaacacatctaaaaggtccttctctccaacacctccaaattggagatcaagtttccaacacatcaactttgggagatacattcaaaccatagagtccaccctactcttcaagccaacttgtcagttcttcctgctctgacttttgacttgatgtcagtggatttcttttaaacagtaatgtctccatgttgattaagctttcattctcacttgagaattatcatcacttttctcattttctcaatttttgtctgattttatcatcaagatttggaatttttaaaaattatacaaatttttcaagaaattctgggaaggaattccttcatggaaatgactttttcctgagccatccagagggaatactactgtggcccacatagtctctttctaacggccaagtttctcagctgaggaagcaatttaagtcttcccactacattaaacaaactacaaattttatttgcttttcagactgtgtctctgagaagctgtccattgacttgtttaagcaactcattgattgtctactgtgtcaggcacagcactggggacgtgaagatgaggagacacagtccccacccactaccccaaacctgaagtatggagacaggtgatcggctcaggattacaggcaatgatgactagctcatggacatcaggggtctcagggaactcacagaagccgatgccaatcccacctgaagatgtctgagaaagttctacacaggaagtgacaatttggttgattttagaagggaacggacacattttccagacagaaagaaaagataaagaaaatcacacacggagcccagcaaatgcggggtcatgaaatgcaagatcctatatgccacactggggagtttccctctatcccctggtgagtgagacgcctttgaggcatgtagtcaggggagcaatgtgatcagacctgtgggttagaacaatttgttaggaaaactccccccccacacactcatgcatggatatctcttggcagaactccagagactcagagctcatttatccaaaatcaagttcaatagccggctgttcccattggaacatttaggtgatagtggttttcttttttttttttttttcatcaattgatctaggtgaacacctgagctttagtctgaaaacaggggatgtcagtgcccaaagacacttcacaggagaatctcccacctcagtccagagctgattagtgagcaccattcacttcctactggaaaatcctatcctccttaaagacccagccataaccacctgttccaggctgagagatgtctcctgtcctgaatccatttccacatgttgagttcagtgaaagacattctgttgacctggtaaaaggcaccacccttcccagatcatcacctggcagcaaatgtgtggttctgtcttttttgttttgtttttgtcttgttttgttttgtttaccatgtcatttgctcctggtcacctgtgacttgagaagcaaaactatgcataccaatgcaaaaagctgaagtgatgttgggggcagcatcacccactcaaacacactggactggatttttctccaaccagcctggagacccaggagcaccaagcaacagcatcagagaactgacttgtctcaaagcaaaatcagatggttcacagtcggcaagccttttgatcacaagttgcatccttccccatcttctatctccattttcaccctaaagggtctggtggctaaaaggagcccaatcaataacctcatcagggtgagaatgggaccacaaaataaacttgcacttgctagcatgttttgttttcattattaagaatctgatctgtaattagggaaatgtaagtataaaccacactataattcaatgtcatatccattagatatgaaacaggaaaaatctaaaagtttaacaatacaaagtgttggcaaagataggggtaaagaggaattgctgatgtgtaggtaaattaggacatgcactttagaaaacacaatctagtgccataggtgagtttcctgaaacagactctgagccagaccttggcatgtagaaagttgactggggaggctgggcatggtggctcacgcatgtaatcccagcactttgggaggccaaggcgggcagatcacctgaggtcaggagatcaagaccagcctggccaagatggtgaaaccccgtctctactaaaaatacaaaaattagccaggcatggtggtaggcacctgtaatcctagctactcagaaggctgagacaagagaatcacttgaacccaggaggcggaggttgcagtgaattgagattgtgtcactgcactccagcctgggtgacagagcaagagtctgtctcaaaaaaaaaaaagaaacttgattgggatattttgggggagcaacacctataaggtgtaaagaaagcaagagcagacagaattgttgatctgcaatgcagttaccagcagagatttcagccagtccaggggagttatggagctggaatgacatttcaagattgttctaaattgaaacaataaggccaagcctttgtattcctttccatctccccaccatggcctacaggctgtacccaacaagtgtaaccttgggtaagtcagctccctttggccgaaatctgtgagctcagcagctggagaaatgagggctctgtttataaagttgaaaatgtatgtgtttaatcaccaggcaattcagcatccgggaatatgccttagagaaactctccagcacctatacaagggagcgtgcactaggatacccagagtagcagtgacagtaaaagtgaaaacaacctgaaatattcatcactaggaaaacagataaacaaactgtgacacatcaagggatgcaatgcatgctttccaggagttgcaaggttggactaaattcatacatatcgatgtggatatgtctcaaatataaaattgctgagttttttgggttttttaaaaaagtaagttttaggaaggtatacaacatattagatcattttaaacacaaggtaaaactacatatttatgtaagtggaagaacacaaatttaggaaagtggtgactttggatcagggacaggcccagggaactgtgcaggggaacaaatggaaacttcaacattatccacaatgatctgtctcttattttttaaaaaatacaaagccaaatcaacaatgtcagcatgtgttaattctggatgtatcgtgtgtacactgatttaagtttctaatctgtacttttctgcatatttttaattcttcaacagtttttaagaaataagagaataatccaatctgaattcttggactgttgtctgactggtatcttaagaaaagtaatgacagacctctggcctgcagaatcccttagtgacccccgaaaatggtcatacacacacacacacatgcacacacacaacacgggcacaagcagggcacaagggatctttcagtcacttgttgagcccaggtaagtatacatggaacttaagatctcagagctccaccaggccttcctaaaggaaaccaacttcataaagtgttcacaatgcagggactgaccactgctgtgaatccccatctcaggggaggccaaggcatgtcctgggcatcatagagggcaaatggacaagggaagatctcagacctcactggacagggctccccggacattcttagagccagactagcaaaagttccccttagaattaatttcatgaaagcgtttaatctcattctatgaattaaacattatgctagaaacttgagatatgttcaataaaaataaaaggtactatccttggccccactttctagcacggtatgtacacacagacgtgtgtacggatcctgacatgtgtcactggtaactattaacttaggtagaaatgtagataatatgttacaagaacaagggacagtgagaaaggcttcttggagaaagtgattcttgaggtgggctttaacgggatgtgatttctcctgataaaagaagggaagaggccaggtgcagtagcttgagcatgtaatcctagcagtttgggagaccaaggcaggaggattgcttgatgctagaagttcaaaaccagcctaggcagcatagcaagaccccgtccctacaaaaagttaaaaaaaaaaaaaaaaatagccaggcatggcggcatatacctgtaatcccagctacttgggagactgaagcaggaggatcactagagcccaggagttcaaggtaacagtgaactatgattgcaccactatactccaactgggataagaaagcaagatcttatcccttaaaaaaaaatttaagagaagagagaacattctagacagaaagacaaacccacaacaaatctcagaggcataaagtatatcacttgagagcagggtagcaaaaaaatgctgaaaaggtgggcagggccaacatctgagtgtacttactactgtttccatcaggatgggctagagtgtgctgcaatgacaacaaagttcttagagttctgtgacttagcccggtaaaggtttatttctcactcacaaaaagtctaagaccgcaggctgtctcctccctccatagcctctaggtaggatcttttcttgcctcatctggtttctggtggccccagctgttccttgactttcagcatcatgccaatctctgcctccgtcttcacacaaccttctctcctctgtatctatctgtgtccagatttttctcttcatataacgacatcagtcacagtagatttagagcccaccctaatgtcctcattttgacttgatgatatctgcgaagactatttccaaataaggccacactcacaggtgtgaggaattaggatttcaacatagcttttaaggagacacacacatatagcctacaaggtcaccacagcaggacaggaaagagctcagggaaaacacaggatgttttaagggccaagcgtggaagtgacttccaccacttttgcctctctcctattggccagaacttggtcagttggtctcggtctaatgcgagagaaggggagtgcagaggagcatgtgaagtctagtgagtatccacagtgttctctgtgacttccatgttcaggaggcttcagctttgtccctcaggcaacaggatgccaaaagtgtggggagggagaggggaggagcgggtaaagtgagcagcattcggttgtggccgatgggttagacaggagcagtccaggagatcagatgggtgaagacgccatcgaagtgacacagagggagggtgatgaagacctgcaacagggctggattagtgagaagagagcaggtgaaatcgcttttggattagtgagaagagagtgggtgcaatcgcttttggattagtgagaagagagcaggtgaaatcactttcggatcagtgagaaaagagcgggtgaaatcgcttttggattagtgagaagagagcgggtgaaatcgcttttggattagtgaaaagagagcaggcgaaatcacttttggatcagtgagaaaagagcaggtgaaatcgcttttggattagttagaagagagagggtgaaatcactttgaggaaattttcagagaaccagacaaagagaaaagagaaggaatcatttatctgtcttaacaatccattcacatcaaaatattagagtttgagctgaaggaatgcattcagctttggagaaactcttccaaatagttcgcaaagtttcgcaaacgtccaaaaccagatcattttgctaaaattatctatatagtagacaccactgaagtaagtgcagagttgcacataatgaaacctggagaggagatgaaggggcaaagtcaaaccagaaatctctttgaggactttccttcttttgcaaggggatcacagagaaaagaacacgttttggaaaaataccctggaggtttcatgtttccactttgatgccacttctgcaagatgatgccaaaagttcagcactactcctaggggagtaaaaggaacaagcaccagggatgaccacgtccacatcagatgtgagctagagggggcggcttcccacggacacgtttgagttctgtgttctcagggataacttcccccaggacgcccatgccctgcaagacaaacagctctccaggaggagggtgtcctgcctttcatgcaccctggccacgtcccttcctggggaacatgtgcattgaaggaatcttttggcttccctgggccacattggaagaaaaagaactgtcttgggtcacacataaaatacactaacacggctgggcctggtggctcacatctgtagtcccaacactttgagaggcccaggcaggtggatcacctgaggtcaggagtttgagaccagccaggccaacatggtgaaaccccgtctctacgaaaaacacaaaaattagccgggcatggcaacatgtgcctgcaatcccagctccttgggaggctgaggcaggaaaatcgcttgaacctgggaggcagaggttgcagcaagccgagatcaggccctgcacttcagcctgggcaagaaagtgagactttgcctcaaaaaaaacaaaaacaaaaacaaacaaacaacaacaacaaaaaaaacactaacagtaacaatagctgatgagctttaaaaaaaaaaatcgcaagaaagccccataatgttttaaaaaagcttacaaatttgtgttgggccacgttcaaagccatcctgggcatcatgcagacagcaggccacaggctggacaagcttcatgtacatgtatttgcttcccattctattatgtgttcaaaaggaatcaacctgtactttattcctataaggagttttgaaacacaaggctgaaagggatcgatttgttcaagaggagtcccctagccccctgaagggaggcaaggctgaggatcccttccaggtagaaagctttccaggcaataggcaggacatggttgtgccgcagaggcctgagggctctgtttgtgtggcagggaattcagctctgcacgtagtgggttcacgctgggatgcacattctttgtcgctcagtcgagctgtaacccagaaagttagcatttgcttcagtgtgacacggaccatatgacaaccattccttctcttttcctgctgctgcatggaggaactgcagcaggctgacctccacttagggagacaagcgctcacatcctccactcatctcatgaaacaccgtgttctaaactcgcaagccatcccccagtcagagcagccggccaagtttgggaacttgaacaatgtactctttgtacattggaaatgctgtttagaagctgggtggctcacgcctgtaatcccaacactttgggaggccaaggtggaaggattgcttgaggccaagagttcaagaccagcctgggcaacatagttagactccatctctacataacaatcttgtaaaaaaattagttaagtgtggtggtgcatgcctgtagtcccagctggtcaggaggctgaggtgggaggatcactttagcccaggagatcaaggctgcagtgagctgtgattgcagcctgggtgacagaatgagaccctgtctctaaaaaaattaaatgatgtttcagctagagtgccttgctcttttttcttctctttttcctccccacttctcccatttaaatcttccttctcactctcctttggctcaagtggatcccactgtccagaacaaagtgtaaggtcaggaacaattttaaagaatatttggtgggcaaggtggctcacgcctgtaatcccagcactttgggaggccaaggtgggggattacctgaggtcaggagttcaagaccagcctggtcaacatggtgaaacctcatctctactaaaaatacaaaaattagcctggcgtggtagtaggcacctgtaatccccactgctcaggaggctgaggcaagagaatcacttgaacccgggaggcagaggtcacagtgagctgagattgcgccaatgcactccagcctgggcgacagagcgagactccatctcaacaacaaaaaaagaaagttgattagggtattttgagggagcaacacctataaggtgtaaagaaagcaaagctagtgattgcaccaccgcactccagcctggagaaaaagagcgaaagtgccactctttatttatttatttaaataatatttaaataaaaatatttaaataaatttaaatattataaataactatttaaatacttaacataaattttaaaatatttaaatatttaaataaatattatttctttataaataaataatataagtgggagctaaacaatgtgtactcacggacacagagtgtagaatcatatacactggagacccaggaggacatcaggcaggtgagggatgagaaatttcttacttggtgtaatgtacattatttgggtgatggtttcactaaaagcccagacatcaccactagtcaatagatccatgtaacaaaactgcacttgtacccttacatttatacaatttttttttaagatggagtcttgctctgtcgcccaggctggagtgcagtggcgtgatctcggctcactgcaactttcacctcctgggttcacaccattctcctgcctcagcctcctttagtagctgggactacaggcacccgccaccacgccgactaattttttgtatttttagtagagacaggattttaccgtgttagccaggatgatctccatctcctgacctcgtgacctgcccacctcagcctcccaaagtgctgaaattacaggcgtgagccaccgtgccggcaatttatacaattttttttaaaagaatacagtattatcaggtcaaaggcaaatgagaaggaaagtaggatggtaatcattcccctctagaaagcaaattctactctcccttcttagaccctggacttttcaagggtaaggactttgatgtccattggctcaggcaccacaatgtaccttgtgagtattttttacgtggcttgtgactaactgaatgctttctgtacacctcagtgatttgcacacagttaactgaagaccaacaaaggcaagctcatgtatcatggagccccacctctgtgtgatctgctggaaagcgcggttgtataggtgtttttctgtctagcagggattgttggaacagattggaaatgccccactgggatctgctagacttccctagctgcagaagttattaacatattttaatcacccacataaacacatatgcaaggttaatgatctttatgatctccttcgacttaaaactcaccttcttaaaacttctcaggggctcctgatttcgttcctgagaatatccaaaatcctgaaatcttcaaagttttacatcagcagttctcaaacattctaatctcagaacttgtttagactcatcaaagatatttaagacctcaaagggtttttgtgtatgtgagttatatctatcaacatctaccatattagaaatttaaactgagaacgttttctttctaattatgaattcatttttaaataacaataataaaacaattttttttgacagggtctcactctgtcacccaggctggagtgcaccatggttccctgcaacctcgacctcctgggctcaagcgatcctcctgcctcaaccacctgaagtgctgtgattacagtcatgagccaccacgcccggacatcaaacaatttttgggtgattttttgagacaggatcttgctctgtcacccaggctagagtgcagtggcacaatcatggctcactgtagcctcgacctccaaaattcaagcccaagggatcctcccgcctaatccccaccccacaccctcaagtagcttggactacagatgcacaccaccacacccggctaatttttgtatttttttgtagaaacggggtttcaccacattgcccaggctggtcttgaactccctggctcaagtaatccgcctaccttggcctcccaaaatgcagggattacagacataagccactgcacctgaccataaaacagtttttaatttagtaatgtttattgtttaaaaacaataataaaacttttgttaatataattaacataaatataattaacatctataacaaatataaaatatataacaaatataattaacataaataatataaacatattattttgttaacataattaacataaatataattaacatagatattattgatgcaaataacccatttatgaaacctaactctatgtttcaaagcacacaatttttagtgaaaaaactggcattattttacatttttgcaaatctcttcatgtctgacttaaccgaaaacaaccggattctcatgtctacacttaaactgctgtgataaattatgtcagcacatctagagaaaacctggcttctcacagatacacagttagaaaagagaagaatacttaataggcatttcagataatggtgaatattccttttttatatgacaccaaatctcagcacatagtcatttatcaaaggttagttgcaatgtgaaatctgaaaccatatcagtaacgttttcagactcaattatattaaaatccatgaaattatattgtcctttgaatgggtctgtcacgcatacatgattttctatcatcatgtcatttggaaaatattggatctctgagttaagcagatcttccaaatgttgtcacagtacacttttacattctttttttttttttcttaagacggagtttcactcttgttgcccaggctggagtgcaatggcacaatcttggctcacagcaacctctgcctcccgggttcaagccgttctcctgtctcagcctccagagtagctgggattagaggcatgcaccaccacgcccggctaattttgtatttttagtagagacggggtttctccatgttggtcaggctggtctcgaactccggacctcaggtgatcgcccgccttggcctcccaaagtgctgggattacaggcgtgagccaccgcgcccagccaacattatcaaaacgataaaatcacattcattaaatcacccccatctcatcagaaaagtcttcaagtattagagaactatgcaagttaagcatgacagatacaagttttccaaaattctagttttcatttgaaaactcaaattgtattattggctacaaataatgactactgtatttcttgaagagacaggctccctttgttcattttttgagaaaatacctggcaggtatccaagtctgaatagtcatagttcaattgtctgccatcactctttcaaggaaagctggtattccatgaagaaagggctagtgaggcttgcaactcaatcgcaactcaactgcttttccctgagaaaactgctggagtttggtatgcagccaagcactcaatgcatccaaattttttaaagtatactcaagacaagagatttaataaatgagtaattgttttacaacttcatcaacatccttaaatgaaactggattttttttttctgcaaatgcaggtggtaaagaatacaatgacacctggtacagccttggtgtgggctaaagccccatcatttttacttccgttttgcattttgacagtgaaatgtcaaagtgatataaaaagcaagtaccatcttagtagtattatgaaaaacatatttgacttctcatgctccctgaaagagtctcaggagacactagggttccctggtctatgctttgagaactgcagccctccatgctctgacttctgcctgcctgttggccccatcctcattcagtgatttaacttgggctcccgtagaagcagaccaggggacaaggattcaaaagcaagtagttgatttgctaagtgaccccaggaagtactgggaggggactgtgagagtggcatgaagaagagaaggaaaccaatgcatgatgtgtttgttcatgagcggtttacccctgcaggcaactggagctcagtcctgcgggagatgaagtaggatggccacaagattatgtgactcaaggggagagggagctggggcatttatcctcccacactcactgccactggctaggggctgcttgtggagacctcccctatcccttattcactgtgacttgcttcccacatgctatttggtctacttagaaccatcttgtgcctaactcgttgcccggccaatgcccactcattctttaggtctcaggacaagtgtcacctgtagagagactgccttttatccccacaattctaaaacagattcccctggcacagtcattgaaagcacacacagtttttcttctcagagagtcctcctgcagtttgtaattcttatatttttgttattctttatttactgcctttcttcccactaacccagcatctctgtagcataaggatggggactgtgtccatgatttgttttccactcttgcatctccagcacctagaacatgcctggcacacagtggacactcaaccaacacttgtcaagaggatggatgggtgataagtacgaaagtacataaaaggcacatagctagaatttccagtggtgattcaaagcaagtaattcaggtaatcattctggaaaattcaagcactctgttgactatcctcttcaatagctgagtattggttcaaagtgcctgaaggaatcacagccttggcctgtgtggggtcgcagctggatggcagagtgtcatggctcaattgcagccccctattgcctccctctgcccctggcacactgcaggtcctatttcccctatgaggacactgatcccacaagcacatgggcatgtgaacatatgatactagaatgacaaggaaaggaaataccagagaaagatgttcaatgtgtccttccaaattctgacacgcaccatcataagccatgaaactgtgcctctcatggaagcaacagtaaaatccaaatgaagaatgaatgaatgagtgatgcataagaacaagcataggacagtggaaggaactttcctctctagatttcatgcatattggattttatttttctacagcaagccactgtctaagacttttgtttgtttgtttgtttgtttctggtactgcttatttgcaatgccagacaaacagaaaaacccaaaagagaaacttaacagaaaccttacaaatcatctcataacacatgattagggttttttgtctattataattttcaaatacattgtcagtagagtagaatttttataataaaatctaattccctgatgtgacattttaaaagaaccgagctccatgatggacagtagggttggcaaagccttctctagggttattaagtctactgctgggaaaatgctaattcgccaaaacctttttcaagctcaggcctataggagactccatgccaaatttatatgcccaggtgcatgatttcatatgtgctttgaataatggtatctgtgctcagaaaatcaaacagaattaggaaaagcaattgcctgcggggattttcattttgtactagtgacatgagatcattcatgtgccatgccgttttaacaattcagcattgtaaaatcagaaatctttcctcaaatccactgtagaatgtaaagtgttcattttcttcctattacatgaagtgaaggaaacagtcgttctgaaatgcaggcagtatcaaggtaaatgtggtggccatttgctcagtgaaaaatacatggattctttttttcttccagaagagagacaatatttgattttaattactggtacagcgttggagatgttggttccaggtcaaggaagccaagtagctaaaatgaaatatgctgaagcgtcacaggtcaaagagaagtaaacacacataaaaatgggaatggaaatacaataaatgaccacacataacctatcctactcactcattgcagaactgacgttgcttctctcataaacctcaaagcctgctttcaggtttcatcaaatatctagggctccaatatcccaggaatggtttcctcaggcaggccatagattgcaaaccatcccagcctcaaggggagaaacgagaagggcgtggctgctagccaaaaggaagccccggaccactgtgtgccgttatctttcatggtccttgggtttaagtttgcacctggctgcccaggacctgctgagagatgaatgggtaagctcacatttggaaatcacaggggaagatgtcacgagtctctctaaagggaggctacagaatgttaataggtgggagaggccccttaaaagagcttttacagcatccctgagacttgctgcccttgtagagtaacaccctggcatctgcttaacgtacacttaagtctttacaagctcaggctcctaatcacaattaacagcatccttccacttctcctaaaagcctgacatttggtacctcagtcctccttccttctcattgtcctcccctgtggcttccttcctcatgggtcccctgatgctagtatccccacagcctgactcacctcactcccatgccctctcagaagccagctcgcccattgacggggcagcagctggatctgccatggccactaggaactcagagacccaaggggagtgaactccactttataaacctataacctcggcccagaaatatttccaagccccaaagggctaatttgccccacttcccacctccacaatcagtagactttcagctctttttagtattaggaaaagaaccaaaatagtctccaaaagctgacacctcccggtggaagccttggcacagatgctcacaaaacaactcgtagcctcaccaagagctctgtgccttggtgcctgccacgcaccaagctctgtggtgagcttttaatacatattgactgatataaacctcacagcaacattatgggtcaaatgaactgttctaatgcatgcccattttaaagatgaggaaatagaggatgagagaggttgagaacttgcacaaacagcacggccagaaagtggcagagcttggattccaagcaggatggtcggtctctggaacctggctgccaaagccaagacagggtcaaaggatggtgagataagagaacaaagccttcagatttctggtttatattcagtcattatttctttttaagaaaagctccaattcctattttaatcatttatttaaatgactaagcatgtattaagcacttagggtttgggacttaaaggcttcacaaaactaatcaaacatttataagtaagtatgctgtattcagccaggcgcagtggctcacgcctgtaatcccagcactttgggaggccgaggcgggcggatcacgaggtcaggagatcgagaccatcctggctaacacggtgaaaccccatctctactaaaaatacaaaaaaaaattagccgggcgtggtggtgggcgcctgtagtcccagctacttgggaggctgaggcaggagaatggcgtgaacccgggaggcagagcttgcagtgagctgagatcgtgccactgccctccagcctgggtgacagagcaaggctctgtctcaaaataaataaataaataaataaataaagtaaatatactatattctaggaccataaatgagacgttggattcagaaaggtgctatctgtgaacctgtggaaacttcccacttcttaagaacagacaattactaattgcaccacaaggatccctgccaccatccctcactcttgagtgtgtaatacacttgcttgttgaggtgaccaccagggcctaatcaccattcttaaagcaatgtaattagtcatgagtaatgagggtctaagttggagtgttgcctagttagaaagaatgtttttgaaaaaaattacaaaagaacagattgcataactggatattagggataaaggagacaatccaatttcaagtccacaaatattggctgggtgcaggggctcacgcctgcaatcccaacactttgggaagccaagatgtgggattgcttgagcccaggacttagagaccagcctgggcaacatatgagaccccatctctacagaaagtttggaaaaaaaaaaattagccgagtgtggtgggtttgttctgtagtcccaggcgctcaggaagctgaggtggtaagatctcttgagcccagaagttcgaggctgcagtgagccatgattgtgccactgcactctggccttggcaacagagtgagaccttgtctcaaaaaacaagacaaaacaaacaaacaaacaaaaaacacaaatatttattgagcattttcttcatgtaatgacttgtacaaagatcatctagagatgtccctgacctcaaggtacttacataacataagaatgtagagagcagggagataagacaagcaaacaaataatactgcaaattagattaatcatgttgtgacagttgcacaggggaacactaggagggagggtctcatacagtttggggctaacgaatgatattttaggaacctttatgggcatggaagggatgatgggtatgcgaacctctcactgccctccccttggcctagactgaagttggaagttcaagtccacacccaccatcgctggaggctggtggaacgatgctggtgggtcacccctcggccggagttctctgctgttcctggctccatccaaccacttctatctgggagctctggagtcacaagcaaagggcacggattgctactggaggtgttcaggtccttacagaaacccagggaaactcagcctcttgttagagaagccagcatccccaggaatgtgagatgaagaggggtgctgtgcatgacatccatgggaatgaaacagaacactaatctagaagcaagagcaagtaggagttagaaaacatcagttcctaaatgactaacccacttcctacgcagattgcatagtgaaaagactgctgcgttagtaggaggtttaagagattaggcatacccagccaggcggggtggctcacacctgtaatcccagtactttgggaggccgaggtgggcagatcacaaggtcaggagttcgagaccagcctggccaacatggtgaaaccctgtctctactgaaaatacaaaaattagccaggcatggtggtggacacctgtaatcctagctacttgagaggctgaggcaggagaattgcttgaacctgggagacggaggttgcagtgagctgagatcgcgccattgcactccagcctgggcaacaagagcaaaactacatctcaaaaaaaaaagagagagagagacagagattaggcatacccattgtgtttctggctgatgctctcatacgagttctgttctaacacattcactgaagtttccatgttgcattcagacagatgacattcatctcctgcaacagtcaagagaatgtccaaattcttcattttatttgattatgatttttttaaagagaccattgccaggggctttggaatcttcttaatgtacaaaggtaacagcaaatacaggaattgatggtctctatgtctcaccattcatttataattttcttcctggaaaaaaaaaaagcttccaggaattagtgtctagtgtatgataattatgtgcctgttttgtataaggtggaatctgcaggtaacatcttttctgttatgatgaataccacttaaatggcttgaggtggtcaattaatgaacaatgcaatttttgtgtatcaattttccaaattatgatacgttataatatcatcaacttggaattctcatgtaagagtcagtaatatatgtttgggtccacagttcctcagagtgcacatgaaaatattattaaacctgagttattgagcttacgggctacattttcatctaaattaatacaattcagcccgaaggcaaaagaatgtattaaaccagagctcctaggagaaatggctaattccaggactggagcaagaaactacagcatgagcctgcaacaacctgttttgccaaaaagtaaggaaagtaaggatatgatcaaaaggacatacgatcctgtataaaggggctcctacctggccaaatcggggacactttgagcatcaaaatataacaaaaataatgcatcctggccaggcgtggtggctgatgcctgtaatcccagcactttgggaggccgaggcgggtggatcacctgaggtcaggagtttgagaccaatctggccaacatggcgaaaccccatctctactaaaaatacaaaaattagctgggcgtggtgacgagtgcctgtagtcccagctactcgggaggctgaggcaggaaaatcgctggaacctgcggggcagaggctgcagtcagcagagattgtgccactgcactccagcctgggcgacggcaagactccatcttaaaaaaaaaaaaaaaaatgcatcctatcctggcatccattgaatcaaataagaatgggaaagtccatactgatttaaaaataaatgggagaaaaaaaagaacatgctttctcatagtaaaatgcaaactaataaatgtagaaaaaacagaagtagaaaatcactcttttataaccatcctggtaataattgattcaagtaggaattatcaatggctgtgaaaagtagagtaagtgtgtgacaaacaataggatatttctatattctcaaagtatttcccgacagattgcttataaattacaaaggagaaaataatgatttctagggaagaaacctgacaagatgtcaccctaatcaacagatcaaagttgacaggacagactgacatgactaccgtgccttcagatgtgatatgatgggaagagcacaatgtcactcatacagtgttttgtccaaaatgcataacctgaatgagatcatgaggaaacatcagaaaaaaacaaactgaggccttagcaacccctccagtcatgttgttctatgggtctacaatatttcttttgacgatggtaacagcaccacctcaggatttcctactggtatgaccgtgctgtaatcccagcactttgggaggctgaggtgggtggattacctgaggtcaggagttcaagaccagcctggccaacatggtgaaaccccgtctctactaaaaatacaaaaattagccaggcatggtggtacacacctgtaatcccagctacttgggaggctgaggcaggagaatcgcttgaacctgggaggcggagattgcagtgagctgagatcatgccactgccctccagcctgggcaacagagtgagattccgtctcaaaaaaacaaaacaaaacaaacaaacaaacaaaaaaaactgacggacagtgaagggcagctagcaaataactggcctacaatttttttaaagtgataacatgaagaataaaaaagctgacaaactgttccagattaaaggtaagtaaaaaatcattatcactaaaggcaatttgagctttcgatttggctcaggattgtggggaaaggaggtggggtggggaaaagaggtggaggacatgagttgccacaaaattattgaaacaattggtgagatctaaacacagactccagtagataattacattgtatgaatgttaaatttcctggatcccatatttgtactgtggctatataacagaccctccttgttcttaggagtatactctggagcatttataaagggacatgatatctgcaactatctctcaaatggttcagaaaaagcgaatgtggcaaaatgttaacaattggtcaatctgggcaaaatgcatactaatgttctttgtactattttggcaattcttccaaacatttgaaattattaaatgatcccttagcaccccctccagtcatgttgttctatgcgtctacaatatttcttttgatgatggtaacagcaccacctcaggatttcttactggtatgaccactgccttacagattttacactacaatatctcatggcattttcaccacaatgcagtgaggcaattactattgtcccaattgtactgatgagaaaaatggaggcttggaaaggccaaataataatatgtaaattcgatggctgctcagtcaatgttcacccccatccttaatctccatgagagaaatatacttcccctattccatatttgttgggtgagggccaggggactaaatgtggggaaggaatgttagtggaccaggcatgagaagtttgaaatgtgattgtctttttggttgtgcttaccccttgattcttctgccatggttaagagaaaaacatgtcgtgtggagcaggcctgaacctagcaacagcttaaagccaggccagctgagcccagcctggatcaaccaacacaagccaacccatgaatgcatgttattagctgctactgagtttgggggtcatttgttatataactttacagtggcaggccgggcgcagtggcccatgcctgtaatcccagcactttgggaggccgaggtgggtggatcacctgaggtcaggagatcgataccagcctggtcaaacatgatgaaaccccgtctctactaaaaaggcaaaaaattagctgggcgtggtggcaggtgcctgtaatcacagctacttgggaggctgaggcaggagaatcgcttgaacccaggaggtggaggttacagtgagccaagattgcaccattgcactccagcctaggcaataagagcaaaactccatctcaaacaaaaaaacaaaacaaaacaaaacaaaaactttacagtggcaatagacaactgatacaactaacatgtttgaaatcacaaagatagcaagaattggagccagtcagaagcagtggctcacacctgtaatcacagcactttgggaagccaaggcaggagcatcacttgcacccaggagttcaagaccagcctgggcaacatagcaagaccccatctctacaaataaaaaataaaaaattagccaggtgtgatggcacacacttgtaataccagctactcaggaggtttaggtgggaggagcacttgaactcagaaggtcgaggctgcagggagctgtgatcacgccactgcactccagcctgggcgacagagcaagaccttgtctcaaaaaaaaaaaaaaaattggagccaggaagccatgttgtcgtggtgccttatgccactcctctattaaagagcacttccaaatatgtatagccttcttattcacaatgatgactggtgaccctgtaaacgcctaacatacctcctgaatcatagaataaaagcaattatagcatcaaatacaaatctgtcttattttattttacagtaagttgataatcatggcatatttaattaacttttctgtttaccatcctggtcatatggtactactatttttcaactttaataattatcaaaatattcaatatgcatggattttaagtggcatggagtggaggtattgcttgaataataaccagtctctaatgtcagatgaaaaaatcaattctgtaaaaattgggatgaatttcctagcaagggtttttactcctctgtgtcctaagacagaagagaatgaattctgctgcatattttgagtctctggttttagtcttccacagaacccaagatggaaaaatacacctgttctcaaatcttacatccaaagcaaattttccaatttaaatctaaaggtaagtttgtttgttcatttttccaaatgactaaagatattgttatgtttttgctaacatattgaaacattttttcttatactaacaaatgaattatattcagccaaggagtcttttttaaagtaacatttagctgaagagcaaatcccataataaaaatgcatctaggcggccgggtgcggtggctcacacctataatcccagcactttgggagactgaggcaggtggatcacctgaggtcaggagttcaagaccagcctggccaacatgatgaaaccccatctcgactaaaaatacaaaaaattagccgggcgtggtagcgagcacctgtaatcccagctacttgggagactgaggcaggagaatcacttgaacccaggaggcagaggttgcagtgagccaagatcacgccactgcactccagcctgggcaacaagagtgaaactccgtctcaaaaaaaaaaaaaaaaaaatacatctaagcatctagaattgtagcacaacggttacgacttggcttgtaactattaattccattatgcaacagttcctggatcattaataggtctactttgagcaaatttctggtaaaaaaaaaaatggcccctgttaattcttttgtgacagcgccctcaactttcattcaagtcagatgcagacagcaaaaaagaagaagatgttaaaaagtgaaatattataaagttaatgctcagtcaacaatatgctgttgcatgtatgcctggtgtgggaaattttatactatgagaacttggttttttgactcctttaaaaatctcctataaatacacataaaagtgaactccctaaaacatacccttattttctaaagcctgagtttttctccccctcccgtacaagcaaggcagattatttgcagaaactgacattaaaaatagctctggtgatattgtctacaaagcagaagattctctttttgtttcatactcccattaacgagacaaggcaaaaagtgtgtgaattgaagagtgagaaaacaaacactctaaaagaatagaatgcaaaactcccccactggctcatgaagatgtcaataaagcagacatttgagctaatttcataataatgaagctttggtaacagtgattaaacaaatgtaattcattttcaggggatagatggcatagtctcctcttacgctctcaagaagaatagatgttcttctgccatcttcactggataaaagggacccctcaaaagcctgaaacaaagcagtgaatcaggagctgggaatttccaaagaggaaagatgtcccattgcttctcattcttaatttgtctttgcagcgtatgcaagaagctattcttagataagaaaaaaaaaaaagaataatggcagcaattttgacttcatgacaagggtctggtcccttcaaatggcctccagttttttctagtatgacacaggtcatttatatttttataagaagagaagtcagcacttgattttacaactattgaagtggaataatagttagcaaatgttgaaactttaaatgagacgtaaaccatatcagaagtggcgaggcagcaaatgtgcgtctgtggcctgcctcatgaagcaagaagagggtctcattaaaaattcggaaaacacataaattatcccacaagggtgtaaaacgtataagaaaaaattcatcaacaaaccgggggaactaatgttatgcagattaatttcaaagtccttcaacatcaaagaggtcataaaaacgtgtttaagaggtagaatccattatgccatctggaattcagatttccggttgcaaaccaattggtatcatgaattaatcttctcggtagaagtaatctggtatggtcaataaatcacaaaatatgagacagtcgttacatatgtaatatagataacagacccccatccataatgttctgttatggtaaacctaagttatctgaaaaggaatatatatgaaatataaatttgtagacattttatcactgcaataaacaatgcatattgcatttgttaaatactattgatatgtgtaggttaagcctatattcttaacatttttaaggttctttcccctttttgaattgggattgaagagtggtgagacactgcacttcacttgtttgaagagccaagatggccttatccacacgtctaagaacaggtgttcttttctgagcgcttactctatgccaggcagtaggcttagatggcagactcaggatttgaactgagcagtcttactccatagcttattcacttaactagaatgatttgatgcttcccaaacacacatctagaaagtgtgatttcagaacttttctcccccaaaccccctaaaactcatcggctctagctggcagtgactgtgaagtcttatccttatctgtgccctaagagacctctagatgcctggggtaagaaaggaagcacaatgttggaggatggctgtgctgcccctcccctcttccctcctcatggttctagggtgggcactgtgtctggaactccagagagcaaccattgccacgctcccagtgagattcaaaccgacttcttctcatctgggccaactgaagaggggacctcatccccttccacatttcctggccagcaaggatagaggcatgtatttccagaaggggcaggatcttccagtgaccctcgctggggggttcatccagccatagagagccggcacaacttgtctttcctgccctcactttcccaaagcagcaatctcctcatgacttcactcaagtggcattatcttctttctgaaagaaatttggacataaagaaataaagcacctctctgagttattgaagctggtttgccaaccttgtttatgccactggttatttagtggccaggttgaatatcacccatactcaaagttcaagaggatggtttcaaaaactagctgacataaacagatgggaaactgagcgttagattgaagtggctacattgctctacacagtgctaaaagagcttccatgttactgctttgcagaaggcatcttcatatcaaataccaatttattctctttaaccagagtaggtggcagcctaagtgattattactaatgcctgaagttccttaactggaaaatgtctttcatccatcaattagagaaaggtttgaaaggcaattcccctcagtcagtgctactaccttgatttagctctacactaagaataaattattagtaactcatcatatactactgagaaagaaggggagaggaaagagaaatacagtgcctgcagtggggaaagagaatactctatagacaactaatttcttgagtaatttcttaaaattactctattattgcttttgggtttttttgtttttttgttgttgttttttgtttttgtttttgttttttgtttatttgagcagtcttgctctgtcacccagactggagtgcactggcgcaatctcggctcactgcaacctccacctcctgggttcaagtgattctcctgcctcagcctcctgagtagctgggattacaggtgtgcaccaccatacccagctaagttttgtctttttagtggagacagggttttaccatgttggtcaggctggtcttgaactcctgacctcaagtgatctgcccgcctttggcctcccaaagtgctggaattacaggcgtgagccaccgcacccagccaaaattactttattattgaatataagctcaataaacattttctaagtaaattaaaactgaatggaaaattgaagatggggagaggagaagggaaaatggaaactaactctgtttacttcttgattttacaaaaggcagctaaatggtactttgacaacaaactacgaatagaaggaaactttctcaacctgataaagactatctgtgaaaatcccacagctagcatcacatttaatggaaaaaaaaactgaaaactttccctctaagactagaaatgagacaaagatctttgctctcaccgtttctattcaacattgtactggaggttctagccagagcatctaggcaagaaaaagaaacaaaaggcatccagattggaaagcaagaagtaaaatgctctctatttgcagaggacatgatcttatatatagaaaattttaaaagatcctctacaaaactattagaactaataagtttagcaatgtctcaggatacaagatcaatatacaaaaatcaattgtatttttatacaatagcaaggaataatccaaaaataaatcaagaagactatgtacaacagcataaaaaaaaaaaatactcaagaagacattcaacaaaagaagtgcaaaacttaaccatacatctaaataatgaaaaaatattctatgttcatagatcaaaacttttcagttaagatgacagtactccccaaattgatccacagattcaatgcaattcctgtcaaaatcccagctggatcttttgcagaaattgacaaaataaccctaaaattcacatggaaatgcaagagacccagaatagctaaacaatgatgaaaaagaaaaacaaagttggaggacatacacttcctaatttgaaagcttacaacagagctacagtaataaagacattgttgtactgggataaggataggcatatggatcgatagaatagaactgaaccagaaataaatcattacatttatggtcagtttatttttgaccaagattagaagagataattcaatatggaaagaatagtctatccaacagttgcctctgggacaactgaatactcacatgcgagaaagtgaagttgaatccctgtctcacaccacacacactaattaattaaaaataaatcagaactaaatgtgaaagctgaagctctaaaacttccaaaggaagcacagaaatacatctttgtgaccttggattaggcaatgacttcttagatacaaaccaaaagctcaagcaataaaagataaaatggataaattggactacatcaaaattttaaacttttgtgacactatcaagaaagtgaaaagacaatggacagaatgggagaaaatattttcaaaccatatatttgacaaggaatttctatccagaatatataaataattcttagaaactgacaataaaaagacaaataaaacaatttaaatgggcaaaggatttaaacaaatatttcttccccaaaaaatatacaaatggccaacaaacacatgaagggattcttaaagtcattagttataagagaaatgcaaatcaaaaccacaatgagataccacttcacatcctgtaagatgactagtattaaaaagacaataactaggccaggcacggtggctcacacatgtaatcccagcactttgggaggccgaggtggatggatcacttgaggtcaggagttcaagaccagcctggccaacagggtgaaacccagtctctactaaaaatacaaaaattagccaggcatggtggcacatgcctgtaatcccagctactggggaggctgaggcaagagaattgcttgaacccaagaggtggaggttgcagtgagccaagatcatgccattgcactccaacctgggtaaagaagtgagactctgttaaaaaaaaaaaaaaaaaaaaaaaaaaaaaagacaataactagtgtttgtgaatatatcgaaaaattggaaccctcattatttgctgctgaacatgtaaaatggtgcagctgttttggaaaatagtttggcaatccctaaaattgctaaacacagagttaccatatgacttagcaattccattcctaggaatccaaaggaactgaaaacacgttcacacaaaaacttgcacacaaatgttaacagcaggattattcataataacccccaaaagtggaaaaaacctaaatgcttatctgctgatgaatagattaaaaatgtgagggttttttttatatagagtattatttggcaataaaaaaagaatgaagtagtgatacatgctacaatataagtgaaccttgaaaaacattttgctaactgaaacaagcctgttacaaatgatcacaaattatatgattccatttatgtgaatcaacacatagacagaaagtagataagggcttgcctggggctgagggagggaggaaggaatgaacatggggaatcactgttaatacatagggggtttctcttcagaaatgttgatgtgatgaaatgttctaaaattaggttatagtaatgaccacatggctgggaatacgatgaaacatgatacattataaatggatgggttttatggtatataaaatatatctcaatggatcttttttttgaaaacatactttagcataggctctattaggaaaaagaaatccacctgtcatacaacttgattttcaattttttttctgagataggatctggttctgtcacccctgctggagtacagtggtgcaatctcagctcactgcagcctccacctcctgggctcaggtgatcctcccacctcagcctcctgaatagctgagtctacaggtgtgcatcaccacatccatctaatttttgtattttttgtagagatggggtttcaccatgttgctcaggctggtctcgaactcctgagctgaagtgatccacccctctcagccttccaaaatgctggaattacaggtgtgagtcactgcacctggccttggattttcaaattttgattaagttattgtggtagccaatgtgagttggctacccaacaaccattctcctcttgtctctgcaagccaaatcccaattttgtccaggtaagaggcaacagtgtgcctctcccaagtgctgagtattgattaccttaactccaaacccatcacgatatcctcatctacctttgacagtgattcattcaggagtggcaggtgttccagtcctggccattgacacaaaagagaagtcttctgctaaaactcttagcaggataaaaagtcctagataaaaaaggaagatcccaggccagatgtggtggtgcgtacctgtaaccctagtactttgggaggctgaggagggaggactgcttgaggctaggagtttgaggctacagtgagttctgatcacaccagtgcattccaggctggataacagagacagaagaaagaaagaaaagaaagagaggaaggaaggaaggaaggaaggaaggagggaaggaaggaagggagggagggagggagagagggaaagaaagaaggaaggaaggaaggaaggaaggaaggaaggagggaaggagggagggaaagaaagaaagaaggaaggaaggaaggaaggcaggcaggcaagctagctctctctattccctgattttagacttcattttgggggaagtaatgcttgggggtacatgagtcatgtgataatcttgaggacagggaagctgcctcgagctgcatccctgaaaccacctgttaccaaacctcttagaaaacaagatttttaaataaacctcactgtttaagccacattctgtcaaagaggctgtttactgcagctgaaagcctgctcattaatatattttctcttaaatgggcttatttgtgaatactcacaaaattacatgctcagtcctatatcaagatttgtctttagaagataaaattgatctagactttttcagaagacagacctagcactgagtcacttaaaggtgcaagaagaaagcactgtgctcagtaggagaaagaggagaaacagccttctatatgtaaagtggaccagagattgatcagcctttgttaggaaggctgatggggatcccctgtctaggaggcaggacaaacctttgacggggcctgcactacagagtttgaaatcctatgttgtttttcttttctttttctttttttttttttttttgaaacagagtctccctctgtcacccaggcaggagtgcagtggcatgatcttggctcatgacaacctctgcctcccaagttcaagtgattctcctgcctcagtttcccaggtagctgggcctacaagcgtgcaccaccacacccggctaatttttaatttttaatggagacagggtttcaccatgtcggtcaggctggtctcgaactcctgacctcaagtgatctgcccatctcggcctcccaaagtgctaggattacaggtgtgagtcaccacgaccggccttgtctaattcttcacgaacaatatcctggcatccaccgtttaagagaatttggtacgttatttgcaaagtgaataagaaagaaatcatactagaaaagcaaacatagtaattctgaaagaaaactaccattttacttctttaaattgtttatcttaatagttcaagaaatgtgtgaaaatacctacaattgttaatgctataatgaaacttctttataaacctgtaggtgtcagatttacacttgtctcgtaattgttatgtaattctttacaaatataattgttttaagtgccaagatttgacctaaataaatgcaaaattttgatatggaataataaggcaacttcaacttgtttttagtgatagaattaatgccacagaggaaggtttaactgttgctgttgttgttattttatgttcaaattttataaagacagtcgggcagtccacttccagaataacaatgtgaacatcatgaatgcactcaccagtgcaaccatcaaaatgcatgaaaattattttttataaaacaggctagaacagtcgcggtggctcacgcctataatcccagcactttgggaggccgaggcgggtggatcacgaggtcaggagatcgagaccatgctggctaacagggtgaaaccctgtctctacctaaaatacaaaaattagctgggtgtggttgtgcacgcctgtggtcccagctactcgggaggctgaggcaggagaatcacttgaacccaggaggcggaggttgcagatcgtaccactgcactctagcctggcaacaaagcgagactccgtctcaaaaaaaattaataataataaaacaggctgggcatggtggctcatgtctgtaataccagcactctgggaggccaagccaggagtatcacttggggtcaggagtttgtgaccagcctgggcaacataacaagaacccaactctacaaaaaaacaaaaacaaaaaggcaggtgcggtggcatatgtctgtagtcccagctgaagtgggaggatcacttgagcccaggagtttgaggctgagctgccatgagccatgattatgccactgcactccagcctgggcaatagagtgagactctatttctttctttctttttttttttttttttgagacagagtctcgctttgttgcccaggctggagtgcagtggtgcgatctcagctcactacaacctcggcctcctgggttcaagcaattctcctgcctcagcctcctgagtatctgggattataggtgtgcaccaccacacccagctaatttttgtatttttagtagagacagggtttcgccatgttggccaggttggtcttgaactcctgacctcaggtgatcctcctgcctcggcctcccgaagtgcggggattacaggcctgagccaccacgcctggcctgccagaccctatttctaaagaaatttgtcttatataaaacaaaactaaaacccagtcatttaaagtcttaggaaattgtccaaaggaaatgaagaaccaagtattcaatgtcctaaatctgggtaagaacagcaagaatcagtggcactgaagtcactctccactccctctgtcctgctcagcatgatggaagctgtattccaggtgggtgtggccaagaagatggggctcactcccagctctcaatcagttgctacaacgtctcgctgggaggcttaagccaacagcatttctcattctgcctccaggtcttgttacagagcctgaattccaagcatggctgagagttcctgagctccttttctccaccaggccacacttcataggcagggcagaggctctaccttaattgcagcaggctgagaacataagagtcccactctccttcaccccaatttgctcatgggtcagaggtccacaccaaaaaggcaaactaagaagaccagaggctcacacccccaaccaggcccagcagcccatccctaaagcagagggtcactcagaagcacaccattgcccctgccgtcagctctggagtcattgttcagagattttgccaaagaggagagacaggctataaaacagagctctgaagctttccccaaatagactgactttttaaaaactagccggtggggaagttgaagcctaaggatactctcaaaaacaacggaggtcttggtggtaagcaattaagaggaggctggtagcttcatgagaaagaaaagctacaccagaaccagctagtttcccagagaaaatctggaaaagagacagttaataacagcactcctgggggaagaacaaactccaaagactggcctcaaaaaccatccctgaaaagagatccacatttaattggatccaactgtggagcaatttatgccccaaagcattgtgaaaacagagagcaatcagccagctattagtggaatctaacaaatggatgtgataccaacagagaagacaactgagaaatcgggagaaataacagtcaaagagatccctgataaaactactgtccagcccaggatgactacatatatgaccaaggctctgctctctgccatcaaaaacttctcactgcagagaaagtagactttactaaaaaaggttcagccaagacattaaacaaataaacaagcaaacagcaactataagccttgaagttggaagaagtcaatatccagaattgctacaagacattgtaagatacaatgaatttctctgagtttctcttcaaaaatttagcttgctaactttcttgtcttttgttctcaaactcaactttcctgttcctccttgcccctagttactgtaaacagcctacccactgcccatcagctctaatcaataactcacacccgtttccttcgttacctgtaccccttattcccccaaaactgcacatctcacacactccacctctgtacctcacatccccctcccattctataattagaaaaatatgtaccagtagccaatcgggtcagttcagattgtgtggtccgaccccagcccatgggggagggacacagaagtagggattgcgttaaggatataaaaaccccccagtctcctttgctccctgtgctcttatgatcttgagtgacacaagtggcacccttctgcagaagcatattgccttgctgagagaattaaacttttgcctgagtatcggttttacttcacagcaccaagcatttattcctgcagcattttatatccaacattaactaaaaatttctagttttccaaaagaaattatgctatatgtgaagaaacaggaaagtgggacccatacacaggtggaaagggcaggcaacagaaactgcctatcaaaagattagatgtcacacataacagacaaagacctcaaaactgtcattacaaatatgctcaaagagcaaaaggaaggccaggcacggtggctcacacctgtaatcccagcactttgggaggccaaggtgggtgggtcctgaggtcaggagatggagatcatcctggctaacatggtgaaaccccgtctctactaaaaacacggaaaattagctgggcgtggtggcagacacctgtagtcccagctactcgggaggctgaggcaggagaatggcatgaatctgggaggcggagcttgcagtgagccaagatcacgccactgcactccagcctgggcgacagagcgagactccatctcaaaacaaacaaacaaacaaattatatctacagttatatatataattgtattgttgggcctataacatatagaaatataatatatttaacaataacaacacaaaggatgtaggtggaagtaaagatagattggtgtaaagaaatgacagtatcttgaacccacagaaacaaatgaaaagaaccagaactggtaaataagaaggtaaatataacaaactttataaatatatgcttgttctttcttctctcagtttctttgaaagactaataattatataaagtaacaattgtagcactgtattgttgggtttttatatcgagttgttggatattgttatatataacaataatgaccccaaaacaaggaagaggtaatagagctatataagctctataggagtatcatttttttttttgagatggaatctggctctattgcccaggctggagagaagtggcatgatcccggcttgctgcgaacttcacctcccaggttcaagcaattctcctgcctcagcctcccaagtaactgggattacagtgcacaccactgcgcccagctaatttttgtattttttgtagagatagggtttcaccaagttggccaggttggtctcaaacatctgacctcaggtgatccgcccaccttggcctccctaagtgctgagattacaggcgtgattcacagcgcttggctaggagtaatatttttatatgtaactggaattaagttagcataaatctgaagttgagtctgataagatatatatggtaatgtctaaagaaaccaatttaaaaactcaaaaaatagtgaaaaagttattaaaggaattaaaatatacacttaatgcaaaaagaaaaaaaaagacacttgtccaccttcgctaataccagtagacactggacaacccagacactaaaaaattgaataggaattaatgagaagatgcttctgcaaattttggtccaagatctcaataaactcaagggtattttttacattactaaggaaagtacacttttttaagggtttacccttaggaagagaacctactgcttatgcacttctttcttatccccaagcagataatataattatgtaaatttcttacaatgacaccattgactgatgagcaatggaaggagaattcttgaataaaagtaaataaaaatttgagatggtatggagtctatgggagctcattcacacaggattcagaacttctccctcttggttcacgttgcatgtctggaaacaagctgcccttttcagggaagagaaattaactccatacacttttgatcagttcaaaggcagattgggccgggcgcagtggctcacgcctgtaatcccaacactttgggaggctgaggtgggtggaacacctgaggtcgggagttcaagaccagcctgatcaacatggagaaaccctgtctctactaaaaatacaaaattagctgggtgtggtggtgcttgcctgtagtcccagctacttgggaggctgaggcaggagaatcacttgaacccaggaggctgaggttgcagtgagccaagactgtgcctagccgagattgcaccattgcactcaggcctaggcaacaagagcgaaacaccatctcaaaaaaaaaaaaaaaaaaagaaaaaaaaaggcagattgtgccctgaaactcttattgttttagagaaaaggaggcaagagattcccttttagaatgttgaatggccttgatgggcaccctaacctcagcagagctttgacagttggatggaaattaccacatttcttccagattagacacaaccaaaatcccttctcagagtcattggtaaggaatttgcttaataactgaacctgtggtctctgggctgcctgccaacggcaggacaaaataaagacaaggatgcagacacaggcaggcataagagaagatactgtgtccctgactttattgttctgccttttttttcttcatctcttcctattctcctttcttgtctatttatagcaaacaaaattatcccttaaatctgagtgcaacacacatgaatgcatggcttaagcagatattatgcaaatgattatagaataataaaatcagatgtccaaagcaaagtatttccattaccatcaacccatggcaaggttccctattctattcttaagcagcttcaaatctacttgtgatcttttatcacaatttcattttcataacaactttcctagtttatagaatgtttaccatctatatgtttcctatacagaagaaaacaaagtctcccactgtatctatttctatagcaagattttgtaggaaatgttgcctatcaaggaatatcctttcaattttcacccacatggaaaatcaaactgctcttcagacctactaaaactcgctttacaatttccagtctatttcaagcttcatttgaaaaagtgactttttttagagaccagaaaaaacctaattctgcttttctttttcttcttttttttggggggagggtacagagtctcactctgttgccccagctggagtgcaatggcccaatctaagctcactgcagcctctgcctcccaggttcaagagattctcctgcctcaaccacccaaatagctgggactacagggacgcaccgccatgcctggctaatttttgtatttttagtagagacggggtttcaccatgtgggtcaggctggtcttgagctcctgacctcaggtgatccacctgcctcagtctcttaaagtgctgggattacaggtgtgagcctctgcacccagccaaaaccaaagaaaacctgactctgattttctaataaaagtaccatgaataataaaatctgggcatattcaggaagcatttgaaagttttgactggagaaactattgatcaatcttcacatatcttcacattaccactcaattgtctctagttctctagtttcatcagttttttttatttccactgaaattcccactgtttcttatttttctgtggaagattaaatctacaaatggagataaacattgttatttatctagttggtgcttattgtactttctgtatctggggaaccatgtatctcaccaattctagtaaattctccaattgtcatttatttctttatatgtttcatatatttccttctctccattcactccttcaggaaatatgtgaaaccgactcagtttatccaccatatctctttttgttttgctgtgcataaaaacacaattctttatttgagtgagtatatttactaaactattttaacatagttcatgaattaacatagtttagaaatgatcgattgcaaattaaggaccttgctgaccatacttacttcttatgctttatcatttcctaatttttaagtaaactttactgtgctacaatgtacacaacaaaattcacaaattttaagaggaagtggataaattccgtcaaatatccatgtaaccaatgccccatttaaaacatagaatatctccttagatagtttcctgtgcacattttcagtcaatcaacaccccaccaccacaccctagtcaaccccgatctgatttctaagaacttcatcctataaacagaaacatacaggctttcctctttcgcctccagtttctcttactcacgataacgtgggggaacattcatccacgttgttgcacgagtcagtagtttgttcctttttatggccataaattggtattccattgtatgaatacaccacaatttgtttatccacatgcattctacgtattattccatacatataagcaatctaaattgttacattataaaattgcatatgttcaatataagatgatatacaaaaaaccttggtagcttctaagtggcttctcttgctcaagtcttcaatacatccttactgccaagatcaaccttcccttcacctgaaaatcttctattacgttttgctctcatcccctgcaggaagcaatccctcttgcttcccagtttttacttcacacgatacaccactttctattttgtgttatggttacttatatacatatctaatatcaactgctagacgctaagctgcttgaagtcaggatccaagtgaattttagctttgctgatccacagcacttagcaaacggctggcttgtgggaagggctcaatgcacggcagctgagtacgtaaaaaacaggtgaattcccgtattccaaagtagcttcagtggctccctgctttgtagtttgtcatgcaaactcttccacgaggagctccaacctagttttccaactgcagtctcgtgatttttcctacgtaacacttctccttcagttaaattcttctttgctaacttccatccttttatctgttatattattccagtctggtagaaaacacacacgcacacgcgcacacacccctatctttattttccccaactcctgaacgagagttacagtttcaagatttcttttaccagggctccccaccgccgcccccaccaccatccgccaccttggtcagcagggaccataaaataagcagttgcagatcgtgcccagtagggggaggagtgcccataagtcttccactaaatccgaggcctttctgaagcccaggagattttaaagaagccacgtgtttacgaaaacgtcttctaggttaaagaaataaacaagagttcagctaactccttcctctgattacaaactgagtaatctctgctcaccaaagcacggtaatttaagcccaaataacaaagacaaaaccatatgaccatttttaatctctaaggacctcactctatttgcatcctcatttttttttaatccataaaaatctattcacagattgaatgttaaatctgtgttgttgaatcaggaactagtaatggaaagctggacgtcttgccctccagatgcagagattagttcaaaagaaaaacatctgtactgcctacttctcttccatctccacccacttctcagcaccatttaggttttaaaaatgttttgtaatggtctaccaaatggcaatcattttttatgtactaagtttaagataccatgggatttgatttgactcaatgttaatcattgagtcatgctgatcacaaaccaaaagtgaacagtcatcatgaaacaaactgtgtcacaccacagggaacaaaatggtagccccgcccgttctcacacaggggcagatagatttcacagagaattagtaaagctcagggcttcgtaagcttaaaaattaatgacgctggaagagatcattcaatttcataaatgagaaaactaaaatcttgagagatcaaagtggctttctcaagagaccacagccagttagtgatgaagcagagactagagtccagtgtttggatctgttacgtcttggatgatcttcatctacaaacactattcattgcacttccttggcagtgtcagcaagagatgatatcttaaaaggatcgtttttgtgcccagttcctttagagatgtactaagaaggcaatgcaaacaccaggtcaacttgaagaaagcctctctaagcagccatccagacttgaagcttcgtacagccgccacattgacaccttttaaacaagtccttgtaagaagaatcttcaaggaagaaagcaaaatccatccacggtgaatattgcatgtgttagcacacatcctatacatctctcccgcaattatttattgggtggagtatgcaacaagagtgtgttattatattagtcagttacttgtcccttgaatctaaagataacacctacagctcccattgcattagagataggacggaaatgctaaaagccgtgttagaatgacagtgcttaataacaatgacacttgaggtttgtaacgcttttcatggtagatctcaaagcacttggcaagtggtcatgacatttcgacacagtattattctgaagaagcatcactgtgatttccttttgataagtcagagaaagaaagataattccctgttaaaatctatctagcgactgggatttttagccctaacatttttatttttaattatgcttaattttgtacattagctaaaaacttgttgggaatacatttaattctaattaaataaataaagtgatccgacttaggatctaaactcaaaagtcctgtgctcattccgaggcagcagtaacttttctggcttcctgacataaaattcatacaaacaaccctcgtagaacatcatctgatattccaggagtggaatgtgtgaggcaacctaacagggaatagagcaacttcaaaagaaaaaatacagaagctaagattctcttcccggaactatcactattaaaaattaatccaggaattcaggtttgggatgaggtaggaggatgggtgggagggaattagagaggaaggagaagcagacaaagactctttaaatatttatgattcttatttgaaatcagagaaagattccctacttgcaagacttgaagtgtcattataattaagtacttcagatattttatattatatttgatgggttttgacttcaaaggaacttaggggcaaagtctcagccaacacagagcattcactgcagcacccccgaagcagtcaaagtcatcacagaggcttcagcctagcctgtctcaaaaaagcacgatatcctaggaatgcaacaatttctcaactccaaagtggtcaatgagatgtaagtggaacttgttggatagggcctctggaaaagttcctaaaagagggctgactcagctatgaggtgagctcttttatggttccacccacgtcttcttcttcctgcctgaaatgtggacatgatggctggcgttccagcagccattttgtatcttgagatagaccttgagaaaaaaagccacactctgaggggggtagaagaaagacaaaaagaacctacacacctgatgaccaagttgatgtcatgcccacccagaattgcctaatttgggatttcttttacctaataggaggtctcttacttgagtttttcattatttattcactgatacagccaactcaataggttttaggactctactttctctaaaactgtctttgattcttgagcaagcatagtcagtactgttttccttgactttctaagacaggttcaccaagtcctgcacgttatgtaactctggaagacccttcttatatcgtgggccatgagacactctcacttagaagacagtgtgaatagggtcctccggatcctctggtcccagctcacccactttcacagaatttctgcttaccttcaaccttcttggagttacatcctcagggatacaagtaaaaatgttattttagattcaaatattggttaaacaatctttaatacaatctatggtattacaattttattaagggctaatttaaactagatttctcaaacttccaacccatggatcactttggcagataaatgaatgtcatgaaccatctgtaatgcttctttccacagcacaaaaaaaaagaagggaagaaagaaagaagctataaagaaaagaagggaaaagttaccacaaaagaatagaatagaatagaatatgtgctattgatcataaaacaagaattaatataggaaaattatttctcattgaaataaaagaataacattggtaataatgataaacaacatttttaacattggtaatgatacataacatttgttgtgacacagatttctctaggcggtcattgttccaagtccttttttcaagtcctctacatgtagtaactcagtagtggtctgtggcctgttacgaaccaggctgcacagcaggaggtgagcagtggtgagtgagcattactgcctgagctctgcctcctgtcagatcagcggtggcattagattctcataggagcatgaaccctattgtgaactgtgcaagtaaggaagctaggttgtgtgctccttatgagaatctaatgcctgacgatctaaggtgaaacagtttcatcccaaaaaccatctcccccaccccacctggcacctcggaaaaattatcttccacgaaactggtccctggtgcccaaaaggttggggaccactgtattaactcattcaatcctcataacaagcctctgaagtaggttgttgttattattattatgcttattggacagatgaagaaacagaggtacagaaagcttaagtgacttgccaaagtctcacgttggttagcagtggaatcaggatgtaaattcaggtctatctgaccccctcctcacccccaaacatataccattaactaccacaccatactgccccaatagttcataacaagcagcatcatactataaacactatgattagaagatctagactacagactccagaagggaaggacgatttgtattttgttcactgctctacgctgagtgcctaaaacactatttggcatgtaataggcactcaagtaattattcaatgaatgaagaaacgaatgagtgaatggatatagaaaactttacggtactcccaggcacaagggatctatgttgtaagaattgtttttggggttgcaatgagcagcagaccatccaaggagaaatacattcataataaagctttgtaggatgtgcgatcttcagatactaacatcattaacattcaaccatctgccagaaatcattatgataccttccaacaaaggcttataaagtgttttcattcgcactatctcatttaatcctcataaccaccctatgaggatttattttcactttgctattgagaaaacagtctttagcgactgccagaatccaggcttacatcctctcacccactcccgcactgtgggtgttcacactagagtgtcttgccagtcatggggttagatgcccctgaccactcacacttcactgccccatccccttcatggccgtgggcctgcattcacagctatccctggcctacaacccaacttctgatcttggtattccaggtatctactgtggagtgcaaacttaacagcttaaacaacaacttgttgttattatctcccatggttctggaggttggctgggctcagctaagtggttcttgcacaaagcctcccatgtggttgcagcctgatatcaggtcagctaagactgaagtcatctgaaggctcaactgagctggatgtcctataaggcccattcacatggcctgcaggctcatgaagggctgttaacctacgtgagcctctccctgtggcttaagcttctcacacagggtggttcactccagtggaacatcccaggagcggatgtttcaaagttcaggaagcagaagctgccaggccagtgaaggcgtggctcagaactgttacaatgatatttccactgcatcctatttatcaaagcaaccattggcccacccagattccagggtgtggagaaataaattccccctcctgatgggtgagtgggaaggtcatcttcctgaaaaggatgtgggatgggagatgttgttgcagccatctttggaaaatatgacctgccacactcagcttcgtaattaaactgcaacttataagctacccggttgcggataaatttccatttccacactgttattctgtgtttaattgggcacagaacaatgttcagtttatgtttttaactgttggcatggttacatttggggcccgaactgttattaactcatatcctttaataccttccaaggctattctaattcaaacaggtattttagctcattgataagagagttcatggggtccagggcatgggtgaagctgccactgttttatttacattcgcgacagttacttgtacttccagccagttccagcctctcaaagaggaccaggcaaaaatataaaaacagatcagttcaaattcatcacgataatgaaaacatttttttaagtccacagctacctctctttagcactcacgtgccaatcatgttagacttctcaccctagccttattctcttttctgtttttgttttgttttgttttgttttgttttgttttgttttgttttgtttgagacagagtctcgctctgtcaccaggctggagtgcaatggtgtgagctcggctcactgcaatctctgcctccagcgttcaagcaattctcccgcctcaggctcccgagtagctggggctacaggcatgcgccaccatgcccagctaatttttgtatttttagtagagacagggtttcacgttggccaggatggtctcaatctcttgaccttgtgatctgcccacttcagtctcccaaagtgctgggattacaggcgtgagccaccacaccaacctattcagttttcttgatgtccacatcctcccatcctaactggatttcactcccacatcctcttccattgaaatattacttatttcatggcaaactcaaattcctctggatcgcctttcctaatgaatgtccctgctaaatgagtgtgacttcactcttctttgagcccctgtaactcttgcctgccgcctgtcccaaatttcaccttttctacttggagtcacagtcctatttgggcttatctctcttacttccctccctgtgccttcgcatccactgcctgcataactcagcccaacacctccacacaacgagtgttccatgaatacgcatgaaagtggattgaacctccaggaataccattctcatcctactgtcatttcctctgatagcctgggctgataaagatctcactcaccctcagggaactgtcttcattcacattcatccactccttaactcaaccaaaatgtactggataaagtctgagtgttaagccaaaagaatgtttgaacataactcaattcaagttaaatgatctcacttctaccagcaaaataatcttatcaaaggaaataggcatcacatgtcacatgtttcctccaattctggctccttaaagaccaaaagagatgttccctggaggtgggcccatggctgtccacaaagaccagaatgtagcttctgcaggaggagccaggctttcccatcttctccccagcatgttttcagcagccagaccttgggctctcttttaaatgctgcttcttttgctcccattcacaaatgtggggacttttcttgctgacccttcctgattctgcttttgtaactgtaataggttcattgcctgatgtgcagggtaaatcaatacgccgagacactgggctacagcagagaaagaggtttaatcgtagggctgccaaaggaggagatgggaagagacctcaaatctgtctcccccaagcagtttggggctaggatttctaagggttttggagtgggctgaagtgtgaggatcattaattggttcaagagttgcgggggtgaagtcatgggaccgagagtggagaaactattctcatgctgattccattcctttgtgggggtcctcaaactgggtgatgtaagttgtttttgccagaattcaggatatggaaaacatcttaggcaattcttaaacaaacgccttatgagtctaacatcagaaatcctatctagaagaacagcagggatgcaggtgatcagtatctagcgctacatggctcagtgacaaggaagtgggccacagtgcggcctgactaatgcttaattacaaccctatttctgtccagaattcttgctaagcctatgaggacagtttcgattttgctctgtccacactaggctgggcaactcccccatgctcctcatggggctcctaacccattccaccctctgggttggtcttttccaccagtagaaaggaccccaagaggagttccagtcccttcatggacttgtcagtgagggttctccagaaaaacagaaccaataggacaagaatagacaaataagaggggattgactgcgggaattggctcgcataattatggaggtctagaagtcccacagcctgccatcctcaagctggagaaccaggagagccaggggtgggattcagggtgagtctgaaggcctgaaaaccaggaatccaaagtctgaaaaccagagaagatggaggtgccagctccagaaggacagaaaatacaaaaaagtagattaattatcctgtctgtgacattttgttccttcagggccctcagcagattgaataatgccatctgcattggtgaggatgatctgccttactctgttgactgattcgaatgctgatctcttccagaaacacctcagggacacacccatattcttttttttttttttttttttttttgagatggagtcttgctctgtcccttaggctggagtgcagtggcgccatctcggctcactacaagctctgcctcccaggttcatgccattctcctgcctcagcctcccaagtagctgggactacaggcgcccaacaccatgcccggctaattttttgtatctttagtagagacggggtttcaccatgttagccaggatggtctcgatctcctgacctcatgatccgcccgcctcggcctcccaaagtgctgggattacaggtgtgagccaccgcgccaggctgacacacccatattctatcagttttgtgggtatccctttacctggccaagctgacacataaaattttccatcacaatggaagatgagcagaaatgtcccatgcaaggtgggactagtatttaaatgtataaagcccagttatttagaagctttgtgcctccatttcctcaagtgcaaatggggataataatggcccctcttccatgggtccttgagagcaccccccgaaataattcactaacgcatcacaactgtgcctgatgcacagaacacagaccataaatgctatgccttcctgttgctaaaagtattattgtcggctgggcatggtggctcacgcctgtaatcccaacactttgggaagccaaggtgggtggatcacttgaggtcaggagtttgagaccagcctggccaacatggggaaaccccgtctctactaaaaatacagaaattaaccaggcatggaggcgggcacctataattccagctactcgggaggctgaggcaaaagaatcacttgaacctgggaggcggaggttgcagtgagccgagatcatgccattgcactccagcctgggcgacaagagtgaaactccatcacaaaaataaataaataaataaataataacagtattgttgtcttgggtcatgtttctcaaaggcagactctgagacaaggaaaggtgtgattttaggcaaagtcccaggaggggcagcttcaccctaatcccacagggtatctcaggagtgtggggctacctggaggaaagaatcccttagtactccctgctcttcattgacagacaaataagttcccagagtccaagggcagtcctccacgaagagtggcaggtgttgggggggaacctgggaggatctggggagccctgtggtgtgcatcacagttgttacctgctaaacctgtctgaggatttcattctctgactggcattttcactctatggtctccattctctgttctgcatcctagccccttataccatctacagcctgttcatccactcagcaattatttattgagtccaactatatgtccagcaccatgctaggacctgggaatatatccctgaacaaaaggcaaaaatgcatatgccctcatggaaatattcagtggtggcaaatttcaccagtttctaaaggagatctggcttttagaaatagccaaaagtcagagaagatgcaattaattccataatagcaattttcacccaaagtaagttgcaattatgaattgataagactgattttctcctagacctattaaaggagaaaattattgcctatttttcccaggcaataattttcagaagacttcttaaaaattacacattttttcattacatgggtaaataatcacactaccaaaacctgcaaaatggaagaaagtaaattaattacctataattctactggctttccaaagctactgttagcctttgggggtatcttcgtcccgtctaatctttgtgtctactttatatttttttctaaattagaaagcatttatgtatactcatgtatttctttccaacttcatgttttatcttagtcccacagtttttgcaaagaatattctaatgaccatagaatatgacattctttactcattctctattattagccctttggtttgttggcaaccttttcactattaattgttgaattgactaattcagaaaacaattccaaaaggggagtttcaattatgtatgaggcagtgaaaccataattggaatgagtacactgactcccaggaacccttttgaaggatgactctgatctggatatagcaggttttatcagattgattccaaaacaccaatagtctgcagtttcgtgttttccatgtttgaggagttctttctaagcttaccaggcgggctctaaaagaaggattcctggaatttgatttttatctccacccgagagcatcatcgaagcaatctcctaaatctcccctagagcattccacagcaacccttggaggcaaaggacataagggaggtgggagaggcgagtggtgtcttgtgatttgccaatgtcattcctgccatggcttcagctgacccctgaagggcccttgaggcacttttcccggaaggccccccaggtctagttgtcactggttttttggaaggctctccaaggcctccgacatctgttagacatgacccaagacaaagacagctgggaaaacccacaaggaaggaaatcccactgtgaaaggagctgcctccgagttcctttgaaagccatagttaactattgttccatcacaaaaactcaagttgaaagctgctgctgattccggggtcggtcgcttagcccgtggcagagttagcaggagggaagggacacagaagtgcctgtgtccccagaatggctgccagtggctgacggagcagctgaggcgctgctgccaagagccagggctccctccagagagggcctggtcctaggagaccacgcgacaggcacagacaatgggccattagctgtctgtggcttctctctgcctggtgttggcatttactgcacgtcccacactcatgggtctgaaactccctggaaactgtagtaaattgtagtgaaaactttccaacagccacctgcacacactcccagactggatgaataagcagagagtctgacttctttatcttccctcttgtaaggcctagaaaaagaggaacacattttaaaagtctgtgaactgttcaaaattgagcacacgctttctagctggacaccttatcattttctttgtcagatatttgacatcaacatgcagagcagtttggatgaagagagcaagcatttggtggagagaaatgggtatcacaggtatgttagaagagaaaaagaatctccaagctgccgtctacagctttccctgagcagtttctgcaacacatcaaaaaccttcacatgacaagaggaatggtccctggagtgggccgccaggacagagggtcacgcctgcatgttggcatcaaggatggtccagttagcactcgcaggattaaaactgggaatgacctctcgcttggtggcttcagcctaatgttttgtgttttcactctgggttgacggagagggtgattccttaaaaagcaccccctaaaaagagacaagggaaataatgttaaaacaaacactaacacacaaagcttttctataccaccatgggtagaattctgagactaacatatcttaacacctcctttaaggaaattggctaaagaaaccctcaaaggaccttgtgataagagagtctaatctgtaagctgaagaccaccctatggggaaggaggcacactaaagctggcttccttgtggccacagcaatgggctggtgtgtgctgtgaagggtttgggtcagagctgggcattcagaatatagcaaactgcaaaaccacaatgacatttagcatggaagagtctcagaaggtgccttgacatgcagctgatatctagaaatcacggtctggtgaaatcacagcaaatggctcctgctccagagcctcctaagtgctcttctttcctcccaccacaaccctcccagcactcgaagccaagatgggcagcttcaggggccaacctggcaccagcccgcctgtgggagcaccagacagttcacagagactgccacacctgagccctgtccctgtgcatatccccatccagggagggcccagacaacagtggaggttgggacgtgcccagtgcctgtggttgccagggcagtgttctgccaaggcatcctcaagaggtcacttgtgggaaatgcagccccaacagtttaccatgcggccattattatatatcaagatggagccaagaccccaaggtccttcaaatccattaagaatcctgggtgcagtggctcacacctgtaatcctaacactttgggagctcaatgtgggtggatcacttgaggccaggagttcaagaccagactggccaacgtggcaaaaccctgtctctactaaaaatacaaaaaaacctagctggacgtggtggtgcgcagctgtagtcccagctccttgggaggctgaggcagggggattgcttgaacccggaagtggaggttgcaatgagctaagattgcaccactaaactctagcctggacaaaagagtgagactccttctcaaaaaaaaaaaaaaaaatccatcgagaactggatcttccaatgaggggcttgttggaaaatttcccctcctgtattaggctgttttcaacaggcattaagtctcaaccgtgttggtgttctttgaccaaagaaggtatggaagaaataatgctcatacagaagtgccaagctcagtgttacatgttttatgctctatcttggaagtgaaaatttttcccatgtctgcaacaagattaccaagtgacagtgaccagtaacagctaaataggcctctatcacaatttgttaattgtagtttttttttcctgaaagttctgcatttctaccatatttcttcttttgacaataatcagacatattgtcatattgccaccaaaagtatttacttcagataggaaatactcagactatatcttcaatgagagaactgtgaagaaggtgaaaccatgccccggtacactgagacacgaagcttcctctctgtcctgagaaacattacctatatgcttttttatttttattttttagagatgtggtcttgctctgttgcctaggccagagtgtgcagtggtgtgatgaccatagctcatgtaacctacaactcctgaccttaaggggcttcccaagtagctaggactacaggcatgcaccaccacacccagttattattattattattattattattaaagagatgggttctcattatgttgcctaggcttgtcttgaactcctgacctcgtcatcccatctcagcctcccaaagcactgggattgcaggtgtgagccaccatgcacatcctttattacttttgacaaagacctgaattcaaatcagattattactctttaatatgccaacatctgttatatcattaaattatagtgttctgggtataatcattacctacagatctctggggggaaaaaggctgtcagttcaccaaagtccattagagtctctaaatgaaatagatgtaagctggccctagaccagtcacagacacaaggcaaaacaacactgagcagaaactctttccttgctctgaaactagcatgctgtgaaatagaacaggtttctattatctcacaagggtatagcttagtgcaggttcaatttacctaatttaagtgtcccattatgattgttgcaatacaactagtttcttcatttctatcttcatgtattacgattccagagagagtgacctttaacataggagtgaatggccccgtccatctgttcatcttttagtaacatgaaagatcttaagatatttgtcagctccaaggcagacttggaattgcctatcagaatcatcctgagtttggctgagatggccaggcctttatactctcaaatcaatctgtatatgggtaccccaggagtgggcatgaccttgggcagaatgaggtcattcctgaggagggtgacagctgaaggttatagtgctcctggcagctgcagcaacaaatctttcatgaagggaggcttggggatggtgcaacacagagtccaccacaaatatacagtcctgtgaagagataagcacaagtgcagacgacgttataatacattgtgatgggagcagggtagagttaaatacaggactctatccgcacatctacgaaacttattgtacacaatttaagggatgaggggagcttcaggagaaagtctcctgtaactcggttgtgaagggcatgggggctacagaggaaaacacatgcataaagggccagagtgtaaatagtttggtgtgatggaaagcgttgggggccgggcccagtggctcatgcctgtaatcccagcactttgggaggccaaggcaagcggatcacctgatgtcagcagttcgagcccagcctggccaacctggtgaaaccccatgtccactaaaaaatacaaaaattggctgagcacggtggctcacacctgtaatcccagcactttgggaggccgaggtgggtgatcacctgaggtcaggagttcaagaccagtctggccaacatagtgaaatcctgtctctgctaaaaataaaaaaattagccaggtgttgtggcaggcgtctgtattcccagctactcaggaggctgaggcaggagaatcgcttgaactcgggagggagaggttgcagtgagccaagactgcaccattgcactgcagcctgggcgacaagagcaagactccatctcaaaaaaaaaaaaaattaactgggcttggtggcatgctcctgtaatcccagctacttgggagactgaggcaggagaatcactcgaacccaggaggtggaggtttcagtgagctgagattgcaccactgcactccagcctgggtgatggagtgagattccatttccaaaaaaaaggaaaatgtggacctgatgttgtcggctacattgaagatcaagactatcagtaaggagttactgagggactctaatcgggataaaaaaaaaagcacctaggaaagatcacaatcataggagcatggtgaagaaattggagggctaactcgaagggaagagtaacacttttgagtgttgtagtaactcaggtgaaagtgacggtaatatgtggggatggaaagatttaaacagatcaaataaatatattcaagtggtaaaatcaagagaattacatgatggactggatgtaggaggtatagctgagggagggggtgggatggtggccagaagtctgggtggatgaccatggcattcattgaaatggaggttttggggggaaaggagtggggaaggatgacaaaaaaaaattcagttttggatacattgattcgagttttgtttcagttgtccactaagcagctaccatgtgtgtctgaaggtcaggagtgattcctgccttaaagatgcaggccgagggtcactagcatctatatggaaaaagaaatcctaggcatggatggaatctcctacaaatttcttttaacagtgagaagagatggtgtctagaattactagaactacaagaagcactgcgatgtaaggaatggttgtagggagaggagacaaacatctctgaagactagggaatgttaggaagaaaaccaaggtttagcgtcacaagccaagagaaaggaggttggtaaaccatactgaagtttgtgggggctccacaaatctttccggtttccctaattgcactctgatctgattatgagataaatacaggagtaggccattggagaactggccaccccttcattactgatgaaattgatcacgaagactatggtggaggtatgcggcagtaacgaactctccagttgtgaaacctggactccttccttgctgaggcacaggtagtgctggaaccctgcaaggcctcctcactggggggcctggaggaagagaagggcagaatgccagctccccacagcagctgctcccaagaggaaaagagggagaggcaagactgtacctgcccagttcctcctcccaaagccaccaatcgggtaattcaacccacatggaagaagagacactgggattagagaacaagcgtctctctcacctctcccatccacacaagaaaatcaaggactggagagtgtctgttagttgatgctgctggtagtaaactccctggagtggtagtgggagaagccagactgcagcaggctagagagagaatgggaggcgaggcatagagacaaccaggccatagagcgctcacaagaaatgctgttatgacaactactccaaggggttagagctaccgtctgcaaagtttaatttcatttcattagcatatgttagggtaatccaggcttgaggagctgaaataaggtactgattaacttcctagggaaagacacatgaaataaagccatgaaaatgtgttttgtgggacctggggccagtagactaacaaggaaacgacccggggtcagttcacagaatgttggaggagagttgagagacagcagtggggcctaagcatgtgagtttctactcaagatgattcattgcatcacactcaaaaaaaatggagaaggaggccgggcatggtggctcactcctataattccggcactttaggaggccgaagtgggtggatcacctgagattgggagttcgagaccagcctgactaacatggagaatccccatctctcctgaaaatacaaaattagctgggcatggtggtgcatgcctgtaatcccagctactcgggaggctgaggcaggagaatcgcttgaacccgggaggcagaggttgtggtgagccgagatcgtgccattgcactccagcctgggcaacagagtgaaactccatctcaaaaaaaaaaaagagacaaggaggacactgagcctttagaaagaatttaaaccaaacaaacaaacaagcaaaccaaaccccccactaaattaaagaaagaccatgtgctaatcaaaacactgtgctgacaaacagacccccaaatttcagtggcttaacaaaagtaaaagtctattttactcatgtcatgtctattgcaggatgggtagctgtgttccatcttgcagctccaagctagttcatctgggcttcaaggctgatgtggatggggaaggagaatagaggctcacacatgggtgtacatatcacaaggaacagaatatagtcacatggccccacctgactgcaaggaaatatgggaattgtagtctgtgggcctttgaagaggagaaaaatgggcactggtgagcaccagcagaacccatcactgtaggcattaaagaggtttagagccatgggaaccacacgatgtggctgtgcatccctgcaagccacattccttgaaaccatgtaaatcactaggtaagtaaatcaccttactgacatagaagctgcatttcatgtaagtaaggcgattcctcactgaccttgaagaagtttttttctttttattttttcttttttttttttaatttttttattttttttttgagacggagtctcactcttgtcgcccaggctggagcgcagtggtgctatctcagctcacggcaaactctgcctcccaggttcaagcaattctcctgcctcatcctcccaattagctgggatttcaggtgcccgctaccatgcctggctaatttttgtatttttagtagagacagggtttcaccatgttggccaggctggcctcaaactcctgacctcaggtgatccgcccgcctcgacctcccaaagtgctgggattacaggtgtgagccactgcgcccgacaaagaagttttttacgataggcacaaatgtttaaagagataaatactactgaaatggggattacgatccactgcagaaaatcattaacatagtccctagcacatagggctcaatgagtatctgttgatcaattgagctgatgcctgataaatcttgacctttcacagacagacagaaaacaacagatgcaactacagcagaaggctttttccctccaaaggctgtaatgctccggttttgctctctgggtcaggttttcccccatcctatatttttggctgctggttcggaggcaatcaccagagacaaagaaaagagatgcttagacaagcggactggttcagctggatgaagcgcaaccgctacaaagtcttggtttggtagatttgactttgctctttcctttctcttcggaggggaacgttaggaaaggcctgtggcttgcagagatgcactccccactggtgtggttcccatggctctaaactcctgtgcctgctcatgtgggaaacctatttaagacattctgttgcataattggaggaaaataattggaggaaaagtgtaagccatcttgagggaagcaatcactcgactaacattcctacttaaaaataaatgagaaaaaccagattttgcaatttcaacagacttttattgaacatttactaactctgcaaagtattatgccagatacagtaaagggcataaaaaataaatgggctagacccagttctcaaatagctagtgggaaagtcggtcacttaaaaatctgattagattataacggaaagtgattctgaatagagtaatgagaaaacttgcatggagttggggagggaggggtgctcatctcagaccatcaagaacaaaggccccatggtgggcacagcattggtggaagactgtgggactggggtgctccttggctgtccccacaggccctatatatgtaagtggatgaggtccccacctgcctgggtcagggcattcaagggatgtttctgcccagatcctacaccaggtgtgactcaaatccttacaactgtagggtccctggggacaacctcagccattctgcttgaagcaggcttcaaataaaggtcctcaagagattctgaggtacagggcattagccaggaggatctttcatgcccacactgaggagtatgaagatcattttattttattttattttattttattttatttattttttgagatggagtgttgctctgttgcccaggttgggcatgatcttggctcactgcaacctccgcctcctgggttcaagtgattctcctgcttcagcctcccaagtagctgggattacaggcacctgccaccatgcccggctaatttttgtattcttagtagagatgggtttcaccatgtttgtcaggctggttttgaactcctgacctcaagtgatcctcccatctcagcctcccaaagtgctgggattacaggcgtgagccatcacgcctagccatgatcattttaaagggcaagaaatgaatcaaaggtttttgagaagagtggcacaatccaacctgtcctttgggaagttccttgggcttgaggtcaaaggagggatggttagggtgcacctgcagcatggggaaggcccagaggaacagcccttccctgagagacagataccctctatcccacctccatgagagattctccccagatttccctagtctcaggcacctgtggagacaaatgacgtcacatggtcatgaatatcacctttcactggccggttaactcactgcaaccatgcagcattccaaattcttttaaaccggtgctctgcccaaaatactatttgcacatgttgtctaattgaaatctcagaataactgtatgaggtaggaaatgctgttatcctcatttctcagatgaggaagctgaggggaaagttcttgtatttacacagatacagtagctaagttggaatttgaatctgattgagattccagagccatactcttagttactatgctgcacagcctgtaaagattttgataaacatggaaagccctggatgcttgaaagacaaggtaagcccatggcataaagaaagatcaggataggaactgtgctgcaatctgtctttcccttcacaatttagtccacttggtgtgtctgtctatccatctgtctgtatatcatctaaccaccaacccatacatccacccatccatccatccctccatccaaacatccatccatccatccatccatccatccatccatccatctcaaccttcagaaaagaactcaaggcaaaaagataaacagagaagtaaaagccttaaaaatagtgataaaagaataaaaggcacataacaaagggaaatagattattgtaaaactgatgcaaaaaagcacatacttaattctgagcaccttgacttccaaggtataaaaagaaatatggtgaattacatagtttgcattcgctcataaaagcatggccatctgtcaggagagacaaacttttctactaccaaagcttaaaacagctaacacatgggtctttatttaataaaggaaaattaaataacatgaggccagcatcctcaaatgcagatgagtcccaataaaggcagagcacctaacgttaaatcttcattatttctgtaggactgaagagtagtataatctggacatgctctgtctaggggagtttctagagtcccagattgaggaggcccagcaatgtgtgacttttgcttccctgtggttcaatagtctcaccttcaccttaccattgacttctccttcattctgcctatctcaggaaagagaaccatcagggggtgccaattagattatgtcagagacagtagaagagacagaaatgcaagacaaccaggggcccaagaagatattaccaacgtggggactggaatggagggaagtgaatgagtgaaagaacatggctttagaatggtatcaaatgccagtcctaccaccagggaaaaatcacgacatatttcaagcaatagacactagttccttgccttgattctccaaggttgtgaagaactaggaagagctgagcagagaagagtcatgctaaaggacacagctggagcttccctctgcaggtgggaggtagtttcctgagtttcttctcagaaaagagtctttgtacttaagagcaggatggaagagagatggagtaatatctcccacacagaaagatgcaactgctggctattgtgtgaaggatattgtaacatgagagaggtcacgtgttcacagccaaagagaagtgttatccagatgcatttcacctgccaacagtgagcagatgttagagtcttttcctgaaccctgaaagttgacttgatcccctctttttggggactcctttttgtgagaagttgcaggtttccagctatcatccctgttttacctcttcttattcctgggtttgagaactggtattccagccattggatgacaatgtggatgcctgttttctccttctgtggggagagtcaattgctggcattcacttcttatggcatctccaccagtcattctttctttgcattgctaccatcattggcctacacaggcctttacaactagactagtgctccacagccttgctcatgtcatggcacacaaaggaaatgacatgatttattcagcccactgggcttatccaggctggaggcaaatggctgtggccactccatacctcccgacccctgccccaggctgcactggtaggtacaaggatccaattaagttgacctgcttgcagtccaactaggcacaccagttggaagctctgatctggaacacagaaatagctgcttcatttttttccccgtcatcggtctcttgcttcaatccacattgcgcacattggccaggctagttttccccaattcagcattttcattatgttgttttactgctcacctcacaagcagtggctccccaccacctattggagttttaaagttactgacctggcagtcaagacctcccccagtgttgcccctatttgtctttcccaggattgtcaggttcagacctgaactcgctgccttctccacatgtgcgcttctgcatttagcatggtgctctactgtcaggcctattctccattcttgcctacaatacttccagattgagatcattccatgtctcctctttgatgctgtccaataactcagcttctaagggtttttgttttaacctcttttccaaccttgtaggccactattctccaagtcccttccagtctctcaacattcagtgaaaagccaggcttaaatagtccaataaattcaggaaatgctgcagcatatattcccttcttgaggatgcaaaacgcatatctgcttaaaaggaatttatttcattcattttagccctgagttgttcaaacttatttcagcacagaactttagaacaataacagttattaacttcccgtggaattggtcctataaagcagactttggaaacacacagttggaaccttgcaggtgatatccagataggctctagtctcaaatttagttagctctttcaaatctccaggtagtaaaagctaattaaatccgatcatggaactagacaatccgaccttcctataaatagtctcttttcccgccacattcagtactgaaagagaaaagggacaatggtggtacccctcaccctgcatgaccttactgtcaactctgtgtttggaaccctggcagaagtttgctgggatgaatttgagtagccaattcaagtaataataatagcaagataatattcatcaatatcatgcactagaaagtgcagcacgttgtaaatccttagtttacatgagttttttcagtccccacaacagcactgtcaggtaaccactattttttatctccatgttacagataaggaaactgaggcacagagggatgaagtaactttcccaaggatgcatatctagagagtagcagagccagcattcagacactcaatcaccagagtcttgctcagaaccacaatgttatgttacctcttcaagaaaaccaaagtcctttgccataggttgtttgtttgtctgtttttgagacagagtctcactctgtcacccaggctggagtacagtggcatgatcttggctcattccagcctcaacctcccaggctcatgaaatccacccacctcaacctcctgagttgctaggactatagaagcacaccactacacctggctaattctttttggttttgtagagatgggatcttgctgtgttgcccaggctggtctcaaactcctgggctcaatggatgctctgactttggcctcccaaagtgctgggattgcaggcatgagccaccatacctggcccaaaggcatatatttgaagggtgtgtaaggtaaaatgacacagcgatagattgatctaatgcattttttttttctaattttgagacagcatctcgctctgttgtccaggctggaatggagtggcatgatcttggctcactgcaacctccacccccgggttcaagtgattctcctgcctcagccttccaggactacaggcgtgcgtcacgatgcccggctaatttttgtattttcagtagagacgaggtttcaccatgttgtccaggctggtcttgaactcctgacctcaggtaatctgcccacctcggtttcccaaagtgctgggattataggcatgagccaccgcgtccagcctaatgtattctttatgaaactctgcctaaatgtttactgatatctatgctcagaagtccacgttctctattccacacagatagcttatctccaagtttatttaaaagatcacattgtacttattctttgtactgtgagtcttggtctttggccaaaagcaatacaattctgacctaggagttcttcattcatcaccccagtgcaagaagggtttccccctctctgagtttttttgacatttattgtgtcttctactcatttgaatgtatattctgttttgtaatcataattgtctcgccaagtgactgggtcttatctttccaactatgtcttgtcacttatagctccgtgcacagtgtcatgctcagagaggtgttgagtgtctgttgactgatttattacccccaaatgctggagccatttcatgattgcactgggtgtcctcctttaacccactgtatctgctctctgccttcctccacctcgctgtgtcctcaggaggatgaccgctgtggacccattcacaggctcccttcctctctgactcccggtggtgccactagtgggagacgccagcagaagaagtgacagtgggaggagagagaggtcagtattcattcccctggtttcctctcttgcaagctctgtgttgtcaggacaaaaccactgcatcaagagacatccctagctgcttattagcctcacagtccacaatctccaggaacgcccatgcttcctcaggttttgttacaatcctctcctgccattctgcaacttcttcggcaccgggctgaagagtgaatgttaactgccagctgcacagcctgcataagactgcagagctcagtggatacaactggcacatatctctcctttaggaaagcacgtaaaagatcctttcaccctttctggctgttggaaggatagcaccctacattgcagctgaacaaggacagcatctaccaagggagatttttcagctgaccccgtgaggcctggcagttgaggatggagaggcttatggttgtttggctgttggtgtattattttggctactgggaggaatcccgtgtgagagcctgtactactgtggcagtctgtttctggccagtttgacctttttatcatgtatttttgggcctgagaatgttctgagattccctgacattctactgctttattttcaattagccagagctgtaatctatcaatctggacctttatagatatacgtttatacagtttttgtgaaatataatttatatgccgtataattcactcatttaaagtgtacagttcacattttggaatattcacagggttgtgcagctgtcaccacaatctattccttttttgagatagagtcttgttctgctgcccaggctggaatgcagtggcatgatctcggctcactgcaaactctgcctcccaggttcaagcgattctcctgcctcagcctcccaagtagctggaattacaggtgcccgccaccatgcctggctaatttttgtatttttagtagagacggagtttcaccatgttggccaggctggtttcaaactcctgacctcaagtgatccaccttccttggcctcccaaagtgctgggattacaggcgtgagccaccacaatctaatcttacaacgtttttatttcccataaaagaagctctgatttagtgtcactctcctttcctccctttgccagcttctggcaaccaccaatctactttctacctctatggatttccttattttagatacttcatataaacaaaatcatacatgatgtgaccttttgtatctggcttctttcacttagcacaatgtcttcatggttcattcatgttgtagatgtatcaattctttatcctttttatgattgaataacattccattatatgaatatacaaaattttctttatacaatcatcagcagaatgacatttgagttatttccatttttttggctattatgaataatgctaccaagaacatttgtggctggacacagtggctcacacctataatcccagcactttgggggctcgaggtgggcggatttctttgaacccagcagtttgagaccagcctacgtaacgtagtgaaactccatctccacaaaaaaaaaaaaaagtatacaaaaaattagctgtgtgtggtggtgcgtgcctgtagtcccaactactcaggagaggtgggaggagaaattgagcccaggagttcaaggctgccgtgagccatgattgtgccacttcactccagcctgggtgacagagtgagatcccacctcaaaaaaacaaaaacaaaaaaaaaacaaagaacatttgtgtacaaaggtttttgtatggacatatgtatgttttcatttctcttgaataaatacctatgagtggataagctaggtcatatgctaactctatgtttaacttttggagaacttccaaactgttttctaaagtggctgtactgttttacattcctgccagtaatgaatgagggtttcaggctctctacagccttgtcacttgctgttggttgtctttattttagccattccagtgggggtgaagtggtatctcatgctggcttggtttgcattgcccaggtggctagtaatgccgagtatcctttcatgtacttattggccatttatacacaagctttatgtctacatttccctattcaagactttaggagcctgacggatttcagaattctgaccctttcggaagttcatagacactcttcaatatatctgctgcaaaaatactatgattcaacctaaatgggataaagtgtatatgacctcaggtgatactgtcagtttttgacaccgaaagtgttacaaaaaaatgttggttttgagaacttttggattttaggaatataaggaagggactgagcacctgtacatgctcctgggttccagttaagactgtgctatgggcagccatccagatgtgccactgctgcccctccacgagccccataagcatggctttctctagcgtgacccctcagggaccctccccagggtccagcagggagcagagtacaaggacaggggcctaggcacctttcttccctgatctgactttgcatggtgcctcactcaagacctgagtggcattcttagcttagccccacagttgcctcaggctagctgaggtcaccttgcttgtccagagatagaagtgcagctagtggtgtttttgggagagggagagagtgggggtgcagggagggttgtgatgcatagagtgggggcaggtattaatccctgcaattactcctagatatgcccattgcactttaaagaatctttaattgtatttatagaaacacagaaaagtgaagaattcaagtgatgctgaaatttggcaaatcaacagtgtgcaaggcaatcagggctaggagcagggctattcaaacggttggtcatggtcacactcattgccccttttaagttgctcttgatccatgactcccccttcccggcttgccctcagctggcccatgggctatccttgagaagcaaaggtaatggctcactagctgtctccaccctgccaactgtgagctacatgaactctgtcccaggatgtgaggaggagttctctgccctctccccaactctgctctgaagccacagccatttgttcagtaagagtctgtggcctggaaccattccccggaactgatctcctttccagtgaggtgcttatagctatagaacccccagatgatctcagaaaaaaggaggtgattagaaggaggtaagcaaaggggatgggtactgatatagtttggctgtgtccccacccagatctcatcttgaattgcagttcccataattcctacctctgatgggaggaaactagtgggaggtaattgaatcaagggggtggtttcccccatgctattctcttgatagtaagttctcatgagatctgatgattttataaggtgcttcccccttctcttggctctcattcttctctctcctactgccttgtgaagaaggacatgtttgcttccccttctgccatgattgtaagtttcctgaggcctccccagccctgtggaactttgagtcaattaaacctctttcctttataaattacccagtctaagatatttcttcatagcagtgtgagactggactaatacccaggttagaacaagggcagtgccctgtctccctgctccccatgcccattcccgccaaccccacacttcccctgctgcccagttgctccactcctttcagtgttgagttcagtcttgaggtgctttcttacctgttgatgaagggaggcagggatggaggaggaggcagatgagagttatgtgatataactaatgactgcaagtgtgattttctttggggacttggctttcctgaaggtaggggccagacaggcaagattcacttctctagttccagttcacttgcccaggatcacatagctagttggtgtcagagctgggactgaaaaccgcttcttcttggggcttcttttccctccatgacaatatctacccttgtgtctctagaagaaggcatttaactgcactggttttgaaaacaaatccaatccactcactgggtttctttgttgctttttgcagccatgattttgccctgaggccagagtataaataaacagaaagcaaaaataggctggagaggaggtgctttctaggaagtgatttttgagctgtgcctgcattctcttctcttggtccctgagacctggcagggtggtggcaggaggagggaggtccgtggacaggtcccctcagcttgtgagggaagaagtcctctggggtgtggttgcagacccagttgggttggctgcggggtgatcagcaatgatggggccaattcccactgccttggtgttacctccgcagggggtatccctgctctcccagccctgggcaggggtcccatcacttggtgtggtggttcttgagcatcttaccgagacttctcccctgggagatgacagtagctggtttctagagaaggccccatcgccatcttttacaaaactttttacaaacttctgctttatccccaaacattctaatgagtccacataatctactttgaacctaaaatcacttagaatctttccatacaacaacgtacatctgcaaccacattcttttgaaaaggcagagtccttacagagcacttgctgagattcctgtacctcaccaaccagatccactgttcatcccccacacccaaactccccaagctacagtggcatcccctatattctccaaatagcagcaacacacgctcctgctcagggcctttgcatttgctgtttcacctcccttaagtcctcttcccctagatgtacacttttttttttttttgagacagagtcttgctctgttgcccaggctggactacagtggcatgatctcggcccactgcaacctccacttcccaggtttaagcaattctcctgcctcagcctcccaagtagctgggattacaaacacgtcccaccgcacccggctaatttttgtatttttagtagagatggagtttcaccatgttagccaggctggtctcggactcctgacctctggtgatccacctgcctcggcctcccaaagtgctgggattacaggcatgagccaccatgcttggcacagatgtacaccctcattgtcttatctctttccgatctttgctcaaatgttgcatcaaatgttgcactgcttcgtcgctcagacttcaccccttttcctgtcttattcttctccattgcactgtcatttggccacgatgcattttacttatttgcttattgtctgtcatacccatcccaccctatgacaaagtaagttctacgagggcaagaatgttggctggttttgttcactagtgcttaaaagagcatcttccatatagtagggactcagaacatgtttacagcatgaataaatcaaggcttctagaacagtctaaaactggacatagagtctttagatggtttcctgtatgcaatgggagcccttcagtaagtaatcagtgaacctcaaatataaaaaccctcattactgttgcaaatgcactagggaagaccttgctcaggttctacactagacagaagcagtaagaccagctctaggcacaagcaaagtcagtgctttttttttttttgagatggggtctcactctgtcaccctagctgaagtgcaatggttcaatcagagctcactgcagccttgaactcctggcctcaagctatcctcttgccctctcaaagtgttgagattataggcatgagccactgtgccccaccagtactttttttatcggtgccttccatcactcttttctttcttttatccctcattactttggaccaattctcggctaatctactaatcttctctatgaggtattaagtgataaaggcttaaggtgttagcattcccaggagtatttatcctttaaagagaaatctggaagaccaaaagttggccaggatcagaatgaatgaatctcaccaggtagaatttcagattctgcagatttcaggctagaggctcaatttggaattctttgaattactggccaagaacagcaagtcagctgtttttaagcaacatgcctggaaaatgggtcaattggaagccaaggcagtaaatacagatattgtcacttctcctatacatctctcatttatatactagtaataataaaaccttcctcgcaacttccaaatttcagctcacttcaaagccaaatctacctttatctttttttcccctgaattgctgggttttcctgctaccagatcaagatcttcatcaattccaacccaacatcttcggaagcaaaagcatgtgtacacacacacacacgcacatacacgtgtgcacacacacacacctcaaatgctcccaaattccatcccctggttctttcctaggcacattcctcctaattccctcttctacctctcaccctgtcctctgcttgatttgtatattcagagctattccaatgagtggaaaaaccactggtgggaagagcccaaaagactctttaccaatccaccctgatgaccagctgacaattctcgaggccccatgcctgtgaatagggcttcagaggttcaccagaggcgatgaaatttgagctgaattttgaaggttgtgcaggatcaacagcagctgtcacgaaaccctgtttagatcccccctccacatgctcagatagcagaagggaaaaacctgtatgcagcctctttctcttactgcaatctgcgtgagcctgcaagcaagtcccacactcagacacaaatcttctatatggtgttcttggaactgactctcccagagacagaattggtcagtatctgagtcccaaccctagagagctcattttgcccaaatccacaccattccccagacatggcgattcccaacacccttagccatcattaccactcagccacattccctttcaggccaactcccatccccagaacttgcctccacccaagaattctccaacacgagtcaggcttttccagttgtcacttcccaggcaccaccactaaggtattgccaatctttctgtggctgcatttcatccagtctgtccctctctcctaagcagttttgactttttcaaattctcgacctttctccaccattttggcagcagagaggagctctgtattcactatccacacggtagggttataatgggatggatgcaaagagaaaaaaataagttggcacttggtttctgaattttaagagacactttggaatccatggtagaaggaataattggggggaaaacattgttgaatattaggagctgagtttccactggaacacaaactttatgtcaaaaaaaccaacagatttggaagaaagcatgacaaaactggagtgagattttctttctggagatgacataaatattcttcaatatgggggaaaggagatggatagtgtcaaaccctgatgagcctctgagaaaagagcttgtacccagataggcttgtgggattggagagcagagatcttagtctagttttctttctttctttttttcctttttgagacggagtctcgctctgttgcccaggctggagagcagtggcgagatcttggctcactgcaagctccgcctcccaggttcatgccattctcctgcctcagcctcccgagcagctgggactaccgacgcccaccaccaggcccggctaattttttgtattttttagtagagacgaggtttcaccgtgttagccaggaaggtctcaatctcctgacctcgtgatccgcccgcctccgccttccaaagtgctgggactgcaggcgtccgccaccacgcccgcccaattttttttttttttttttttgagacggagtcttgctctgtctccaggctggagtgcagtggtgcgatctaggctcactgcaacctccgcctcccgagttcaagcgattctcctgcctcagcctcccaagtagctgggattacaggcacgtgccactacacccagctaatttttgtatttttagtagagacaccatgttggccgggaggtctccatctcctgacctcgtgatctgcccgccttggcctcccaaagtgctgggattacaggcgtgagccaccacgcccggccctagtcttgttttctgagactggctgggaagggaaccttgctggtggttgtggggaggtctgagcactccagtgagcagctgattatttccctgggtggctgggaatagctcaggagtggcactgactgccagctgacctctggagttgccatggttgggagagaagtaacagcagaaggcaaggcctgagcaattcctgcaatccaggcaggatgccagggtggagggacacagctatacacccatgccagcataaatccatgacgatcaaggaccaggtacctctctgttgccacctggagcaaaagccttgagagcttggctacaatcttggggagaagatagggggagggaagaacatctaattgacaaagaaaaccccaagagattgagttttccctaaactaaaactaagctttctgccatagggccagtgggagctggagactcaaattaactgaggggaaaaaatcaaaggaatgttgtcagcacatgtgagctgatggcctgtgaattttggacctactgcattattttttgggatacactgcccatgcaattcttcagtaacttttaaaataaacttttattttaggatagattgacatttacagaaaatttgtgaagacagtacagagttctcatataccccacaccaagtttcttttattattagcatcttttactcatatggtacatttctcataattaaagaagcaatgttggtttatcactattgattaaagtccatatgtttttcagattttcttagtttttacctaatgttcttttgtggttccaggatcccatcaagaacactatattccatttagtcatcctgtctcctcaggctcctcttggctgtgacaattatacagactttccttcttttggatgacctgggcagtttgggggagtactggcctggtttgtttctagaatgtccctcagctgggattcatctactgttgttcacatgattggatcggagttatgggttttcgagaggaagaccacaaaggtaaaatgctggtctcatcacatcatatcaagggtacatagtatcaacacaccttcttgcttctgctgttcaccttgatcacctggctgaggtagtatttgtcacatttctccactgtaaacttactcttttgcccctcctttccattttgtattctttggaaggaagttactatgtgcaggccacggtttaggagagggctcctccatttcatggagggcacagtatccacataaattatttagaattgttcccaatgtatttacttaatcccattgatttacttaattttaaaaatactatattatatattacttaatcccacttatttgcttaatcatttattttcatcactatggactcatggataatttattttatacttttggttataatcacattctgctttattttcttgctcaaatcgtttcagctttggccactgggagcgctttcaattagctcctgtgtccctttgaggtacccccaccattgctgatgtcaattaaaaaaatttttttttcatggggggagcaaattacctaccttttggcacaaggtgctccaggcacaccttgaatatttcccgtcccagtcctagaatcagtcatttcctcaaggagctctggctccttttattggagaatggtactagaagcaagatcagagcgctaggtgtattcgttgctacagagtgttgtgtctaggcccactcagctgacaaagcaaagagatacaagtatgtgtacgaccctttatctacaaatctctgtacagacccattatatacattatgaatatataatatagatgtagaccccaaacatgagtccataacgatgtctccaactctaaccctgtaccacaaggatcactctagcctcttcctggctgtaacctccactccagcagtgaagatttgatggccaccatccaccatttacatttgtctatttccagtatactcgtgtggtggtttcatcacccagttgtttttcatctctcttgcttctgcctgtttcccccggcactggatcctttcactctcctcgtagccggggcataggcgttttgaactagaatattcgtccagcgctggtttgacacggatcttccgcaaaggaacatttcttttggcctccccagaccccgtcatcttccccattcattctggcggagtaaggactgagaaaccgtgaacccgaggttcagcagccgaaagtcccctgggagatggggatacaccgagaggaatcccattttacaggagagctttgtacccttaggagtaccgtggcctccgggactggagcagataacctgttttcgggccctctatgttcactcaacaactattaagaagccccctccccgagccagggccagcgctgagcccactagggaggcacccgccccggcccgcgtcaccccgccttgcgggctagacgacgaaacgcctcggcgctcaggggaccgcgcaccggtgcaggagccagcgccccggttgggggcgcaatgccgggcctgggaaggtccgccccggctggtcagagctttcctgcgccttccaaggcttggagctgccccggggaagcagaccgaaccaaaccgaacgttcctgcagcctccccgccagccctgcgggagcccatccgcccaacgcggccccgcccctcccccaggctccgcccaccgccgagcccaggctcggcccttgacgaagttcgccggaaattaccgaagcccctcttttttttccttcctctccgttccctgttctcccttttcctttcacccgggttccctcggccgtgatttccccctcccccctccttccttccccattgaaatcaagatggaggctcgcggcagccgccggcgcccgtgatcccggaggtctcgccggccacgggcccccgccctcgcgactgcgcgtccgggaggcgcgtgctgctgcccgcgctccggccggcgcccgggaggccgtggctccgcgcctccgcccctcggccagctcgcggctaccgggcggagtcctcgtctatgtgggcgcgctccttgggccgagccgccgccgccgccccccgccgccccggggctctgcgtccgcgcgccgggcgcgggcagctgggtgctcggcgccgccaggcccggcgcggagcgggcggcacgcggcgctaggggcgcggggcccgaggcgggcgcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccggtgagtgcaactgcggccggcccgcccagcggcgctgccccaagcgctcggccgacccgccgcggagctgccgagctccggccaccgcgcgctggtgcccgcccgtccgtccgtcggggcccgcaggctctcgcctgggaccactgcttccatgcgccggggctgcccgccccacatccgcgtgtcccgctgcccgcgcagccgggcgcgcggcagcttggcccgaatgccaccacctcgccctccctgcgcccgcccctcgttttagggcagaatcccccggtctgccgctcccggcagccgcggcttcgcgggttggggcgccggctctttgtctctttcgctggaggaccgaggaggcggcggcggagatggcgtgggcggaggctcttaccccggaggccgagcggactgagccggggccggtccgggacgggaaattggtctttgatctgtgcctgtctctggctgatttgtacctggaccctcctcgaccccattagcagccgggtttctttgcttggccctctagcctgtcatctccccggccttggtctacacttctgtgaaacggggcagtcacggcactcactgcccagggagtggggacggtggccgagctgaagctcggaggaccgggaggcgcggtgagccattgtctccggggacgacccgggagggtcagctgggaacgtggccccgggggggcggcgcggggctggggctcgcggggcactgtgtgggtggcgtggaggtggaggcggtgccaggtggccccgagtccaccccggcgcagagggggtggccgcgggagaggcgcgggtggcgaccggtccgcgggaggggcaccgggtttgctgcgcagggggcgtgacagggcgtccccggtaccccagcggcggcgcctcctcccgctccggcccagatcccgcgcgagccgggcccgcgtccccgcgtcccgcgtccccgcgcccagtccggtctgctcgcgcgtcggctgagcagcagcaggaggaggaggaggcggcggcggcggcggcggcctcggggccggcacccagagcgcagtccttagcgggccgggcacggggcagggaggatgcagactccgggttggagagcggaggagggcgggccaggtccgggcctggagaggcgggcgggggtgctggtggcggcctcggggaggacggccgggctggggacaccgacaggccgggggagcggccctgcgctgggggacgcgcgggaggtcggcggttcacgcttttccgtggcctctttgaaaatcacctccccagattcggtgagatcagttccccaatccgggtcacgaggagcaattgcagcgggagggcgatggtgagaggcagaagttagcagtgctggtagatacctggtttagtactgtcttctcttggttgtcttgatctttgctaggcggggttatttttgattcattttagcagattggttgtggctgggagtgacacagccgactgtccagtgttagcttggggttaatctactccccagtgctcactctccttgagaagtgcctgcagaaagcaaaggtttaggaaaacatgagctccttctaaagaaagctacccccccccacctttttttttttggtgcgactggccagatagagcagccccgtcttacctcttaatagcagaactgggacgtattcccttcatgccctgaagctaagtctagctttctctctacctacctgtcacagaataatagattctgtgcagaattcagctcctctctgttagaaaggctcttctgcgttggagatggattttttggtgtttgtgagaccaggcttttttacatctctattatgcatagtacaaaaatcacttctgctgctgctaagagccctccctaaaagacaccgaagatttgctgcctgttggcgtggctctctccaggagttgtcgtctgctcttggctttgcttaggcctgtgctgcccccgccgccagggctcctgttcatgttccgtttgggtcagaaccaggtaatgtctcactggcttgttcctttcttctgccctccaaaatgacaaacttaactttttagttgtttcacttagaatcaggagccagggcagaacttaagtaggtatcagatgcagcatcccattccagcgatagcctggaacgtctttttaaaagtgaaatctcctttgggcagctctgagtccctgacctagatcttggctctagcatctaggccaacgatgtctagcagggggcagagaggggtcattctgttggatgggtgggtgtgggggtggggtttgaacagtcagggctgaccgggcaaggaagctgaggagaatggagcagtcaaatccatcagaaatctggctttcttttctaagactcagaaacatgggaaaataggttctcattgactggggaggacagatcatggtgtgtttttgagcctggtactaaaagtgccaacctgacttagacaaaggctttccattgcttgcctttcctttctcagccctgaaactctgtttgcatggctgcctgattttctttcttttttttaaattcgttcttgttgcccgcattcggctttgtctttgtagccacagattgaaaactaataccagtggttggatgaaagaaagagaagactttaatagaacttttaaacaattaagggaagttcagaaatagagtgaacagtcctgtgatttctccattactggaagtgctcacataaaggtgctgtcacctggcagggtttggagttgggctcaggggacaggactgctgccctggagaggggtccgggagatgaccttggggctgttcccctttccctgtggactctggctttctctgagtcctcagtgcctaatcattgttctccgcttttctttgggtagttcagggctccagagccctggtgcccttctcctctgctgagcgtccacccagggttcacctcacccaaggtctcatttcctttgctgtcattccgttctctgctcaggaccttggcactccctgttcattttgatgatcattttgatcacctatttatagacctggcatgaagcaggcaggccaattagtgttcaagtggattgagttgtaataatgtgagtcaagtcctggtgcttgtgtgttaaagagcagtaagagattttctgcaggtgttagtgaatttcaaacttcacttttctcctttgcacagagctcagcacagtaaaaccaatttcaatgcaagagcaaaaagaaaaaaaaagacaccacaaaaatgagctagccttgttttaattttattttacagatgaggaatcagccttagggaggtttcatgacttgccccccagagtggaacttgggtagagttagagtcagggccctggtccctggtgctctttcctggtcgcttctcatagccaggacgttgcttacattagttctcaaccccactgggaccaatcatttttattgccaatctattttggggctctgttctcgtggcaataaatcattctttcagagctccctatttaaccttgtgagagcgtgtgtgtgtggtggaggtgcttacataaatgcagtatttttaacctgcctggcacgctttaggttggcgttaaatgaatatctggagaataaaggtttgtagttattctgaagcatcacgtcctgtcgtgcttggtttctttcattattaaatcttactcgactcctcctgcagcccctgtctttccagggaacaggtgaagaaaatcaagtctattagggagaagcacacatacttttatatattttgatatgacggtttccttgtggagtattgagagaagcttttcttcatatttataccttgaatgccacttaggtagttggcctggggcgggctgtgctacttctgttggtattgagaagcctggcagctttggtccttgtgagcaccaataatgattgtattacaaagtgggtccttgttaccctcaatatttcaaaaatagaaactgaaggaaatgtaatttgatagtgaatgttggtttctcctttttaggtggcacagtcagttttagaggaaagcaaggagatttctaaaattcctgtaagtgactttcgaggaatcaaagaagtgcagtaaagtcatcactgaaagaagcttttcattgagaccttgtaaaccgacatattgatgtgggatattgtattttttccctttgcaatttaactatttaagattcaaatgaaaatttaaagaagccatttccaccatttaaatgattaaccagatttaaatgaagccggtggtggtgttcaaaatgaagcatgtggtttacatatgtttcctaaatgtaccctaaaaatatgtaatttcagtggccttttttgaccttttaaatgttacgataaagttgagatttgttctgaactgcaggtgaaagatgtgtttgaagctgtcataatctaagtcagctgtattcaatatttactttgtttatttacttgactatcgagaaaataaaattttatctcataaccttggcagaattccagagaaaagtctaattcttaatcaatagccacactttactgcctagtaaactcactgatattgatagggatgagctgtgttttactacaaaaagcagtgataacaccctgcccccattcctcctcaattctataatgaattggcttttatttccttaagtgcattgtcttgacaaaattttaacagcgccactggcaggaaatagtagcgactccctggacagtgaagacttggatttgcgggagaatcccagtgtattctggtggaaagtgcgtgctctgacctcatcctcccatttcttccaagtactcagctgcgtagacttggccaaactgacaagggtgatggtgtggttggcctggtggatggagatgctgtcttttgaatcttctcagcctcattttaattaatgggctgcagggaccaggctgggtccccagctggagcaaggggtaagcgggttcgatgtgcatccacagggttctcttcgtcctattccagttctgctgacgcgctgttcagtgggccactgggagagggaatgaacagggagacttcccagtgacccttgcacttgggaattctggctgctgttactcagcgggagctgttctgggaattcctattgctgtgcctctgaactgaggggaagggagcatagaggagtggtcagaggcttgcggggccctgcatgtgctgctggcttcctgctggacccctggtctcctccccctgtgcccgcagaacaggacttcgctctcactgccaaggtgcccagctccctgctagttcgtaaatctcaaagagagatacctggctagattgtccagtgaggactcccagctttttgatgttactgagccttctgtgcagacagtcttgcttttggggaatcttgctctcatgtttaatggttaacaagtgcataaacactcattttcgcttctcattcactcatggaaacacttaatttgcttactgaatagttgtgttgttaccttaatttcctcttttctgtcccctctccacataaggaagccccttgaaacccaaattactaatcacctgccccccgggaaaggttgtatgtggggaaagagagagcaaaccagagtgaggctacgagcggggggcagagggcattgacctctgagatttctccctgtgccatttgatggcagaggggctgtggaaatgtaaaacctcgttttggtgatgaacatacttgagttttagattactggctcttttcattagccacatgtctactcttgtctgatgggggaggattgtagagtagtctagagctggtgttttggaggcatcttcctatttgggctttgtcatcaatgagtgcattttagcagttacactgacagagaaagctttcatgaaaacttactcaacacaaagactggattctaggtctagggtactttgactttgtggtgtccacgtgagttgatcaggcttgttttctcacagtctgtagccctgctatggacagggatgaattgcaggaggtttttcttggggagggatttcagtgagtggcagcagatttgtcctggccgctctgtggacccctttcctgaaaggagggggagctggtgctgctccattactggcttactgcagggaaggccaaggggccccttgctgtctgtctgttgttgttagcattgaaactgtgtaggtgtgaatagatcacaaactatagtacagccattccattaatgttgagtgagagaagacagtctcaaaatgctgcatgctgtatgagttcctttatatgacactggcaaaaagacagaaccgtagtgacagaaaacagatgggcattgattgccaggagttagggggtgggggagtatggctacaagggggcaggaggcaggtgaaggatggggaactgatttgtattctggttgtggcagttacatgtgttaaaattcacagacctttacacacatgcacacaacacacacacaccgtttaactgtatatgttattttaaaatgtgacattaaaaaaaggccaataataaactgggagaaaaactattacaaatcaaaggattatatatatgtaattagtaaagggctccctcaaatcaattaagacaagacatatctagaaagaaaataggcaaacaattaaaagaagtatgaatggccaaaaaatacatattcagcctcactcataatcgaggaaatgcagatagaaccaatgataccaacaaaagccaaagctcatataagtaattattctctaagtaaacttgaacaaaattgagttaatttggaaagattttatatcgatttgaaagatagtaatacttgtgttcatactttgctatgtaggacctagcttcttataattgcccgggggtgatctagggtaatggtaaagatagatagggggaaataaagattctttcctgggattctgtaatacgtgttaatttggaaatccatctggtgtataagtcaaatctgacttacaataatctttagctatagacagttaccatttttgctgcttcaaaatttcccactcccatgatttgtgctgctgtccagatcgaagatgacaagtggcccatgcaggatgatcttcagcgcctcacagttcctggtgcgaaagaagaagtttagtttcatctggagggcttcgttcctacatgagtaactataggaggtcatttgccctctgttcttaggcattcttgtatataattgacagctacctatttcacggtattgacaattaataaatggatttatgaagtgttagccccacctacttttaagactcataaccataaaactatgcatgaacttgagaaaaacacagttcaaatttacacgtataatcctaaaatatttttaaatggggtttgttggtgcctgttttttcattgtgtgtgtgtgtgtgtttgtgtgtgtgtgtgtgtgtgtgtatgtatgtatgtaggtatatctcttggaaagtcataaaatacccctctttggatttctgtggaataggtggtttcagtgcaagaatgaatgaatatatcggagactaatacttgaaatctattttcaaagaactcgtgtttcctagtatatatgaagtgacatgtataaatgacatgaatgctttcaggcaaaatgtttagattgtgatttgaaaatgatgtgcatatgagaagtcgttaagatgttggccaaaacagtgtgtgtataaattgatctccattgtttattcattttgctttgcttcctcttgcattgacccatccactttttcaagttcacaatgattcttttttgctgctgccattgaaggatgccactgatacctgtgagagggcactctttggcatttgcattctgaaagttttgcattttcttatttgtgtttactttttaagttcatccttgttctgcatgacagatatgccagggcctgcaggaatagcattaaaattctgttgttttttagataactttattagtttaagttttaaatgataaggaccgagagctacaattcctctgttttttattctgaagctgaaccacacaaatattgaaaaacaatgctttgactggagtgttatatatatttccacctaactagcttcacacaataaaatctctaaagtttaaattgcccaatattttgacatctaaataactggaataaatccctcattagtctaatagtaaacaaatagatttctcatttgtaggtggctttttaaaaaatttaagttcatgattatgagaaattcttcccagcgttcactgcccttttcagtaccagagtgatgaaagctggcatgcaagggaacattactagctcgaaaagcaaaacaaaacaaaacaaacccagatcgcatgggggcaggatgtatttcagtttttttgtttgtttgtttgtttgtttgttttgagatggagtctcgctctgtcacccaggctggagtgcaatggcgcaatcttggctcactgcaacctctgcctcccgggttcaagcagttctctgccttagcctcccaagtagctgggattacaggcgcccgccaccatgcccagctaatttttttgtatttctagtagagacggggtttcaccatcttggccaggctggtcttgaactcctgacctcgtgatccacccatcttgggctcccaaagtgctgggattacaggcgtgagccactgcgtccgtatttcacgctttttaagagtcacttcacctccatctaaattttgttgcacttaccctaatatgtcttgggtccaggagcctggagaacgggtgctaatttgatggtttcaggctgtaccttttactcacgtgccaattcagatcagtgcatcctgatgggttgcccataggagagcagctcttcatggcaggggcttcactgtagagtcatttagtgccagaatgttgttagtaggtaaattttgttagttggttggtatacatattacttttccaatatttaattgcagaatttgcaggattcattgttaggcctttctctcatacctcatgggtattgtttattagggccagcctcaactctgctggagtctgaattctcataaggttcagcctgtttgtaagacggaagctgtccactgaaccaaagagctggaagccttcgaaaggcatgcaagattgaggtggaatcacacagattttcggtgataacctgcagagtggacgatggaggctttggaaagtaggatggcagccttgcaacagcctgcccctggccatgcttgccacacccttgctatcctctaaatctttaacagcagctgccagggagcagcaagagaggccaggacccctgtcacgtgggatgagatagcacctttggaattgtgctccataggaaagtagaataagcacatctgcaaagtagtaacctgcttgcaatgtcataggatgagatttaagatactgtgtttatttctttttctcccaaagctgtaagtcccatcctgttctctaagaaaacctggtaaaatcttcctcttcactgttatctctgtattgccaccactggttttaccatccaagggcctgtactttgccaggcactgtgcagagtgttttatatacttttccttggatagaagcagctccccctccttcagcaggtggatgccattcctgggttgtggatgaggatgtctgcttctggtagggcaagcgacctgcttgccccatttgactctgtttgtgagggcctgaattggaatttaagcccagggctggcagattacaaagccccctccatgccccttccctctcatggaaggagagagtaggcatgacccctcctctatacagcatcccacagcctcctggattttcattttaaaatcctgagaattgaatttgtgtatactcgtgtgttaaggatcaaagctataatttacaagtctcacaccaaataaaacttgagtgaaagattccaggctatagcaagtatttttctcatgttggtttgggccctgtaatttagtttctgtgcctttcctcttctcacctaattaatactgatgttaccttttacgtaaataaccctagcagtcccagctttccggtggaggcatgttggctctgttgagttttacaggctcccccggctcacagtctggggagaaatcctgattgaaatcttggccctctgttttcttggctgtctggacttggactcaagtgttggataggaaatctctggctgttaatgtgggggttgggagtacgggaagggcggggagaggctggccagggagggaggtttcccagcccttgctgtgtgtgacacattagaacactaccagggcttcctttctaacttaggaaaggaacggggccggggagtgagaggggcaggagggcaccacggagctgcctttttggggttggttttataaaatggttgtggtcactcctggttttgctatatatagctgtttcgttgtagccactcatttttttgctgtttttcatcaaaatgtgcacgtagatgatatttagttgggggaagcagggtcatttccttcccactgtctcaggcacgtgtcctaggctgttctgtgtgtgggttgcgttctcatcagccatacctcatgtggtcccctcacagtcaatggcatgattttatgggatgcttgctcaggtttatgcccacataaaacttctgagctgttgttttcgagcatcatttccacactgggaatatgctctgtttttctgtgtgactccacgtttactttggagttttaatatttcagtcaggatgattgaaatgctggtctcttgaaggcagacactgtataatcagaaggtagattgtgctctaaacatttaccagtcacttcctcctagtttgccctaggagtttctaaaactttcaagcttttacatttttatgtaattctttccgtttgaagatttctaggattaaaaggattggcctttaagaccctgggttgcttttgacctgctattgtagtatatcttttattttaaactaataaaggtgatacaaagctcaggtccgaattaacttagttgaattgtgattttgctgtgtagtttttggtcatttagttggtccatgtattaattgtggattacatctaaagttatttcggggtgggggtaaacttactttgagaaggcagaactcatcatgctcaaagaagcaagaacagcttcagatccccagttgtaagtatttcaccacttctgctttgtcttcctctgcttctctttctggatatagctaatttacatgttatcttgtttctgaaccatttgagagtaggttacaaatatgatgatgtcccttacctctaaatggttcagtgcatattttctaagagtgaggacatgctcttacatagtgatcataatcaggaaattagttttgatatgatatcatgatctaaatcactaactttaacacctttttaccaattgtctcaggattgtcctttttggcagttaaaaaaattatggtccaggatctcactcaggaccatgttacatttagtttgtcgtatctcttcagtttccttgaatttggaacatctcctcagcctgtctcccttgttaccctgatagttttgacgattacatggtggttattttaaagactacctcccagtttgggttgcctgattctcatgactaaattcaggctgtgcatttttggcagaagggctgcatcctttttggagcatcgtgtctgggaacatgtgatatccactgtcccactgtggtgatgagcactttgatcacttggttcaggtgatgacttgcaggtctctccaccctatttgtccctttgtcattagttagcattttgtggggagataatttgaggctgttcctctcccttctttcatttgctagttgtagcatccattgatgatcttcacctgaatcagttattaatatgatggttgcgaaatgttgattttttttctaactttgtaattccttttgtatttagttgactttgtactataaggaagagctttccttatcttccacttatttatttatataagtatggcctcagaaattcctgttttatgcaatgagctatgatcttttgctgtcacttagtttgatgctgtaattatctaagatttggctagtgggagccccttcatcctggctcttttatcttttgtgacctgtctccatcatttttttggagcactttcttactttctggcacaataaactgttccaggtgcaccttgtgctttccttgccccagggctgggatcagccatttctccaaggagcccttggagaaatggttcattttagtagtgaatggtatttagaaacacgatctaggcactaagcgtgctcattgctacagagttgtccttgcttttagggcctctcagtagacagagctaagaagtgtatgcgtgtatgtgtgtgtatgtatgcatacacatagacattaattacacatatgcaaacgtgattgagatctctttctgcacctcttggtgataaaaaccatatgtttagactcagtgtgtccaattccaatacagtaccacagggtgcattttagtctttcctcttccgtatttgtaattcccttctctgacagtgaaaaacctggctccttttatcctccgtatctttacttattcactcaatcctagaatatgcagaaagtaatttgagaatgctaacccacaccacggtgataaatgaacctccacccccaagtttaaactgttcaaatcagcagttagtggtcagcttctgttcagctcagtgccttgtcagttagtcatccaaacaaaacagatgaagtaatgctctgcagttccccaggggcatgtttaagaaaagagctgccagactccatcaacagcttactttctggtgatgtcggagcacaaaattgaaaaatcaggagtcgccagagaagaaagggagattaatttcatacagtttataaaaaggacacctgttgtgggaaaaacagtttgtcatcttcatctcaatgtacaaattgccaaagagaagaaataaaaaggaaagtgttgagccagtgagaatgggtgtgtagaggaggatgggtcgagcggacctttctcagggatccagtacattctacaaggaggagaagaagctgagttcatgtgttggagtaagctgtgagtcatgacttgaaagactgttgcttactgcccttcattgactaaatatttcttcccagaaaccacctgcagtaaattcaaagcagctatgtttctgcctcagtgcgggatttctgggaactgagtttatgtgcagtcagtcccagaaatcatggaacggtgggtgagatcttaggatttcatttgctgttctgtatttttcttttctctctctctttctctctctctccccctccccgcctccctccctgtgtctccctctctctccctgtctccctctctctccctgtctccctctctctccctgtctccctctctctccctgtctccctctctctccctgtctccctctctctccctgtctccctctctctccctgtctctctctctctccctgtctctctctctctctccctgtctctctctttctctctttctttcgagacagggtcttgttcttgcccaggctggagtgcagtagtatgatctcggctcactgcagcctccatcttctgggctcaagtgatcctgcctcagtctcctaagtagctgagactttgagcatgtgccacgacacccagctaatttttgtatctttttttgtagagatggggtttcgccatgttgcccaggctggtcttgaactcctgggctcaagcgatccacctgcctcagtctcccaaaggcttgagattatacacaggagccactgcacccagcctgttctgtgtttttctacattaaatgatgacacggatattacgtcgctgacttggggagacagtctcagtttcatatattatgttctgtactgcccataaacatcctcatgcttgttagattgtgttctggaaaatttggcctctgtatttctagcaaccctttctatgatgacacattttagcaagaaaaaaaatcataatttgcttattaatattttaatggagaagggcttttgatattagaaaactgggaataggccgggcgctgtggctcacacctgtaatcccagcactttaggagcccgaagcatgcggatcacgaggtcaagagatcgagaccatcctggccaacgtggtgaaaccctgtctctactaaaaatatgaaaattagctgagcgtggtggtgcacgcctgtagtcccagctactggagaggctgaggcagaagaagcgcttgaacccgggaggcagagggtgcagtgaactgagatcacgccactgcactacagcctggcggcagagtgagactccgcctcaaaaaaaaaaaaaatctgggagtaaaaagtcatgactaggggtagtgagaatgactgctaataggtcaaacattctgaggaaagtttttgagctaatggagatgttttggaattagatagtgatgaggctggaaacggtgatttctgcctgtaatcccagcattttgggaggccaaggtgggagaatctcttgagcccagcagtttgagaccagcctgggcaacatagtgagattcagtatctaccaaaaatttaaaattcgctgggcttggtggcgtgcacctgtagtcccagctgttcaagaggctgaggtgggaggattgcttgagcctaggagtttgaggctgtagtgagccatgattgtgctactgcactctagcctgggcaacagagcgatgacacgctgtctcttaaataaataaataaaaataaagaacaaaaagtcatggctaaatgtgtgatacatttcagattttgaaatagcttcagttattgagtgtttactatgtataagccacttaattttcctaccccttacaaagtaggcagtgataacattatacctgaggaaatggaactcagagaggttttttaacttgccccagctcaggtggctatagggacaaggttaccacgcgcacagtgggttctgccgggggtggaatccgcctgtgctggtgtctcctactctgacgtgcgtctcttatggaggaatttgactcagttttttctactcccactccccctctccctttttttggtgttagaaaaagtgaaatcacctctatttgaaggaggggattgtggataagatttgaccaggtttcagttgtgatttgatggcatatttggaaattttgtggaaaaacctgggttaacttttcaggaaatcgcagtcaaaaaaaaaaaaaaagagagagagactttgcttccctgtagattgtttcagtcctggtggtgtcttttgagatagtgaagagcatagctgaaaaagtggaaactgatgatgctttagcttttattgttttttaaacattctgggaaagttgaagggagaggcaactttctgctatgcttctcctgaaagtgatattaacattaaaaatcggtgtcattgtttttctgctagtgtgagctttatattttttttctttttttttttttgagatggagtcttgctctgttgccaggctggagtgcagtggcacgacctcggctcactgcaacctccatctcctgagcgatactcctgcctcagcctcccgaatagctgggattacaggcatgcgccaccacacccagctcatttatttttgcatttttagtagagacagggttttaccatgtttgccaggatggtctccatctcttgacttcctgatctgcccgcctcggcctcccaaagtgctgggattacaggcgtgagccaccgcgtccggccgagctttatattcttgaatattggagtcacctctgctcaccagcatatagaccgagacatagagtatgttgttagactctaaaacagaaacggcattaatttgcataaaatcgcatatgctctgttgcaataattttcattgtgcctgttttagaattgagttgacacttcatacagagtattccaactcaattaaaaaagagacatcgcagaagaatttgtgtggctttgaaatttattttgggcacagtccctgaaagaaatgagcctctaaggacttttgttctttgtggtgttttgaaaccttctcgccagttatatacattaagaacacgtagagcaggttggggttggtctgctgggtagaatgcctgcaaagggaccagaggtctgtcagaacaagagtctcttagtgcagtgcctcccgccggggggtgaccttttcatgatgtttggactgtcatctttgtttcccagtttcaaatgcctagctcagaattatttagtgcttgaagtggttttcatcttcaaaggacgttatggacattatttaatatacatgacactgtgtaatgaatgagctgtttatcccttgagtaacgtcaacatgccaggtgccatacagctggagaagacaaaaataatactctgtccagtgggagctgatagtctaaagaggcaagatgattaggcagattctctcttttggcctcttttaaaaatgtgctggggaataatgtagaaattaaaattataaaagatgatcaactagctcaagtctacctaattgaaattgccctcaaggtggaaatgaaatttgagatgctcttaaaaagacatcatgtgttagctcccatttatcacacatttactggtacacgcctattttacttgtgttacaggtgaggaatttggtgaagaccagtgcagaattattctcagatctccttcccgactcgtccctttctcccactgaagctcctctttttgtttgcatggtctaggatggcactttgtaaccaaggccacatgtgatgcccaaacatacatttattattttttttgagatggagtcttgctctgtcgcccaggctggagtgcagcggtgtgattttgactcactctatcttctgcctcctgggttcaagcgattctcctgccttagtctccttgtaactgggattacaggcatgcgccaccacacccggctaatttttgtatttttgtagagatggggtttcaccatgttggccaggctggtcttgaactcctgacctccagtgatacaccttggcctcccaaagtgctgggattacaggtgtgagctaccatgcctggctcaaacacacatttcttagttgcagatcagtctgtcctttgtagctgggcagacctcctgggaaacttggacttcttgcccctgttggcctgtgtgtcttgtgctcttgtacctgtacctctttgtgtttgctgttccctcttcttcctggtttcccttcctaactcagctcaaacatcctttcctttggaaaactgcacttgaccatcctgtcccagcctcttgaggcccattggtgttggcatgacactttgtgagaactggattctggactggttcctttgggttataattgttccttcactcgtgagtttgagttgctgggacctctgaccccagcgccggcccagagcagtccccaggtagaagtgcagtagatggttgttgtgatttatgcctgtggttccttaactcagattttagcataattacctggaaagttttctttaaaaatacagaatccctagagattctgatttagtggttctagattaggcccctagaaatgtattttgaaaaaactctacttgtagtttgttttgagacagcgtctcaccctgtcacccaggctagagttcagtggtgtgattatggcttactgcagccttcaccttgtgggctcaggcgatccacccaccttagcctcctgagtagctgggattgcaggtgcataccactatgcctggctagttttttgtagaaatggggtcttgccatggaggccaggcaggtctcaacctcctggactccagccatctgcctgtcttggcctcctgaagtgctgggattccaggtgtgaaccgccatgcctggtctctactgggaatttagacgcacagctagggttaggaaccaccgagttatgccaaggcacagtattagttgtgggttatggaatcacggccaatttggagtaaggtgtaagtgcagtttgcagaatcattccattcacatatctggagagagtggagaaaatgaatgcagtccctttatgatgaggatgtgctccatgaaggagaagatcctggctcgtggaggagcttcctgctctgtgaacatactgaaggcacaattggcccttcaaactctcatttgaagtcactgtgttgccatagagatattgtgtagtgttgaaggagattagagaaatcatgtcgtaaattatcagaacagatggcttgtaatttaacactcttctagcccatattctttgtactgaccttgagaacattgaaggtatcagtttttactttgttcttttacctataaaaatggcagagttcatattgagtgagatctaaaatgggtattagatatgccacatacacagtgtggtatgtgaaagcattttaggagtggcttccttaactttgcttgtatattttcccctcagttccctggatatatagaataatgagcctgtcttccttattattttgatagcactggtcagggatcatttttatatcctggcttgatgataatcgtattcctttgcaagtgcagttctgtttgcaagtattatatgatcatgtagattcaggcagcataatcacttccaaggtgtttttatatgtcatcaaccacataaagggtattttctttttttttcttctcttttgagacagtgtctctctctcttgcccaggctggcatgcagtggcacgatcttggctcactgcagcctccacctcccaggttcaagtgattctcctgcctcagcctcctgagtagctgggagtacaggtgtgtaccaccatgcctggctaatttttattttttgtttgtttgtttttttgttttttaaattttactttaagttctgggatacatgtgcagaacgtgcaggtttgttacataggtatacacatgccgtggtggtttgttacacctatcaactcatcgtctaggttttaagccctgcatgcattaggtattagtccttatgccctccctccctttgccccccatccctggacaggccctggtccggtgtgtgatgttcccctccctgtgcccatatcttctcattgttcaactcttacttataagtgagaacatgtggtgtttggttttctgttcctgtgttagtttgccaagaatgatggcttcccacttcatccatgtccctgaaaaggaaatgaactcattcttttttatggctgcatagtattctatggtgtaaattttgtatttttagtagagacggggtttcaccatgttggccaggctggtctcgaaccacctgcctcagcttcttaaagtgctgggattataggtgtgagccaccaggcctggccaactaaagggtattttctaaaaggagacttctttgaaattttttctgtctctctattctagcctgggtctgatgtgtaagtcttaaaagattgtatccttcattaaggacaactattgcctcttgcagggagctgcatcctgattgggattctggcacattcacacatgcacattgttgtagatgaccagagtagatatgtacctaaaacatttcaaattaacaaaatcataatcctgtgagtgtaatttaaaaatctaataaagcttaccttatttttaaagtacttgtagttagacatatattaacacaactatttcatatggttttattctcacatgcttgaagtattcaggaatcttaaataggctcttcatacattttcatgagcctcatttcttatgtgtcatacagtaggaaattaagtaagttttccgatctccagataattcctgagttgctcttgtgtgaatgtgtgttttaactgaatccagacattcatagtagtgagcactttctttgactccttttttactagcctacactgcttatactaatgggggtttctgatgccactcagcagtgggacagagaggtcagttgtgagcctgaccctgttggatatagcaatttttacctcaggatgacacattcacgtgacttaaattctttgacacttctgtgtcaatgctagaaaattttttataaaagtgctaggtaattatatcagaaagcatctgaaaaacagtcttatcagaagggcttagagccattacaggagtgagggaaatagtgtggaaataagctataatttccttgatgagcatgtcatactacaagacaaggttggctcaacctcctggtaactgtcctgccccagaatgggctagctccagcttaaataaattggaatcagattacctgggtattgaattgcatggcttcaggagagggtgtttggttctgtaaagccacatgtcatggtagtgaggtgagactgatggtagtatttgttcaagaatccgattttcattgagggcacaaaggctctgttgtgccacgctcaggatcttgttttcctgagattgcttcaggcagatttaaacaatggcctctcaacgtactggatttaaagagtaagtagttctccatgatcttatttctcattagtagggaaatgtaaacttttacctttggtcaaaattttgctcctgtcacctgaccccctgatgtcattatgattgtcttttccttgcagtattgccttgtcagttactcttgccagagggatttcatcattggagtatctgcatgtctaagtccaattcagctctttacatataggccccatgccctaagtgttgctgtcattttgcctgtttagttactttacaaacactaatggcacgtaaggctcctgggaaccctgggtctggaacaggcacaggccacagaacagatggcccttgccaggtggtccttgggtgcacagtggctgtggagctgctgtctctcaacaaaggaaggaagggcactctcagggaaatcaaatggatcaaagccgtccccttacccgtgttgcccctttaagccttcccagtagctctacttttatttttattttatttcaacttttattttagatacaggggatatacgagcagatttgttatgtgagaatattgcttgatgctaaggtttggaatatggatcccgtcacccaggtagtgagcatagtacctgatgcgtagtttttaaaccgacaccctcaccctctggtagtccacagtgtctagtgttcctgtatttacgtccatgcatccttaatgttagctcccacttataagcgagaacatgcagtatttggttttctgttcctgtgttaattaagattatggcctccagttccatccgtgttcctgcaaaagacatgatttcattcttttttaatcaatgcgtagtattccatggtgtatatgtaccaccttttctttatccagtctaccattggcgggcacgtgggttgacttcatgtctttgctgttgtgaatagtgcagctgtatttttattttattcttcctgttgaccctctgtctgtctttctgaggctctgtgtctctgtggacccttcaaagggactttcctttgtttaggagagtgactcatcctgaggtcattctcaacctttccttgggaagggatgtagcccttcgcagacagagctgcatttgcccagaagtaagcattttcacaaaggcccctggatcccaggtgccctcctgcacagtgaactctaccggtggtgtcattcttagccttgtgggtctgggtttcccagcctccagaggtaggaacgccaaccatcctgggatggtaggtggccgctaggcccagatggactgcatccagacctgctgagtgaatgaatgcctttcttctgtaaatggactccttatcattctgttttagctcctctttttctcatttcttcctttctcctgcatttctcttgtttctcattcttctttgaccacttaagagtgacggtgtcactcatggccattgcccattgctaaactgtgctggaggcagttagagatgagtctgatttgtggggcaggaatttagggggatgctcccggtggagagtctgttggattctgcattagcacctcactacagacttcacctgggggtaagccgtgcctggggggcacccccttcttttctgccccaaggccctgggtctgagcctgtcttcttctgcatgtccccttcctgtctctcagtcgtcccgtcacttagtggggtctcttgacacttaattctcttactgcttgatcccaatcccctttaagcacagttttgtctgatttaaaatttgcattttatggtgatcttaatagatttggcttagcaaataagtgtgatgcttcttaatttcggggtaatttaatccctttttctaaattgtggtatattattccttaaaaattgttttggctcagttgccctggtgtcatgtgatttcttcttgacgttttcttttccgagctgcagttcatgttgaggttaactcctactcatccctctgccccgagtgctcagcacatagtcagtgcttagtaagtgttcaccaaaagcaagaacaagcgcttgctgcatccccaagtccagtggccagtttccctgtctcaggaggctggtgggacgtggtaactattgagccagcaaaactgggccagaggctgggccattttatggtgtaatgtcctctccagtagaaattcatgagaggggaaaaaggagaaagggagacggtagattcttacggatgaggtgtgcgtgtctgtggaatatgggcataggcagcagtggagaagggaggtctcagcaaaagcagctacccctgtttgttgggctgtgttcacttggcaagttgctgtggatctaactgctgttcactgttaataattagtcctcaagcgcccattcttgggcttatgtcttctgcacaattcctcagtctctagattgaccaggctccccgtggaccctaattaatattttctgaccgatcactgggtttgatcagtcaatggagggtgaagaagcatccattatcaggtttcctttgagatttaagatctagttgcctctggtgtttctattatgtgttaatgagttgatttctgtttcctaatgattaggctgtggaacagtaactctggggggaagatggcattggtaagatttgctaagttcttgggtatatttttacaggagtatgttccatgagcccgttaagaatgttccaggtcttgccctgtctccccatttccatacttcacttccatttttaggacttctccccagcgtcaaaactttatttacacgaacctgaaagcaggctgcagggctgtttgaaatcacacacgtcaatatgaggccaacccagtttttcataaataggtcagattgtttctataaagcaggattccaaaaacagtcttgttaaagaaaaagtattttaagaaaagatacccattgtttaaatcttaaccctattgcctagggcttgggataatactagtactagaaaatgctgatttctggggcctgccttggaagaactgagacttgccccagacatcatgaagagaaagcttgcaggccacatgtactaagatccggggataggtgtgagtcagaggctgggcaagggcctctaaggagctcttggtgcccttgaagaggagcatggttctgggtggatgcaccatgaagggctgttactggcagcattcactagtccccctgacccaccaccagtggaacaagtacccttgctttacctaaatactgaacattcatttcttacttagtagagattgacttaaatctcttttttttaaattgtgctttttaatctatatatcagaatcatctgataattgtgtgatactgaggaggtatttaagccatagcaaatcaggaagggaagaagctaagatggggtttacaagatagttcttcacatgtgtctgaaattagtactcttaagaatgttactaatttctggcaggatccctggaaaagtttctagaacaattggaagagaagccagaatagctgtgaaaaatggcggtgttcacaggtgtaaatactcacagcctcacactcaagtgtgtcatcctgaaatcagtgaaatgctctcactgatttcatggaccttatcatccgtgagaactggatatgccacgtgtttaattcatgactgagttttatgtgctgttcacacagcctaatgcaagacattcacttgaagaagtttaccctgaaatcccccaaatagggaggtcccacgtaggtgaactaaataggctctctacaagtacattactcatatttttaaaataggagattcccaagtggatctggctattggccaacagaatgagacttacacagcctgatataaatcggttcatttctccttgtactgtagttgattttcaggaggattgatgtgcaatttattgtttgtctgcagcagaatgacttgtatggctctgggtgctgttttctagtgctgtgtttgtggtgcatgtcttcttcctgtttcttctgattctgagttccgccctttttagctagcattcagttggtctggctttatttgacttctttgacttggtgagtgccatggtttgtgagttatactatcatttgtggtttaaacatttcagtttttgttactatatgtccatctatgtggccatcttctcattttaattaccaatacatgtttcagcttgctttttggaaaaagtgttgagatgcaaatgtgtctttggaagtgtcactgagaaacccaaggtctatctggcattccgctcctggcggcagaccgtagtctttgtccacgggttgggaagagagctgtgaaacagggaggccttgccgactgtcctacctgcaatctggactttgcacatggagcctctacttaggggattagttttttgactactgctgtttgatttttgctttttaattgggttatttgaggtgaatgcatggtttaggtttctcgttctttgtgttggacagaattaaagggaaatttgagacatcctggtctacttatgttcaactccgttatattcttttttaatgggcaataaaactgccttttttttttttttttacttttctcttttttagatggaaggttccccatttttatttttacatcacgttcttcctcatacagttttcttcaacagtaccaagagtcgtatttttaagaaagtgtctctaaattttctttgcttttgtaggactatgtcatttctgatgatcattaattggtatgcctaactctcccctttgacccaggtattactaatattgactgaaagatggaaaatttcaaagatggaaaatttggattactgctgtgtctttaccattgagtcccaggaaataacttgcccagtttcataaattcttagacgttggtttctcttgtgattgtcaagtctttggtgttctttactttattcacctggaccacttgagttgttattcatcgaacacacacgtgtgtgtgacatgaagtataacttgttcacccttactttgtgcagtggtggtaataaaattgttttaaacctcttaattatggtttttcatgttggattcactgtgagttcttaaaaaaaaggatcacccactgatggattcaaatctacctttggaaaattaaagtgataagcacttaatggcattttgggattagcttgagaatatctgtaagttgattgtacttgaaacatgcagttgtgttgtgaccatctgtagagtgatgtggtaattaggcaaagcattttagaaaggctttattactaaaaacaagtggtagctagttttcataggcaaaggagacagtcttttagaaaagtggtgttccaggtgatttaatggaaagccaatgaaattggggagagggagagggagagggaaaaggtgaaagaagttctgaagtcaggctgcttggcaggcaccgagggaattgactgatggagctcatctgtaatcctgggatgcgttttctgtgttttatccaaaccagcgatttttgttataacatgtttggaaagcctttttttcttttttggtaagtttcctactagacatataaaaaagacttataaagttctttgtgagagctttataatatagataatatctagcttttttctttcgtaattaaaaaattcaatggagagattatagtagtttgtatatactgtagttagaaaggtttggttttgtttaaaattgttgtacatttgcttttggtaatctttagttgcttgaaccctccacccttcagtttaacttttatttaaaacaatctttgattcttattcatgcattgaacattggctgagaacctgctatgtgctaaacagtcactaaaagtgaagcttctctctcttttttttttttttttttggagaagtcttgctttgtcgcctagcctggagtgcagtggtgcaatcttggctcactgcaacgtccacctcctgggttcaggtgattctcctgcctcagcctcccgagtagctgggattacaggcgtgctccaccatgcctggctaatttttgtactttagtcgagacggggtttcaccatgttggccagcgtggtctggaactcctgacttcagtgatcctctcgccttcgcttcccaaagtgctgggattacaggagtgaacctctgtgcctggctcgagatgtaatatattctcttgaaagataatattacatctagggaactatctttatcactttatttaactatttacattgaaaatactagaataaaatataagtacatatttgtttttaacttaatatacaatttcagtgttagatgaaatgaagatggaatattaacaatgtataagtaatgaaaaattactgaaacttgactctgttttagcattccaaatcttaaattatattccttgccctaaaataaaatatcatgaagatattttgggtgaacagttggaaattgttacaattctagagtattaaagataccaagaacattcagaggatccagccgaacctgacttgcccaagaaaataagtaaatcatttagtttgtcacttcagtttgcatgaccacaaagaactgtacacgcaatgagttattacattgttatagaagaaacaaaatattttataatagtttgccaaaaatatcatgccattatgagaaaaacctgttgactaagtcggcctttggtcacagtaaataatcactgcttttgaccaaaactgcaggaatgtaaatctacgtttttcagtgtttgaaagactttaaaattgcaccatataaggtaatgctggctaactaaactttataacatttgaatgtagaccataagctgatgagccggaggtcaaaattagatagctgtaaattatttgggctaatgaaggataaaggtagagtttagccaaacactgttcttatgtagtcttatcaccggtggaggtacagatggatatcacccacagaggtgtgggtaggttgcttcagaattaattttttaagaaactgttaagtaatagagtatctgaaactggactgtgtttaaggactacttagttgctgttgctgggtattattcagtcttaagcttcttcctggttataaaattaaaaagcaagaaagagacggcaggaaggagcggggtggggggatggtcggtggttagtagatatgtggacctagagtagccttttcagccagtttgggttgtgaaatactgctgagtgcttatgtggccaagttctgtagttatagaagattatgtatacacactcttttccattttgcaaaagtgagcaaagatatccttgtatgcaaggtgtcataatcccattcctcttatgttttgaaaagaattacatacacctgcagataagttgagtagtgcattgagcatctgaatacccttcccttcaattcactgttaactttttgccaatctgttctctctctttctatcttttatattcattaggacactaataagcactgcagcattactaagctgtgagttacttttgcttgaagtcagtgtcagttaggttttagaaagattgtgcatatttttgttttaatttgtcttgagggcagattttgggcttaaaaatacctctgtaactgaatagccaagcagtacttgcccctgagaagcaggaagtgcagcagatttagtagaaatgcttgaacaaatctagcgtcttggttgaaattgactaaagttccaaaataactaaacagtgtcacagagagtagtgacaggcagactcatctcagaagcagtggctcctgtcttctgagtgacagtcactttcaagtggcagtcagagtgttgaccaggcacacagaataaagccccttctgttgaagaactggcttaatggagtgggacaggttaacaacagttgattaaaccaaaacacaactctaaccaggcagaaacacatttggtcacaataacaggggggatgatatcaaaccggagtgttgtggctatgcagtgaagtgcggaattagaggtggagccttcgtggcatcactgaggtggaaggctttttcaagaccattggattcagttaaacaaatgagttgtagaatggggataagctgagggataagtaatcccatcctttacggaacatattttttggaggtggaactggatacagcaaattacagcatacagaataacataggtgctatcttgaggcaggtgtcatatccttgagcctgctgagggatcagagtggactctggaagagctggcctttgagtggggctgtgaaagatcagcggtggagcgaatagtcactcaagcctgcaacttagggtatagggaggaatggggtggcccacccaccagcccctctgatggcttctaaacatttgcaagcagcaaaatcttttccaaaaatgcttgtttcaggggaagttgatcactaggcatgggtaatatgagaaatgtgacggttggggtggtcagacctcttcctctaggaggtccaggagtataagttactgaacagccatctcagatgctcacattgtatgttcctttttttttttttttttttttttttggcgggagggaggatttatttttttgagacagaaacacaggctggagtgcagtggcgagatctaggctaattacaaccttcacctcccaggttcaagcaattctcctgcctcagcctcccgagtagctgggactgcaggcatgcaccaccatgtccggctaagtttttctattttcagtagagacgggctttcaccatgttggtcaggctcgtctccaactcctgacctcaggtgatccgcccgcctcagcttcccaaagtgctgggattacaggtgtgagtcaccgcgcctggcctggtaatgttcttaagtgttctgtgagccgctaataaaaatcaccttgtcttcatttacagaagcaataagcccactgttttttgttttgttttttgtttttcctaggaggctacaggcaatcaggaataattagataaggattgggggcaccgttcatttcagtaagagcagaatcgaagagctctacgcttaggacagattaagagactgacttcacccacttaggctgataatgtaattttggttttctatgtttgcttattgctaattaaaagcagtaacagtgatagaagagcacagaggtttgctttgttttccacatgtaaattagaagcgtctgtctctgtgactgttactctcctgtagtagtttgtataaatgtagagccacatgctgtctgtatgtcttggctgttctcttgaaatacccagtagtgctgcccaaatggccagcagtgagcaccagcggctgcaagtccatttatgcaaggctgttgtaggaaagtaagacagagaaatatgtctgctgacatgtgaggtcactaaagtatagattctttgtgtactgtttagagagatccacttgatagagctgctgatttatggagaaatgagcgctagttgccttccacccgtgtggctgtaaccttctgttgctgtggttgttaacagtccccatgttgagcaggagcatgcagagtttgccctacgctttcagagcctcacttagttaaggcacttttggttgctggagcaaaaaaggaaatttattttcagaataaagaatcctctgagctaacccgagggaaggtggtataaccccacctcaccccaagaggaactgctgcgagtgggaacaggcaagccccagcaaagctgctccaagtttgtttctgtttcctgtttctccctaggggtcggctttatgcccgcctgcctctctatctacccagtcaacttcctctcaccttcctagttcaagacaggattgatgagcaaccctgaaaagtttcacatttctgatggtcacgtgatgggtcaggccatctggtcagcagtcgtcagggtcgtatacaacacacacaaggctgcgggcctgaacccttgccccaagaagattctgccacagagtttatggccccagttaagaagatgttctttgatcactttttgtgacattccctccataggtagaggtcagatcgccaaataaataatagtatctagagtcagggattttagtctacagtcgagacctatgaattttggtaggaaataaatgaattatatctttattttcgtggatctcaataaaattcagtatttctttcaattgtgaatgtagttctagcagtatctgtgacttttcacctgtggatactgcagatatttttaatcgacattaattattacagatctctcaaaatgttgttcatgctcatcacttcaaaactgtagaagttactagaatgactgctattttcatttaatgtgtggtaaagatgcacatattactttaaaatcttttgatgatcattactattttttttagatataattggttttctggttaagtttctctatgcacttaaaaacagtgttctgagaagagcttcataagtttcaccagattgccactagttagaaatatactactcccccaaaattgctggttggaattgagattacagttttctctttatggctgtcaggatttaaatttttctttttttcttaaagttttgggatacatgtgcagaatgtgcaggtttgttacatagcacatatacatgtgcaggattcaaatgctttctaaaaggcgttttctaattcctttccagttttttccactccttacttagaacttctttgtccctttcaacaattcctacttcctttaatgttttaatatctagtaatagattccattttttgtttgctttttgctgcgtaaattatacattctttggagctaaagattctagattattatagtattgaaagttagagatatgtctagatacaaaactagatctgggaacataaccccagatggggaagcaccatatattttgcaagcttgtgtttctcaatgttagaaatgatgagactcagaataaagcttacttatatctacctgggcattttaaataaaactagttttatttaaaactagtcacattgaaaattacacaaatatttgggaaactcccctgtacaataatgtagcctatttctaacatagaatactatacatgcatttagtgagagctccgcaaaatctgtgcgagtcatgaaaatagacgggatacctagactgctaatgtcctgggttggggagatacaccttatgaaagaaaagttcacaaagtgtcatgttacagtaaaagtatttcctttgcatcaatactgatttgtgaagaatatctgaaggttaatgcatttgagaataccaaatatcaaccataattcttatttaaaaatacattgtatgctaattccttagaaaagccaggcagggtggcatatgtctgtaattccagcactttgggaagctgaggtgggacgatcacttgagtcgaggaggagttcaaggccagcctgggcaacaaagtgagacccaccctgtctctgttaaaaacaaattcagttcattctttctttaaagacagagtcaggctgggcttggtggctcacacctgtaatcccagcactttgggaagctgaggcgggcggatcacgaggtcaggagatcgagatcatcctggctaacacggtgaaaccccgtctctactaaaaataaaaaaattagccggacatggtggcgggcgcctgtagtcccagctactcaggaggccgaggcaggagaatggcgtgaacccgggaggcggagcttacagtgagccgagatcgcgccaccgcaccccagcctgggtgacacagcgagactctgtctcaaaaaaaaaacaacagagtcttgctctgttgcctaggctggaggcacagtcactgctcactgcagcctcgattttctgggctcaggcagtcctcctacctcagcctcccgagtacctgggattgcagccgtgtgccaccacacctgactaatttttgtatttttttgtagcggtggagtttcaccaaccaagttgccttggccggtcttgaactcctacccacttggcctcccaaagtgctgggattagaggcgggagccaccatgcccagcctcagttcattcttttaaagatgattttaaaatttagaaacatgaacttttcaaaagtaacattttttgcttactgttaagtaaatggaaagagccaaaacatttaatttttcttaagtcacaggcacttgaaaatctggttttaacttttctttatggccattaaatattttatgcacatattacagggttgataatattataatagattcattttagaaatgaaacacttgaccattacatttagtttttataagaatattcttaggtaagcacaaacaacctgttttcaaacactgtgtgtccagctttacatactgtaattgggttccatggactctgccctgaggtttgagcgcccagggcactcatgggttgacagtggtgagcatacagttatgccccaggagggcaggtgatttattctggaattcacttgagtgttgaaaacagattattatttatgttatatacgtgagaaaactcttacaagccaccacttttaagttttgcttttagtggcttatatttcacaagtttaaagggcacttttaaattttttttggtaatcaccgggatatgagcagatgttatgaaaatcttcttatggggattttcaaacatagaggtctttttagtgacatgcacttctggcacttgtgtgaatttcatgataattcttggtatctgactgctctgaaacgcaccatcctaggtttgtaccatccttgctggagctcctgttctggaacctgggtgtcttcaaggatagcccaggattcttgtacttttaagcctgctacctgtggtttatgatcagataggaaatttaagaacaacaacaacaaaaaaagctaacagggtagagagagaatattgccgggctgactggcttccatccctcgctgggtcccagagcccaggaccccttggagaggaagaaccactcctcctgtctcctgcccagaggtctcccacttctcatcagtccctgggcttgggtgcctaggagtttcccttctgcctgtcttgagggctgagtatatggactgcaggaaggaggggctgctttgcatcttcatgctaatgcaagactttctctggaattttcacaggcccattattaaacagaaaagcaaaatcggtcctcaccataccgtggcttggctctgtttctaatgcactgcaagtattttatcaacattgtctacttttttgttttacttgattattttatatttattcaccatttaatttaatattacagatactgtttgtcatgtgtttggcttttgtgtttgcttttaacaaatactcttgtattcatggttttccttgtttgtggagtaattcattttgccacttcttttaaccattcttccctaaaaatagtctgctagggcagagattccattcggcctttattactttggatttgccaaacaagcagcagaaacagagttgtacgtgtggtcctacaccacaaggatttttaagagaggtcatttgtaggtgatggttgttgacacaggaatgctgtcaattaaaaaaggggagaaaatgaataatattcaaatttactggcatagagatgtttgcacagattccatgtgagagacgtaggctgttaatcttgtgttctggccgcatgttaggaaccctcttatggtgtggataaaaagccttgtgcctgcctggtattagaaaggtgacaggtgttgctgtcaaatattgatgctttgatatcttcacatttcttgataagctgaccgcgtaattgtctaaacagagatggtgttgagagtgaaagagggtgttaccaataattattctagaacagtaggggtaaactgagactgtgtctgtcaagctaggatgtgtgatgactcgacctactgactgaccatagtttcataattcagtatgtagagggtgagagtcatgtgaagatatttatgactcccactggtcattttttgtggctcacccctaacttggataaaatgatgtttgactcagtccaggatacataaaggcatggacagttggccaaggagagtggtcacaggggtgctgctgagtcagcacctcctgtcagtggtggtctgtttgaaaacagacctacagcacatttgaagaagcctcctccccatagcctggagtggctgaatcgctcattttgtgtgtgagctaagtgtgacttgagccatgaatcaggatttgtcagcccccaggacctggcttgcgtcctacccttctttaccaagagctcagaagggggtctttgtactccccccacccccgcagaagccgggactggagggtggtgagaaagcctttgtcaccgccttcccatttggagtgagggaagagttttggtcatagtcccctgctgctcccggccagcacgtcggtgtcccgtcctgccacccaccccgctttggccccaccccccacctttgtgggtctggtgtctcagaatggagagagaaatcctgtttagcagttaggtaccctgtgacttctttaccatgtgctagactcaaacatacggtgaagttagaggaattgttttgtatttgttcttaattactctgtaatactacattacaattttaaaaccattttaaaataaaaatgtattcttttcacttgttctgccctcagaattcttcagtaatataaatatttaaataaatcaacaaagcttttttttttttttcttaaaatctggattttttttagggtctcactctgttgcccaatttggagcagtggcacaatcacggctcactgcagccttgagctccgctgaagtgatcctcctgcctcagccaggcatgcatcacgaagcccagctcagtttttgattttttttttttcttttggtagcagtgcagtttcactgttttgcccaggctgatctcgaactcctgggctcaagccatcctcccagcgtgctggaattataggcatgagccaccacacccagcctcaatctggaattttacacatattttaagttcatttgatttttgaacatgtattggctaaattaatgattaactgtctgggcatggtggctcaggtgtgtaatcccggcactctgggaggctgaggtgggtggatcacctgaggttgggagtttgagaccagcctggccaacatgaccagtagaaacctcgtctctactaaaaaaatacaaaatcattagctgggcgtggtggcacgcgcctataatcccagccactcgggaggctgaggctggagaatcgcttgaacccaggaggcggaggttgcagtgagctgagatcgcaccactgcactccagcttgggtgacagagcaggactcctgctcaaaaaaaaaaaaaaaaaaaaaaaaaaaagattaactgtaatatagatgtggtaaagcctatgcgttatattccctagttttctggcacaacctcttaaagttacctggatcaaaagctggttacatgctgatattttcagtctgtggcctgaatttccaaaccgatcattagatgttgcctggagcttcctattctcattggattaaaaaagattattttgaaggtaatgggacaaaagaagataactgactttacaactttttataaaactatgctgagacttagtattgtttgaaatgaaagctgttagtattcttaaataaataaggattgtttgccttctaaagaatataacctaaattgttcctttgtaagaatcacatttttaacttaaataaaaaaggcagaccatgttgttagaagtgtctgatctttgcatatgaaaatataggccagacacaatggctcatgcctgtcatcccagcaagttgagaggccgaggtgggaagatcgcttgaggccaggaatttgagactagtctgggcaacatagcaagatcctatctctacaaaaaaataaaaagctgggtgtggtggcacgcagttgcagtcctagctactcaggaggctgaggcaggaggatctcttgagcccaggagtttgaagctgcaatgagctctgatttcatcactgtacttcagcctgggtgacagagtgagtggtcccatgtccccccagtgcccccacaaaaaaaaaaaagaaatataggtaggtaggcagttttaattttcttttgaaatttatgatttgagttggcttattttctgtatatactaaaatatttaattttgtctagggaaatccttcagaaaaaagttaaggtataaagaacatgcaagaaaattgtgttcataaacattcacatttagaattttccttgtttccattatatggattataaaaaaataacaatggaatactacaatgtatttttttttgtttcattcttctattagctgtatttcttaggctcttacctttttgtaggacatacagctaacactgcagacttaaaaaaaaaagacatcttatttaagggatatagaatttctacaaataccgtattattcttggatgccttaaagtgtattagagaaccatgaaaaggaaatgtcctttcagatactggcctgcttgaaattttgttagtacttctctgaagtttttggtgtttgttgaaactaaaattgttgtgggctgcttcacccgagcccagacaaatctgtagaactagttatctgtcaccgtcatctgttgtttcctgcctggggggtccctggcactgtctgttagaacttcacagccattctgtggcctgcccaatctcagaatctgtgatggcctttgtgccagattgcagatggtcgtgggcaggcctgtgagtggatgtggagcgtttctggggggcgtagtctgtgagatggcacgtgggaccactcacacaggacctgtgtctacggttgcccccaggcagctgcactgcagaaatcctttgagggccatttcagtgtcctgaaaacgctggctgccccctgcttgacttagagaccaatgtcaggggtctgtaaaggtggattagaggattgaggccaagttcagagtcttgaatggatggcaggagaaagaagagaaagtctgaagaccacatggtggccacgcccctcccggcctgggctcttttgcatccccacttgccctcactattccttttctggtagtttctacactccgggctgatgtgggtctgaaattctaggtctgacctcatagaactctccagaatattcagtcctctgtttttaatctccttctccccatccccatcctccctgacttgtatttaagaaattaatattttgaatatgaacaccacttcccacatatcattgaatttcatgttattacttttggttcttcctgttcaaatctttgaagggcattttttttttttcttttcatccaacacagtaatgacgtctctgagctgtgtggcctgaagatttgataaacgagacttctctgtgttattcctcaggagcaggctcctctgggaagtgggaaggaccccggctctgctgtgaggctcagggagagagagtgcacgtcctcctatttggtagaaccgcctattactccttgttggttccctcttagctgagaaagcatcttggttccctggatcttaatgttagtctttggctcactctttagagatgcttctaccttgggacaaatttatatctgatagaaattgttgtcagagtgtaggtggaatagcaaagttttagaaatgattgccttatcaaatacaatgcaagtttcttcttgtccatagacatagctaaaaatcttgtggtaatacatacatgattcaatgacagtatcaattctatgccttaattttgttgataattaaagtgttaaaaattagtgagaaatttacatgtaggagcttggtctgtaagaaaatgccattaattattacacttgctgtactttttctctgattaaatctcatgatttgcttttctttctaa

SEQ ID NO: 613 - DNA, 479554 bp, Homo sapiens
ctgccattgattttgatcttttagaagatgaggagagcaaaaagtttcagaaatgtctccatgaagacaagaacctggtccatgttgcccatgaccttatccagaaactctctcctgtgagtaccctagtatgtgccacagtatttggaatttcctaaaatttaactatcacaactagcatgatttggctgtcaaaactagcatgccaaatgtaacagggatattcatttacagcttgtaggtttccataacatttgactcttctgcgcaatgtctgtttatggaccctactcaggacagttgtcttaaccccatttcactgtgtgtctatgagagagaaatgatgttgaggactttatatgtacaaattaccactgtgttttgaatttatttttttcctgcatcactactataaaagctgtgttctgtggcatccatgccttgtatggaatcccacaaagattggagataattttatcattttatacatgaaacaaaaccagtttttagtgttctttttagaggtaataagtcaaaatatttagaaggaattgcaccttattttaccaaactgagttggataaaaggactccctgtcttgctttgtctgaaaatttatttatttatttatttattttttgatggaatcttcttcttgtcacccaggctgaagttcagtggttcgatctcgcctcatggcagcctccgcctcctgggttcaagcgattctcctgtctcagcctcctgagtaggtgggattacaggcatgtgccaccatgcccagctaatttttgtatttttagtagagacagggttttgccatgttggtcaagctggtctcgaacttctgacctcaagtgatctgcccacctcagcctcacaaagtgctgggattataggcatgagccactgcacccagcctgttttaaaatcttaaaaatcaggcttctagggccaggcgtggtgggcacctgtaatcccagctgctcaggaggctgaggcaggagaatggcttgaacccgggaggtggaggttgcactgagttgcggtcgcgccactgcactccagcctgggcgacagaggaagactccgtctcaaaaaaaaaaaaaaaaaaaggaattaatggggttttaaagagttcatggaatctccatacactttataaaaattaaaaatggatcaaagacctaaatatgatacctaaaactgtaaaactcttagaagaaaatacagatttaaaatttcatgactggatctggcagtggttttttagacatgacaccaaaaatgcaaaaaactaaagtaaaaaaaaatatagataaactggacttctccaaagttaaaaactgttaggctgaaaggacactgtcaagaaagtgagccggggatggtggctcatgcctataatcccagaactttgggaggccaaggcaggagaactgcttgagggcatgagttcaagaccagcctggacaacatagtgagaccctgtctctaccaaaagaaaaaaaaaagtgaaaagacagcttccagaatgagaaaatgttagcaaatcacatatctcataggcgtataatatccagaatctataaagaactactgtaacttaataaaggctaataattcaattttaaaataacgatgtagttgaatagacatttctccaaagaagatacacaaacggccaataagtgcatacgaaaagatgttcagcgtcattagtcattaggaaaatacaaatcaaaaccacaacaaggtgccatttcacacccgctggcatgactagaatcaagaagacaataataagtgttattaaggatgtggagaaattggaacctttgtgggaatgtaaagtgatgcagttgctttggaaaacagattggcagttcctcaaaaagttgaacagtgattctatgaaccagcaactgcactcataagtatatacctaagcgaatggaaagcatattcatgcagcaactgtacactcatgttcatagcaacgttattcataatagccaaaatagtggaaacaactcaaatgtctagttcatgaatggagaaacaaaatgtctgtccatgcaatgttaattggccattaaaaggaatgaagtgctcgtcccatacaacaacatggatgaaccttgaaaacattaagtaaaagaagccagacacaaaaggacatatattgtatgattccattcatataaaatgtccagaacaggcaaatccatagaacagaaagtagattattgcttgacagggctagaggaaattcttcccaaactatgctaaaaaatagagtaggagggagtacttccaactcattgtatgaggcccatattatcctgataacaaaaccaaacaaaagacatcagaagaaatgaaaatgactaaacacagtggttcaggcctgtaagcccaacgctttggaaggatgaggcacaagcatcacttgggccctggagttcaagactccactgagctgtgatcgtgctactgcactgcagtctcggtgacagagcaagaccctgtctgcctctaaaaaaaaaaaaggaaaactacaaaccagccaggatctcttaggaacatggacacaaaaatcctcaacaaagtacaaccagactgaatgcagtacccatgaggaagtcagagtcttctggggaatgaaaggttggtttaacatctgcatatcaggccaggtgcggtggctcacacctgtaatcctagcactttgggaagccaaggtgggcagatcacttgaggtcaggagttcgagatcagccggaccaacatggcaaaaccctgtctctactaaaaatacaaaaattagctgggcatggtagtgcatgcctgtaatcccagctacccaggaggctgaggcaggagaattgctggaacccgggaggcaggggctgcagtgagccaagatcgcaccactgcactacagcctggacgacagagcaagactccgtctcaaaaaaaaaaaaaaaagtctgcatatcaatataatgcatcatatcaataggataaaagacaaaaccacatgattttctcagtaggtgcagaaaaaacatgttagcaaaatgcaacactctttcatgattttttttaaaaaagccacactctacaaatgaaggaataatagcaaacaatagaaggtaactacctcaacacgataaagaccgtatatgaaaaactcacagttaacatatttaatggtgaaagactggattttttccactaagatcagcagcaagacaaggctgttttcccactccactcctgtccaacatggtgctggatgttctagaccgggcagttaagcaagaaaactaaaggaatccatattggaaaggaagaagtaaactgcctctgtttgcagatgtgatgatctagtctatagaagatcctaggttatcctctattagaactaacaagcttagcaaggttggagaatccgggatcaatatataaaaatagtatttttatacacttgcagtgaacaatactaaaatgaaatattaaaaattcttccacttggcatcaaaaatagtaaaatagctaggaataaatttaacgaaagaagtacagaaggctaggcgtggtggcccatgcctgttgtctcagcgctttgggaggccgaggtgggcggatcacctgaggtcgggaggtagagaccagcctggccaacatggtgaaaccccgtctctactaaaaatacaaaaattagctgagcatgatggcgggtgcctataatcccagctactcgggaggtggaggcaggagaatcacttgaacctgggagcagaggttgcagcgagccaggatccctccactgcactccagcctgggcaacaagagcgaaactccatctcaaaaaataaataaataagtggagaacttatgctttgaaaactacaaaacactgaaagaaatgaaagaagatctaaataaatggaaagacatgccatgttcctgaatcagaagacttaatattattaagatggaatactctgcaaattggtctacagattaagcatggtccctattaggatccagctgctgattttgtagaaattgacaaactgatttaaaattcatatggggccaggcaccatggcatgcacctgtagtcccatctacttgggaggctgaggcaggaggattgctggagggcttgagcccaggagttctgggctcccaggagcaggggaccaccaggttgcctaaagaggggtgaacaaacacagattggaaatggagcaggtcaaaactctcatgctgatcagtagtgggattgcgtctgaatagccactgcactctagcctgggcaacatagtgagaccctgtctctaaaaaaaaaaattaaaacttcatatgaaattacaagggacctagggtagccaagaccgtcttgaaaaagaacaaagtagggagactcaaatttttttttctttcaaagcttactacagagccacagtaactaaggcagcatggcaaaggattctcagatcagacactgaaggcaccagcaacagaagaaaactagataaattggacatgatgagactttgaaacggaagtgctgtaatggttgtcatcaagaaagtgaaaacagagccaggcacagtggcttgtacctgtaatcccaactacttgggaggctgaggtaggaggatcatttgatcccaggagttcgaggctgcaatcagctatgatcatgtcattgtacctcagcctgggcaacatagtgagaccctcggctctaaaaaagaaaaaaaaatgaggccgagcgcagtggctaactcctgtaatcccagcaatttgggtggccaaggcaggcggatcacctgaggtcggaagttcgagaccagcctggccaacatggtgaaaccccatctctaataaaaatacataattagctgggcgtggtggcgcatgcctgtagtcacagctactggggaggctgaggcaggagaattgcttgaacccgggaggcggaggttgcagtgagccgagatagcgccattgcactccagcctgggcaacaggtacgagactccgtcccaaaaaaaaaaaaaagaaagaaagaaagaaaagagaacccacagaatggaggaaattatttgtagatcatatttgacaaaaatctagtatccagaatatataaagaactattacaacttaataataaaaatgatatatttaggggaaatttaaacactaatattaagacattaatattttttaggtgagatagaagtattgcgattatgtttttgttttgtatgtacttttctgacttttgtgtgtgtttggaaatgtccatattagaaaagaatcaaatctaacagtatcaactcagcagtactatggcagggttaacaggcctatctaccgagccagtttaatgtatactggggaagtgacattacagattcactgcaaagagcttaggttttggaatcagactctgccacttaaatgcactggaaccctgcacaaatcccttaacttgtcaacatctgtttttgcacctgtgaaactgggatattacttccttgtgtcgctttgtgaagaataggtgagataatgtgtataaaatgtctggcacatagttgatgcactagaaatgttaataaccctggggcgggaggcggtgggggaacaggttttttttctttctttttttaaatagaaatggggtctccctgtgttgcccaggctggtgttgaactcctgggctcaagtgatcttcctgtttcagcttcccaaaaactgagattacaggcttgagctaccatgccaattttttgtttcttgtttttactaagtttcagggtagaaggaaatgaaggtcactgttttagatgaatgggaaaaggcccttagaagttgtgtgggagtttggcatttccttctgactactgagcctccctgtttatgttttcattcctttgtctttgcttataaaggccactggtggcaaatttagttctagggtcatctgctttaagagaaaaaaactttccagcctgggaaacaaagcgggaccccctatctctacacaaattttaaaattagcctagtgtggtggtacacgcctgtggtcccacctacacaggaggctgaggcaagaggatcacttgaggccagaagtttgagaacagcttgggcaacatagtgagaccctgtctgtacgaaaaatttaaaaagtagtcggcgtggtggtgtgcgcctgtagtcctagccacttgggagactgaggcaggaagattgcttgagcccagcaggtcaaggctgcaatgagccacgttcatgccactgtactccagcttggtgacagagccagactttctctcaaaaaaagagacaaacttccattttgaatcttgaggaaatcaatgcagttgcagaatcatatttccttcctatgttgatatgtaggatttagtagcttaaataggtctaaaagatacttaattaaaataagtgacctggatttttttccccccaggttttaaccttttctattctttttcttagaagcaagaaaatatgttccacacccatgattatgtgattgtatacccaggcctttttatcggtgtgtgtaataataaaactggtgttaaaatgtagtacgtatttgccagcgcggtggctcacgcctgcaatcccaacactttgggaggccgaggcgggcagatcacaaggtcagaagttcaagaccagcctagccaacatggtgaaacccatctctactaaaaacacaaaaaattagcctggcgtggtggcaggcacctgtaatcccagctactcgggaggctgaggcaggggaattgcttgaacccaggaggcggaggttgcagtgagctgagaccacgccactgcactccagcctgggtgacagatcgagactccatctcaaaaaaaaaatatatatatatatctatatatatatatagatatacgtatatctatatagatacgtatatctatatatatatttttgtactctgactcacagacacacactatcaatacattatatatattgtatatatatatacaaggcgtggtggcacgcacctgtagtcccagctactcgggaggatgaatcaggagaatcacctgaaccagagaggcagaggttgcagtgagccaaaatcacgccattgcactccaggctgggcaacagagcaagactctgtctcaagaaaaataaaaataaataaaaaataaaataaaataatgatgcagtgataacctcatatgtgtcatttcatttgtttgaaattgtatttgtaggatacatgtgactgctagatcatagggcaaatggatttgtgatttgggtagacaagaaaagagcaccatattttttataacaaatctaaaaaagtatctgaccttcaatagtagttgactttttttttttttttttttttttttttttgagatggagtttcgctcttgttgcccaggctggagtgcaatggtgcgatcttggctcactacaacctctgcctcccggattcaagcgattctcctgcctcagcctcccgagtagctggcactacaggcaccaccaccacgcccagctaatttttttatttttagtagagagatggggtttcaccatgttggccaggatggtctcgatctcttgacctcgtgatccacccgccttggcctcccaaagtgctgggattacaggcgtgagccagcacgcccggcccagactcgcttttataactgacacacttaggataacaaatctactcctgcaataatgacattaatcaattcatggaggcacggccctcgtgacttaatcacgtcttactaggtctcgcctcccaacacagttccgttggggttaagtttccaacacatgaacgttaggggaccagtccaaaccctagcaaatggcatttcacagacaggctagggatcagatattacatcacattacatagttactttcccatttcaaattcccttcgtcccaagagccactttgtcttttcagttgtaaagccagtttcccacctgaagttggtattatagttcctcattagtactcagggatatttacatgtattcaaaatgaatctgaaaagcagttatttaagtaagccgtatgttaagaagtaggaggtctggaaaagtggctgatacccataatcccaacactttgggaggctgaggtgggaggatcacttgagatcccaggaattcaagacctacctggacaacatagccagacctcacatctgcaaaacaagacattgggattctgtttagaactgattggtgtttgatgttttcaacagttgcaaaatgcaaatttttaatttaaaaaacgtattaaattgtttacgttaaccttttgtatactggatattcttcagaataaacctatgaactgctgaattatggcatgtagaagttaagcagtttttcctaaattcataaacagctgtacaaacacctaggattagaaaaggagatgctgaggctgggtgtggtagctcacacctgtaatcccagcactttgggaggctgaggtgagtggatcacaaggtcaggagttcaagaccagcctggccaagatggtgaaaccccgtctctactaaaaatacaaaaattagctgagcacagtggcaggcgcctgtaatcccagctacttgggaagctgaggcaggagaattgcttgaacctggcggggcggaggttgcagtgagccgagatcacgccactgcactccagcctgggtgacagaatgagactccgtctcaaaaaaaaaaaaaaaaaaaaaaagaaaaagaaaaggagatgccaaaccacaattagggctgtgtctcagtggcgtttccctacataaggcaagatgaacggaaagtgttgccttcttacctggcacctcatgagagggtagttgtcgctctgctttgtaccccagcttccctttaataccgacagtaaattcatatcccttggccaggtttattttcttcattctataaaaatgcctattttaggaagcttacgtatagtagcacttgctatctgctaagcattgtgctaagcacttggcatgtatcatctcatcttccttattacgttcgtatgagatagataatattttatccccgggatttttttttttttttttgagatggagtctcgctccgtcgcccaggctggagtgcagtgacgcgatctcggctcactgcaagctccgcctcctgggttcacaccattctcctgcctcagcctcccaagtagctgggactacaggcgcctgtcaccacgccctgctaattttttttatttttagtagagacggggtttcaccgtgttagccaggatggtctcgatctcctgacctcgtgatccgcccgcctcggtctcccaaagtgctgggattacaggcgtgagccactgcgcctggcctttatctctgttttgaattcaaaatattcttccaaaatttgttactgctgtaactaaaacaactgacctaccaaagcactttggactaattttcttttttcaaatccctcctcagcgtaccagtaatgttcgatccacatttttcaaggactgtttatatgaagtatttgatgacttggagtcaaagatggaagattctggaaaacagctacttcagtcagttctccacctgatggaaaatggagccctcgtattaactacaaattttgataatctcttggaactgtatgcagcagatcaggggaaacagcttgaatcccttgaccttactgatgagaaaaaggtaaaaagtaaagcattggtcccttcttcaggctagtggattttatcttcctcagaaaagctcttttctagttggtatattggtatttatgtagagctagaaaggaaaaattttttccctggttggagtttttgtttttcttttttctttctttttaaagatcaaatcaatatacagtaaaatgcatagaacttaaaagtgttcagttctatgactcttgacaatttcatccagttttaaagcaagattagaggaagtcacttgaactgtaagatctctttagcacttgacagtattcagtggtgtaatattgataatgctggttctattttaggatacctttttttatggcatctattggaaatgtatgaaaactactttatactgattggaagaacaacttccaggccaagcgatggctgaattgaggttaatgtttagtggaaacctcagcagactttgttttagcatagtctatactgtacctaccataattattgaattatagatgttgatctgtgtcagctaatgagatgagttcttaaagtctcattggtcctactctgtgatttttgtaatgttttttcctacactttgttttcctcaggaatctgcctttatgtccaatttagagcccaactaagtagagttgaatagacaagtgatttgcctgctggcattcagtactacagtattgcccctgccagagtggtagctgaaataccactcttgtggttttgctgaccttgatggcaggatttaaagggaattgaatttagagaaaagctgccccatgaagactagttttctctggtccaagtgtcttccgcctacgccctcatattctgtatggtcagctccttcttcatttataactctcaacctagggatcccctcctgagagaccttctctgaccatcctatttaaattggatacttattttttttatccagtctcttgtccgtttcctttgtagcacttagtattaacttgcagctttttttttttttttttgagagacagtttcgctcttgttgccctgggttcaagtgattctcctgcctcaccctcctgagtagctgggattacaggcatgtgccacaacgcccggctaattttgtatttttggtagagacggggtttctccatgttggtcaggctagtctcaaactcctgacctcaggtgatctgctaacctcagcctcccaaagtactgggattacaggcatgtgcctggccgttttgttttgttttgttttgttttgttttgagatggagttttgctcttgtcgcccaggctgaagtgcaatggcatgatctcagctcactgcaacctcctcctcctgggttcaagcgattctcctgcctcagcgtcccgaatagctgggattacaggcacccgccatcacgtctggctaatttttgtattttcagtagagacagggtttcaccatgttggccaggctggtctcgaactcctgacctcaggtgatctgcccaccttagcctcccaaagtgctgggattacaggcatgagccaccacacccagcacagtttttatcttggctgtttatctgttttctgactgtttaccccataggaatagtaacttcacttggataggtatcatgttagtctttcttaccctcataactcaaatacaaccctcatgtctcaaatatgacagttaggtgcttggtaaatatttttttgattaataaatgattgggctgggcacagcagctcaggcctgtaaccccagcactttgggaagctgaggcgggaggatcacttgagcctagttcaagaccaacctgggcatcatagcaagaccccatctctacaaaaagtttaaaaattagccgggcatggtggtgtttgcctgtggtcccagctacttgggaggctgaagcaggacgatcgattgagctgaggcagtcgaggctacagtgagttgtgatcacactgttgcactccagcctgggtgacagcataagatcatgtctctaaataaataggctgggcacagtggttcacgtctgtaatcccagcattttgggtggccgaggtgggtggatcacttgaggtcaggattttgagaccagcctgtccaacatggtgaaaccccgtctttactaagaatacaaaaactagctgggagtggtggtgcacgcctgtaatcccagttacttgggaggctgaggcaggagaatcatttgaacccaggaggcagaggtttcagtgagccaagattgcgccactgtgctccaatctgggcaacagaccaagactctgtctaaaaacaaacaaacaaatgattgaaattttaaaactagcagcttctatgctatttgtgataaaatttccaaagattatgaccaagtgtgttcatggatatcagaagcataaggaccttttaaaagctgaggatatctatcacatttgatgttttccttctcatttcatccttgggcctcaagatttgcattgtattttcagcccacattaggggcagtgttgcagtctaatggttaaagacattgactggtagtcagaatggggcctagtaacattcaaattctaaatctcggtgcctcttgactactttcctgattcatagcctatttctccaaaatgtgataagaataaatgtatgctgtctccagtccttgggaaaatggagccatggaatcaggtggctattgcattcgctgttgtctaaatgattgttcttcgctggcagccttttaggttcctcagaggtgactgaagtgatttttctatcacttatctattgctgtacaagtaatggccgtgaaactttgtggcttgtaacaacaaatatcttatctgcccatgataaagtatattaacaatttgaactgggctcagtgactcagccaggcattttttctgctgatttttgcaccctcttcacatacctgcagacatctgatggccgcaccagggctgagtgatataaggggaccatacttccctgcaagcaattggccaggccatatatgtcccagcaggctagcccaggcttcttcactttcttcgcatggcagctggattccaaaagtaacacaagagaagtaagacttcttgtgccaacacttttcaagcttctgcttgtgtgtgtttgctagtatcccattggctaaaagcaagccatgtggttagcctggagtcactccgaagaggggccacacaagggcctggatacagaggcttgatttcttggggcgatcactgaagcagttgtccatagctctcatgcatgccaccagtgcaaagggtccctgttgtttctgcaaattatgacaaattgtgatttttgatgcttactttcaaagagaaatcaccaaatttgttgccatcattcttgacagtcattcctgaagtggaaacttagaccacatcaggttttgcattcttgtcctatatcatgaagctagagagtttatgtcagaagtctagtcctcaaaacagcctcttgcccattgtgacctttaaacaggtgctcagccctgccaagctggttgggctatatgtgtgttgtgcaggtcctcgagtgggctcaggagaagcgtaagctgagcgtgttgcatattcacggagtctacaccaaccctagtggcattgtccttcatccggctggatatcagaacgtgctcaggaacactgaagtcatggtgagtggggctgatcttgctggtctcaggaactccttcctgggaaatctctctaaatatgccatagatcttaaaggggaacatcttcttttcattaagtgaaaacggaaggtcaggggctaggagcagtggctcatgcctataatcccaacactttgggaggccaaggggagaggatcacctgaggccaggagttcgagaccagcctgggcaacatagcgagactcttgtctttacaaaaataaaattagctaggcatcatggtgcatgctgtcccagctacttgggaggctgaggcaggaagattagttgagactaggaatataaggctgtagtgagctgtgtctagagccactgcactccagcttgggtgacagagcaaggccctatctctaaaaaaagaaagaaactggaaagtcagacgttcttcctgtgcttcttaacttatgggtgtgcatgctgtctaggaaatgtagaatttctcttaaggtgtcaaaccctatgatctttgtttgtacttaattgacaaccagcagatggcatgtcatcattggcatcatcttcacatacaaaggatacattagtaccctttatcatcatttggtttattaatagccctctctgtgtcagaaataattgaggcagcttcttaacaaaccaaccactactagagaatacattctaaagagactttgtataaatggcaatgggcttatattgaattaaccacatttattcacacttactctttgtgaaaagcttattgatcttttgggatgcacattttcgacttgttcagataaacatgttcaaaccagaagtattcgctgcccccagctctaagaatcttgtttgctgttttcaggactgggtcatatagattatagcatcttttaataatgaggcaaaagaccgagaaaatgtattgtctaaagcacaagggacttttttttctttttacccattctttcccaacatctgccataactgcatccatctctgacattgagtgatcccttaggcagtcatttctgtgtttttgtgtgtgtatatgtatacacacacacacacatactgatgttctaagtatcaaacgcctttccttgagcaaatccgatgatggaattatcttctctggtgattcacagttcagtttgtgagacaaaggcaaatatggtccagaaatggaaggattaagatatatgaagacctactctttgcacaatgacctctgggcacataaatctaaaaaagtacgcctgtaatcccaacactttgggaggctgaggcaggcagatcacatgaggtcaggagttccagaccagcctggccaacatggtgaaaccctgtctctactaaaaataggaaaattagctgggcgtgctggcaggtgcctgtaatgccagctacttgggagtctgaggcaggagaatcgcttgaacctgggaggcagaggaggttgcagtgagccaagaccatgccactgcactccagcctaggtggcagagcaagactctgtctcaaaaataaaataaaaataaaaaagtaaactactggccaagtgcagtggctcacgcctgtaatcccagcactttgggaggccaaggtgggtggatcactcgaggtcgggagtaccagaccagcctggccaacatggcaaaaccccgtctctactaaacattcaaaaattagctgggtgtggtggtgcacacttgtaatatactcgggaggctgaggcatgagagtcacttgaaccagggtggtggaggttgcagtaagccgaggtcacaccactacactctagcccaggtgaaagagtgagactccgtctcaaaaaatatataaagcataaaaaataaagaagtaaactactgcaccagtacactgacaccagctctatgaaacgctgattagagagcctacagaagaatggcaggtaaagataaaattttagaccaatcatcaagttacagcaataagcaagagatcacactccttgatgggacataccaacccacttaagtcttgcttaattggtcatcacagtctgctcaacgtagcatgaccttcttgtttcagacttgccttgagtgtgtcttcacaatgtcaatatgttgtatcttttccttccagagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcaggtaagatgcattttgaagctgaggggaatcagagaacaacagctcttcagccttttgtgtatttgtgatgtgatgggcaaaatagttgccaagatgaggaatgtaatgactgaccaaattgtaaaggaggccacagtcttcaggttagactaaagtgccacttggattatgggaagacagacaaaaaggaatacttgagcagttcaatatagacataggaagaatgaagaaaacagatgttcagcctcactagttatcaatgaaatgcagtttgaatttagattacaaaatagcgaagaaagatcacccaattttggctaaggctgtgagaaaataaatttattcatggagtatttgtggaaaggtaaagttagtacaacttttatgaccataaattagaagatgtaacaaaaattttcaaatctttgacctagaaatcccatcaaaacaatttatcctagaagtttctcataaggagataattggatgattgcacaatcacacaattgtacaaagatgcatgcgtgggaatgtaatttccattgaatgtagtggcaaaaaattggaaggatcctaaaattggtggagattctacagatatgccaatatttatttaattgatgaaatacaatgaaaccatagaagggaaagtgttttcattgccataaaaaaaaaagttagagacatatgagtaaaggaagaaaaagcaggttgtaaataccatggtcagctatattcatatagaattgtacattttttttttttttttggtgcgtgtagaaatgtatctggaatgtttactaaattaagtggctatctttagtaggatttaaagtgttgattttttggtttctgtattggcattttctatgatgattatgtattatatttacaaacagaaaacttacttttagaaatgctatttggaaacggataatggtgatattcaagtcagaggataggggtatcatacacttgatattttacctccacattctaacaataaagagcaaaatggtgattaaagattcagctgattagtggctgcaggcaaattcccagtaaccgcacaaaacacaaacatttttggtatcagctaaactgaagaatgctttttcaaaacctcacattgccaggctccagagtatggctagtgtgactcatccatctaattccaaaaaaacttggctgttgtgcacagaatatttcctgaaaacttatgtaagtattttcattgtcaacctgaatgcatcttaggagggcaaaagtacaggtaatttgtcctgtaatcccaacactgtgggaggcccaggtgggaggatcacttgaggccaggagttcaagatgagtgtgagcaacatagtgagaacctgtctctgcaaaaaattagccaggtgtggtggcacacacctgtagtccagctgcttgggaggttgaggcaggaggatcacttgagcccaggagttggagtctgcagtgagctatgattgcatcactgccctacagtctgagcaataaagcaagacgctgtttctaaaataaataacatacaggtaatttaataaacataaagcagttttcctaaatcaaatcatccccagatttcttaactgaatcagatggcttcaagtagaattctcctgtaatgaaaaattacacagcttcttccatggctatgctttgatggaaccagacttttaaaagccatcaccacatgaacaagtctcatttgtgaaaactatttactattctttgttggaaatgagtttttctggtgtcctgcagtgttctagactctcctgctgttgtttgcccacacttgagactttgagaaggcttttctgttgcacatgttgttttcattaacaagacatacatatccaagttctacatatttcttttgatctatatgctgaggaaagatgctaaagtttaaaacagcaaaatccgtctgcataactgtttctgttgcactaaatcttagcaaaaaataaatatgtctttagactgttgcattacataacaaagaagcagtaaggttccttagtgcactaagattgctctaaggaaccttaactgctattgtggaatggcacaaattcttttattagctgtgtaggcttcctaccagagtagctttccccgaagttacccatcattaaggtgttctgtatctttaaacaaaatcaaggattttcagtatggccagagtgctttatgggaatggtcagctgagtttgtcatgtgaaatgtagtagagcagtttcaggttaaaacatcatttcattttgaaacgagtcaaccttatctttcacccttgcataatgttttgagtctctgtagatatagactaatgagaggttacaggtcttttgctgttattttgttttttaacactgaacctttgctatgtgcctggcattgtgctgtatactcacttttgcatagtggaaattaattgtcttcaaaggattctatagtatgtagttacacatattttggaaaaatcaagcagtgggaaaaagaaaaataattcttataatccattaccatacaagcagtcgttgtggtactttttttttttttttttttgagatggagtctcgctctgacgccaggctggagtgcagtggcacaatctcggctcactgcaacccccgcctcctgggttcaagtgattctcctgcctcagcctcctgagtggctggaactataggcgcccaccaccatgcccggctaattttttgtatttttagtagagatggggtttcaccatgttggccaggatggtctcggtctcctgacctcatgatccacccgccctggcctcccaaagtgctgggattacaggcgtgagccaccatgcccgggcctatttattgatttgagatggagtttctctctgtcacccaggctagagtgcagtggcgcaatctcagctcactgcaagctctgcctcctgggttcacgccattctcctgcctcagtctcccgagtagctgggactaaaggcgcccgccaccacacccggctaattttttgtatttttagtagatacagcgtttcactgtgttagccaggatggtctcgatctcctgacctcgtgatccacccacctcagcctcccaaagtgctgggattacaggcgtgagccactgtgccagctttatttttattttattattattactatttttgatacagggtcttgctttttcacccaggctgcagtacaatggcacagtcatggctcaccacagccttgacctccccgggctcaggcgatcctcccacctcagcctcccgagtagctgagactaaaggcacataccacaatgcccagctaatttttgtattttttgtagagatggggtttcgccatgttgcccaggctgttctcagtctcctaagtgcaagcaatcctcccacctcagcttcccaaagttctgggattataggtgtgagccacagcacctggccttggcacatttctgatgaagttttccctgtgctttttttcatagttgtaaacaaaatatagtgatttttttttttttttggtcctttgaaaattcagtagtggattgtacattttcccacatccctatcttcataaccactattttaattgacttttatattccagtaggggtgttacagtttacctaattattcctgttaggcaacgtctgatattttttttgccagttttttgtaagtcatgttgtgaaaataacatctgtatctcttcagtttttccagtaatttccttgatgagttctcactgtaatcaggtcaaagatcaggaacatttcagtaatttataaatactgctaaattgttttctacgagggtaatatcaatttgtatatttgagtaccatgcctgtttatactgtaattgaccatatttctaatgactattttcttccatgtgttcagctttttactttttctgaactattatctatgccaagtgttatccagtagaatttcctgcagtcataaaaatactgtataatcttcactgtctagtatcatagttaggagccacatgtggctggtgcaccgttgaaatgtggccagtgtgactgaggaatggaatttttaatttgaaaccaagtagctgcatatggctagtgctaccgtattttattttgtgggagtattctgctgcttttcactcttctatttgaagttgctcactcacatgccatttgcccatccctggtgagattgaatttttaccgaaacttggccctctagactgtttagggacagcagacacatgttgcctgtatgtgaaatgtaaaatgtaaaatgtaaaatgttttgtctacaagcaatcgtagtgcactgtggaaactcactgcttccctgttaggtaatgcaagtctaaagactactccagtttatcctctctgcctccttatcttctcaatgattgtttcatttctaaatgcccattccttttcagtcgtaccatatgtcctcatctccctttagttttctttttgctattaatagttttagcttttcagtctaatgtctgatgctgatgtcctctatttagcagggatggtgagagaaggtcagctaaatggctcatctgcagcacacagtgaaataagaggtatactgtttcctattctactatttatcactctgtagcagaaagtctttctaggtccttggttaagaatatagagaatgttactttggacctcacattgccaaattttaaaaaacactgtagagaatgattttcctctcctacccattaaggattctatcttttcctatcaagtctattacaatctagtgcagtgatcagttaattttttgaaaaaagtactgctgggtgtggtggctcaggcctgtaatcccagcactttgggaggctgaggcaggaggattgcttgagcccaggagtttgagaccagcctgagcaacatagcaagatgctgtttctacaaaaaaaatttttttaaattgctaggtctggtgctgtgtgcctatagtcccggctactggctgaggtaggaggattgcttgagcccagtgagctgattgtgccactgcatttgagcctgggtgacaaagaccttgtctctaaaaagtaaataaaattttaaataaattacaagattcctagaatctcctgtcttgccttctgaagggttaggattgacttaagtatctgcagcttccaatgtataaacctgttttgtgaaacttcattttgttctcttttctttctccctacaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaaaagcttgttcatttacttgccaggaccctggctctacttttagagtcattgtaagaaactctaacttgcatcaaggtactaataagcttaattttaataacccaaagtttaaaggttccgatctttctccttggggtggagtgatctcattctcaggacaaccgtttacttacctgattcctcggagcattatcaacttctgctctgttgtcctgaccatacatatgtcctagaactacagttaagtgtgttgtggaattttagttttgaatcctgtataaaagaactccaagacctaaaaggcaatttatttatgaaatttattttcttatataaattacttatttctctgggcagacagccttcaccttattgcactaatagcacatctgtaatatcaagctacaggacaagtcttaacaagaggtttgtgttcttcaatgtagcacttgtctaccaggcactgtagaggggagtgatgaggaaaagccaggactgcttaggaggtgaaggatgggaggggagggggtcatcatacatccttctgacaattggtttcctcccaggaaggggaacatgcagagcttacttctggattctgggagtgggaagagttgggaggccaagaagcccaatgcaacgctgcagctgagctccttttatttctgagggaagcaaggactcatcttttgctcatttgtaacaaatcactccagcctagctgatgctttggggtaaacaatggagtaggagtcatcatcagaattagaattagcagcaattaacaggcaatacactgccacagtgaggcgggtgtcatccaggtcctggggacctgcaggctgtgtatcctagggagaggtgccattcaagacctggcgctggctctggaagagtctcttaacctaatgcagctgggactcattaggctcagacggctcttgaccacactaattattagcaaagctctggtgttgggttccaaccattggtcaaagctgtaataagactgagtctgtaggcagagtgaagggggtgcctgagtaggaagggggaggcccgctgggagagggtcagtgggcagtgattgtaacatgattaggccttccttgcagatggcggctgtgctgaacggggagtggggttggaaggagccacaagccccctcactctgcctttgtactacactgaagacaggttgctcacatactctaaagcacattcttgatacaggaagaagggcttgtggggaaagcggcgatttggtattgggcaagagccacgttaagccttcatgagggcagccaccacagccttggcattgaggctgcgtaggtcacagtaggtctggccggtgcccacaaagacgatgggtttgcttgtgatgtacgtcatagaaatagcagctcccacctaagtggagaaagaggacagcccatcaacacaagcccacttttcactcaccctctcaggaacaggaagcgctggagccaagatttccttgcagcctcagctcctttgtgcaggacgcccattccagcctccagtctcacgtttaccttgtcatcaatggtatcaaatttggtaagaacaatgccatcaatgagccgaggtgtctgagccatagaatggtcagccaaggctctgttgaacttgacctggaaagaaaaagtgatagaagtgtaagaaccatctaaattgaccaaagctcaagttgtaaagggaactgggcccacgctctcaccagctggtccacggcttcattgcctactaaggcttctcctacaaacagcaccaaatcaggtgtattgacagtaatgagtttggccagggcagtcatcagaggggcattgtcttgcatgcggcctgccgtgtccaccagcaccacgtcaaagccttggttacgtgctagagaaagaaagtagtcaactctgaacacctggactaccactcatgctcgttcccagcttcctctcaaaaagtcctagtttgactacctgttcactgtcttgggctctggatttggttccaaggtaatgtgagaaaaacttgattatatgcttggccatcaccaaacatattcaggaaaaggaggacaacaggatgaaggtgaccaaattcaggtttctctggttaaggtatattagctttgcctgcaactacatctgttatccaaaagcagagcatggcaagtaactgatctgactttttactgtaattgaccaacgagtctgtagtagcacaagcctgatcttctgcaaattccaagagaacccaaggagaaaaagggaccccaaataagcccccacacttcccatgcactgtaccaaaagcaatggcttccatggcaatgccagcagcatccttgccatagcccttttcaaacaactgcaccatggtgcggccaccatgcttctctggagggtgtagggcactcaaacgccgggtgtgtgtacgcagctgctccacggccccagcacgaaatgtatcacaggcagcaatgaggacactgaagccattctctaacaaccagaaggaaatctgtgaaaaagacgtaagaaaagtcacctaaagccaggattttgagacacaagaagtacagaaatatcagcgataggctggggaactgcactgaccttggcaagattagtagatttccccactccattaacgccgcagaaggtgacgacataagggcgctggcgacgctgggcatccatgatgtcccggagcatgtctacacgacgctgtggctgcagaatctgcaccagggactcctgtagggcttgctttactgtggaagtcaccgctgaaaggggaggtggaggaggttgcagctgtgaaactcaaggaatgctctcaaaaatgcctaacacctttctgagctaaggggactaaaacagtaaattagactcttgtcccagaaatccagaacagacgcacattacaaggactaactcactgaatcctctcaataacccttaaaatctaggttacagaggtttagaggttaaggaatttgccgaaagtcacatacctagtaagaactgaggtctatgcacttaacctacacataagcactttctcacttaggtaagtacttactgctgaacgtccccatcaccttcccttccaacttgttggcaacagattcacagagctggacggcaatgtctgcagccacgttcttagctgaggagagggggacaggtatgtcagttccatgtcagcaatgaccaatctttatggtacaggtgagaaacgctaggtgattctgctctcaactacccctatcccgcgagtatgagtcagcccggtcctcagaacttaccaatgagatgatcacgcatcttgtccagcacagattccatgtcttcacgactcaagctctttgaacccacaaggcccttcagcataccaaacatgccacccagtgttcccttggtcgcactgcagggacaggagattacacatacacataaaaccagtaggcaggagttgtatcttaccagttttgcagatgcatataccaacccccacctgaaattcccctacctaggtttggtagagttttgagcagccccttcgtcatcagagctgctgcagtccagatcctgaagctgccccccagacccagtccctcgaatctggaagatacggggaaaggatgtggggtcaggaacactaaggtctctgaggaaaacgtccacattgctctatctctttcattttgggaagctccaagtataacttacccctcattcaaatcccagtatcacgttcccacactctacttcctcccaatttgttgttaaagatcactttgacccctgttacctcttaccaggttgatgtcctcagacaaggcagcctcaggggttccattggtggtgggagtactgtaatccaacacttctttgttagcacagccacccagttcccacacccggggtgcttttttgcccttctcctttggagcatctgacttcgtggacttgctgcaacaggttatgatacaaagagttatggtggagaagtaggaaaggaaacatgagccagagaccagaactcccttgcacccattgtgtctagataacagtattttgagagtactggagaaagagtgctcacttggacttctccatacccctcccatgcttctgaatgaactcctcgcgcttcctgcggatcagctcctctttggaaagttctactccgttctcaggacccactggaagacctgacttttctgcagggactggtttgctggtagccaaaggaccatcagaacctgttggggaaaaaactcactgaagaaaaaagaagaccaatcccaaccactagacaatggctaaaagtcttccaaattgttcaaaggaaatttggaccaaacatcttggagttcataaggcctggggattataggatggtgaccatttgagtgagaagcaggtaagcaatgacaaaaggaaggaccacctcagtccttagcaccgtgttaacacctttcatgtcccagtatatccaaagaactcaaacttgccttccttcttggcccccttttttttgctattctttgctttttccttgggcttttccccccgtgtctcaatcatggacctcacaggtttcttggccttttcagaatcttcaaatttcttcatggtagtgggagcacggatcttactgctctcctctgcttcactaaacaaaaaggagaatggtttatctttctaccccatgcagaaggaaaaataacggtccagagaaaggactctcacacccaagaggacaatgagaactgggtagcaaattaggaatgtctttgaacacatcaatttaccacctttgaaccaccttcagagaggtcatcaaatcatggaaataaattgattttagagaaggcaggtctctcaccgaaggagccgcaggaagtcattttggaaatcaaaagtgccatttaataaacttaaagcactttgctgttggatctctgtgcggtacttgtcccgaaacagccgatgcacgtcatctatcaatttgtctacatatgtcagtgtcaggatcttctgaaaaccaacctgtttaggggaagaaacagccaacagatctgcttacatactagcctagaatggagggacgccaactcaaccctggctttcagagataggttcagctacctggccggtttccctgtcctgagaggcagccaagctccctgcctgggcccagtagctgctgttttcccccatctacctttctagttttttcagttacgtcatcatatacactggctgcaattaatcagagttctcttaaaaatcagggctatgttaacaatgcaatcgtccctctacaacaccccacttaccacaaacaccagctcaaactggttgtccagtttatacttgagtgtgagtgcctcatgggtgaaggagttgttacctccccgttcctggagaaagagtatgtctcagtgttcagactatccccagaaaacccaggtttgggccctgggtttggataacctttgggaaagagccaaacatttcccccaaactcaaatctgtccccaggacaagaggatgttggggcacttctctctggcattccaccagaaataagataaccaagttgggggaaaaagatgagagagagagcaagacacatgggagccaaaagggaagtagtcatgtaaacaatcagattactagcagctatacaccatttagttttgtaaaggtgttttcccatctgttatttcacctaggctcgaaacaacaaaaccaagctgctggggataaatagagggagcggaggagaatcccaaaggcgccggaattcggctagagttgagacaccagaggcgggggccgtcattaagttgcggggtagtctgaaggggacgagaaaacgaagcggagtccgggttacgcgtgagtggtcagtgtgaggtgggcggggagggtgggaggaggcgcggaatagagtcgaaggggaccatggatcgggtcaggaaagaagagcctggagttctgatcccacggggacggtacctgcagcagcacggaacgaatcaacgcgttaacgggtccggtgcatgagtcgctaacgccctggaagcaccagagcacaagcccgcccttggagaaaatggtgaagaagtcgagcatggcggcagcggcagaggagctggggccggcgccgggaattcaggccgcgttcgccgccgcttcctgctgcgccaagcgcgggacacgtcacaccagtggccccggaaatcggctcaaccgtacttccgctcagaacgccgggtgccctccccatctccgcccgggggcgcgcaggactgacgtatcgcaaggccagccaatggcgggtgggagcgggcctgggtggggctccaggagaggtcacggggagacggccacctagagcattgggcggggcagagccctgagggccgctggccaattggcgcgctcgtctgaatggcgtttggcgcggagcagtgacggctgcgataatagcgaggcagcagtgcagctttcagagggtccgggctcagaggggttatgattcggagggttctgccgcacggcatgggccggggcctcttgacccggaggccaggcacgcgcagaggaggcttttctctgggtaaagttgaggacgacagagggtattgtggttctgggttgtccccaacctccgactgtgtgtccttcaggacccgaaaccatggcccacactggcaggacagtgggtcggcttggggaagggggttagcttacctaccagagcttgtaggggctgtgcaggtgtatggctcccaaggcggcccttttcaggtggcaggtctcacatcattctccatttaagcttacagtcagactgattgataatcggtggcacagatgtgcattaagtcctgcccgtgttcaggatgctgtacttagtgctgttgcggtaaaggagtgaagagaagacgggattcagtgaatgttctggaaaatggctagagtgtacctagagagggaaaatttcaatagacagtaggccagttcaagactggatagaggccgggcgcggggcctgtaatcctagcactttgggaggtcgaggcgggtggatcacctgagctcaagagttcgagagcaacctgaccaacatggtgaaacaccgtctctactaaaaatacaaaaattagctaggtgtggtggtgggctcctgtaatcccaggtactcgggaggctgaggcaggagaatcgcttgaacccggaaggcgaaggttgcaatgagccgagatcatgccattgcactccagcctgggcgacttagcgaaactccgtctcaaaaaaaaaaaaaaaaaaaaaaagattagctagaactcaacttaatgctttgcactgctagctagtataacggtagaagtacatggagcaggtgggaactgagatcagccttggaggatgtttactggcttaagaaaggtgtgtgttccagtctctaaataactgagtgcagactaggagaaaaatattgttcttatgcaaggaactggcaaaagccatctagatagacggtgtgagtagtagcatgaaatgtagtgtggacaggtaagctaaggccagaccaaagaaagattccagtgctgctgagaagagtttgagtgaggtatgaaatggcaaaaggattcatttatttaagatacttactgagcacttagaatatgccgggtgttgcgataggctggagattcagtggtgaaggtaaacacagcctcccccctcatggattttagagtatgtaacaatacaaactgcagttgtgtccaagagatcatgtagagtttgacctggtctgggggtcaggaaaggctttcccaagcaaggaattaactaggcaaggaagtggacacagtttaaaagcagagagcatatgtaggttccctgtggtgggaggaaataaggtgccatcaaggaactaaagggcctggagtgtaggggaggataagatgaacagaagccagattgtgcagtatcttacaggctgtgtttaagtctttggactttggttcttagagtaatggaaaactcattggagggttttaagcaagagggtttgtgattaaatttgtgttttgaaaagatatttctagctatattgtaaacatgttcacagcagggggtaggatggaagcggggaatcagtgggaacagttaggatgcttttgcatttgtccagttgagagatgatagtggcttggcctaggatgatggtggcagaggaagaaaggggacagattgaggagttacttggaagccggagcccgcagaacttgattatggataggatataaatgtaggtttggtggtggtgatggatatccaggataagcatggcaccgcttagcggtgacatgcttcagagggtgccgtgacttggggtgtgccagggcctcttggtccaaggcctggaagacccaagtggggatgacagtgcagttgaatatgtgagttgggatcaggagaggtctatgcaggaggtaatgtagaaaattaattttaggaaattgaatcttgcagtgcttggcacaatgcatgaagagactgatggcatgtggactattcagaaaactgtggcaacactgttgggtgcaaggtgaccttatgagatgggctgacagtggggactgccaactcatgtgtctgtttagctcaccttttcctgtgcccatcctccaaccccccaaccatgtgggaaggaaatgtttggccctctgaccctaactacatcccacagactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacggtgaggtctggggtagggcagagtcatgagtggggcaagaaagatgactcattttattaaggactctagcgacaagggaaggagaggaggggaagacctcaatctcggagggtccaacggacagagattgtgctttggactttgttgagaaattttcctaggatcttcctcagtcgaaccaggaagcttggcaataaggtttgttcttttgaaagcagatatcaccatattggatttttcgagatctcatagctctggtcatgagagcctgcattcaagctataattaagtgtctcaattttctctttttttttttttttttgagacagagtcttgctctgtcacccaggctggagtgcaatggcacaatctcagctcactgcaacctccacctcccaggttcaagtgattatcccacctccgccccctgagtagctgagattacagggacacaccctgatgcccagctattttttgtatttttagtagagatgaggtttcaccatgttgcctaggctggtcttgaactccgaacctcaagtgatctgcccgccttggcttctcaaagtgctgggattacaggcatgagccaccattcccagccctcaacttgcttcttttgggtcccgttacttctgaggttttttgcattttattgtatttatttatttcgagacagggtctcgctctgttgcccaggctggagtacggtataacctccacctcccaggctcaagtggtcctcccaccttagcctccagagtagctgggaccacaggcatgcaccaccacacctggctaatttctgtattttttgtagaaatggggttttgccacgttgcccagctggtctcagattcctgaactcaagcaatcagcccgcctcggcctcccaaagtgctgggattacaggcatgagccacccacccggctggtttttacactttaggtgttcctgtttgcattgccagctagccacgagtcttgctactttacttcaatcataacctttcatttcccaaatggtaggtcaaacgttaatcgcctgcccttggacttccaggccattaccattttgtaccactgtgtcagctctttccagatgactgaccctctctgctctgcacatccactactaatgattttaaacaccattgccttcaagttgacttacacatgggtcttagattatagacttgcaaataggactccccttcaactttaggtgtatagctcgaagctttcattgcagtattctagtcacatgtgatagggtactggtctacctcaacttttcttgtctttccacagtattcacaggcctccactgggctctcagtaggtgggatttgtcagcagttctcattgcctgagaacatccagctctccctcttttcagccagctttctacggaacatcaatgtaggtgcaatgatatccgggatgttggggtggttacccctcctttagcccagagtggggagcagcccagctagcaaggtagccagagagcaagaatgggtcagccaactaggagaggggggccctggccttcttcctagtggtggtgccgcaggtctggggcactgagcctggggagctgtgggggaagaaggcaggaaaactctttctggcatccttaagtcagtttctttcaggagcttctgtctgcacacaggagtacctggccgtagtcgatgctcctcccctggacctccggttcaacccctcgggctacctcttgctggcttcagaaaaggatgctgcagccatggagagcaacgtgaaagtgcagaggtgggtgcctggcacagcctcttagctgcttggcagccaaaggtgttgggtgactcctgcaccaggttaggaagcgagaaagtggagttgataagacagatccctgcggtctaggacctcagtgtgtcaggaagaaaatacacagacctgcaatgccctgggagtgctgtaccacagatatggacaaaacactgcgaggtgcttcctaatttgtcagatcatgaaaaccacctggaacacatcccagacctaataaaccagaatctctagggaaggagcccacaaatctgggtttttaacaagaaccttaagtcaggagttagcaaactttttctgtaaagggccagatagtatatattttaggttttgctggccatacagtctctattccaaccactttgctatcacagcatgaaagcagccatagacaaaagtgcaaatgaaggagtgtggctcatttatgaaaacaggcagcaggtcggatttggcaacccctgctctaagtgattctcatggtcaggtgagggtgggcatgtttgtgatgcaatatggccagaggctttatttgtatgtttatttaacaaacacccaagtctcagagtgacatcaattaatatcctaaatgctgtacagatattaactcatttaatcatcagaacatccccattttacatatgaggaaactgaggcataaggcgctagtaagtggtggcggtaggatcttatttgaagccagcagtctggcttgtgagtgttctgttggtgtgtccgctatgctgcctttgagggacagtgtcccagaggagatacctgtgctcaggaacaggattgtacaaggagtggagaggaggtggatccaggcaggagtggagggaacaaggttaccaccttgttgtgaaagttcatggaataggctgggtgcagtgtctcatgcctgtaatcccagcattttgggaggccacggcagatggaacacctgaggtcaggagttcgagaccagcctggccaactggtgaaacctcatctctactaaaaatacaaaaattagctgggtgtggtggcgtgtgcctgtagtcccagctactccagaggctgaagcaggagaatcgcttgaacccgggaggaggaggttgcagtgagccaagatcgcgccactgcactccagcctgggtgacagagccagactcattgaaaaaaaaaaaaagaagtcatggaatagactgggatagcagggagctctgtgtgctgaagggagacaagggagtagggaaggaaaggcagtcaaggctgaagagcctgactaggaggcttggtcttcagccgctcagcaatgaggaaaaataggggcatttggggcagagaagtgacatgactgagctggactccccacttgtggagttggggtccatacatcatccccctgcacactcccctctctgacacacatacaccgacccacacgtttatctcaggcaggagggagccaaagtttctctgatgtctcctgatcagcttcggaacaagtttccctggataaacacagagggagtggctttggcgtcttatggtgaggcttgcttgcagaggggacagcttttttcctgaagatggagactaaggggtgctacacgttgggagtctcggtactccacagccaagctgaaggaggaacacttccctcctgtgtcacgggaactgccctgggccgtggtagttctctgtccttcatcaggctttgtctctgtggttcagttggttaagatgaccttccccggcttacaagccctagagaggggttggggggcacaggaaatacaatccaagagcagaagtcctcatccctctttgtgagttctctttttcttatcacagggatggaggacgaaggttggtttgacccctggtgtctgctccaggggcttcggcgaaaggtccagtccttgggagtccttttctgccagggagaggtgacacgtgagtctgagcttgtttcctctagcaaccggggcataggcctagactaggtcttatcttctcactcacaagctaagcaagggctggagggggaaaggggtctccctgagagcaggtcctaggcatcttgacctgggctcctcactgatctgcgttgtgacttgtgatctgcttgatgattgcacctgagcactgtcctgtcagagtgtggccaagctcatgccagctccctcatctctgtttgcttcagtgtctgtgggaaagctcccatccttccagctttctttccttaagaaaccagtgaaatccccatttcattcctcttcagcacctctacggcctatttttcattttcttctctgcaggttttgtctcttcatctcaacgcatgttgaccacagatgacaaagcggtggtcttgaaaaggatccatgaagtccatgtaagtttctagtctgtgatgtcctttaccaaaatggagggacagggaaggtagtgactctccttgttttggttttctttgacccactttccagtatgggtaaactaaggctcaggaagcagtgcatctctcagggtgcctggtgtgtggtccgggccttcccactcctcaccctctggtgtctgcaggtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtaactgccctccggacagctgaggaggttggtgagaaagaaagaaatgacatcgaagttggatagcgtgtgtgtgtgtgtgtgtgtgtgtgtgtggggtgtggggtggacagggttggggagggttgccggccatgctgtttctgcagttcgtaaccgcactggttgtggcaggtatgtgtatgtgtggcactgcccccagggaccaggcctagagactccgcttgttgcagacaccagtggagcctattttcgccgggaaggattaggtagcaactacctaggtggtcgtagccccactgaggtaagctgagtggggtgggacatgctggcaaggagacatagaataattgtcacgaaacaatcaggcttttggccaggcacagtagctcatgcctgtaatcttggcattttgggaggccaaggcaggtggatcacctgaggttaggagtttgagaccagcctgaccaacatggcaaaaccccgtctctactaaaaatacaaaacttagctgggcgtggtgctgggcgcctgtaatcccagctacttgggaggctgaggcaggagaatcactggaacccgggaggctgaggttgcagtgagccaagattgcgccattgcactccagcctgggcaacaagagcaaaactccatctcaaaaaaaaaaaaaagaaaaagaatcagccttttttggggggctgtgtgctgtgttaattgatattagagccccctccagatttgaactgggaccatttctccccatcccctacctgcacagggattgttaaacaagtctgggcctgtccttgtgtcccaggcaatgtaagcgttgtccccacctctcactccagcaggaagaaccggacccggcgaacctggaagtggaccatgatttcttccaggacaaggtgtggccccatttggccctgagggtcccagcttttgagactctgaaggtaactggcaagggctggttttcctttttatttttggacattggatgggacagatgacagtggagcacattggtcccctcggacccgtgactgccgtagtccctccatgtcacaactgctaaggaatttcttggacacatcccatcccatagacccctcagcagcaggtagagggtactctgtgctgagccctgaggggagtgaggatggagtgtggctacagccttcccgagaaccccagtgttttgtgcacccgcaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtttattgattttcgtctgtttaccctatccattaatcaatacatgtaattaactccttccctccagtcttctgtctcttcttttcattgtacagcaggagcttttgaagcaccccattagccttataccagtacagggagtttttttaaaaaaaaacaaaacacgagcacaaacccacctttcattagttaaatccttgagcggtgcagtatcacacagattgtgtgtctgtagtcttagcaggaagattgggaatttggcataaaccatgccactgtttccgtgaacccaagttactttttcccagattactctggttttgtttggtgtgccaccagaagtcgctgtgtggttctttgctttgtgtacatgagcacatctcttgcccaaatagaattcagtttatcccaggcataaatgctgaaattttaagaagagctgtgtgccccctttggttctggaaaccccatgtacagccagcaaaaatggccttggaccacagccttcctgttcccagcaagcctccacaggctccaagatggcagacagagtccttcttagatcctaggtggtaggcacttgcttgtaagcaagtgcctcccattcctgagttcctgcagggagtttggttgtaaagaagagggatgggtttgtccatctattctaccaaaatttattcagcccagctgttggccagggtcagggtcacatgttgagatacaccagcaagcaaaacatagtcatgtctttgctggaactttcatagccctgcacctcctagcccttcacccctagatcagatacagtgtgacccccacagtgctggcataagcacacaacacagacacctcacccagggtgggactaagagggtggcaaaggggtttctccatgaagctcctcgagggaagttgacctctgagctgaacctaaaggatgggcatttagtgaagtgaatgcaaggtggctaagggaggatccaggctgagggcaaaccatatgtaaaggtccagagacaagaattaatacgattcagggatttgtcctagtccacttgggcagctatcacaacatatcctagactgggtaatttataaataatagagatgtattgctcacagttctagacactgggaagtccaagatcaaggcaccagcagattcaatgtctagtaaaggcctgctttctgcttcgaagatggtgctttctcactgcatcctcacatggcagaaggggtaaggcaacttctttcaacctcttctaagaacactcgtccctttcatgagggtagagtccacatgacttaatcacgtccccaaaagccccgcctcttaacactatcacattgggtatcaggttccaacataggactttagggaggacaccaacattcagaccacagcaggattcagtgtgactgtttctgcctggatcgtggagtgcgagaagaggaactagagccactgaggggttttaaacaggagcaacacgatcggattttccttttagaagaatcacctgggtgaccctgtggagagcagatgaggatgtcaaggcaggcagcaaggaggccagatggaggctgtggttgcagtctgtgtggcagggacagggagtgcctgaaccatcatggcaagaatcagatggatcccagggtgacgccagcaacaagaagtgggttaagtcgcatggccaggtttctggatggaggttctacccctcccagagatgaggagcaccagggaggagcggagtgagggacagagtgaatggtgcagtctgggatgtggtgaatgagggtacctgtaggacatccctcaaatagggggttgggctgattggcatggtccttgggggatgatctgggctgtagatagtgatgtggacatcatggaacaggatggcatcaccccagagggtagagtagggggccaaggagggaagctggagggaccccaccaacatttaagggacagaccagagaaggggacactgaagaggtgcccacagagacaggagaaaagccaggagagtgtggtgtcgtgaagctaaggaggaagtgatcacggtgcctgctggattcggtcccaagtaggtcagtggtggcctcactcgagaagagcagtttcagtggaatttaaggtctggacacttgcacaggagaagtgaatgggaatagaaacagctggtaaactgcccactccgccttgaaagtggcctttgggatcgggcgcggtggctcacagttgtaatcccaggactctgggaggccgaggtgggaagatcgcttgagcctacgagttcgagaccagcttgggcaacatggcaaaatcctgtctctacaaaaaatacaaaaattagccaagcgtggtggcatgcacctgtagtcccagctattaatacgtgggaggctgaggcaggaggatcacttgagccttggaggttgaggctgcagtgagctgtgaggcaccactgcactccagcctgggtgaaggagtaagaccctatctcaaaaacaaaaaacgacaacagaaaaagtggcctttgtggagaaggatgaaagggagggaagaaatgatggaggtgggctttactaatggcaggggaggagatgtgctaccagtgaggtaacagcagaagcccctgaggttggggtgagggggccaggcctaaggcggaagccagaagaggaagaaggcggtgctgaaagacaggaaggaacttgccagggatacgcaggagggacaagctgacatccgggttgaccctgtgaagttcccctaggtgccagccagttgctcccttcagcacggacattccaatctcagggcaaaagggaaaaggccttcaagtgtttctcacccagaagctgctcccttccacacactgagtactatgtttattaagaagcactgaggcctgtaatcccagcactttgggaggcggaggtgggcagatcacctcaggtcaggagttcgagaccagcctgaccaacacggagaactcctgtctctagtaaaaatacaaaattagccgggcatggtggcgtgtgcctgtaattccagctactcaggaggcagaggcaggagaattgcttgaaccctggaggcggaggttgcagtgagctgagattgcgccattgcactccagcctgggcaacaagagtgaaactccatctcaaaaaaaaaaaaaaagcactgagcaactctcctgtcctcccacagggctgtacttcaagctgtgggcaagcccttaccatcgcctccgtgcatctgtcttcccccctgagctgtgcagagctgggaccaagccttcttcatccttgcctgacactcagctgccccaacacttggcccatacttggcgccgtcaaggcctgtttatctgagtgttcctcgagtgtccttctgctctggctggagcctgaagaaccatccctggcctcggggaatttttactctaaagtgggagataagcagcagagcacaggctctttacaatgaaaagcactatggcctttgagggatggaggtgggaagggctgggttaagcaaagctttcctgaataagctgcaaaaatgggccttgatccctttgtagctcataagcaagatgactgggtgttcacgcacatgtgtgaggtgtgcctcccttaaaccttgttaagggttgttacccgtgtgatgggaaaaaaaagaaaaaggaaacaaaaaaaccccaaaaataggccttgctagaagaagggcgttttgcagagcggagctggggaaaaggagggccctgggcggaggtgtacttggtagagtcaggtagagtcaaagcaaactgggcatttgggtgcagtgccaagtgcctgatctactttatgtagactaatccttgcaagaacaccagcaaccagataccataatgtgatgaaggaagcaagcctagaaaagttgcgtgacttcaccaaggccacacaactagtaagcgatgagcgctggttgtgaacccaggcagttgactccagagccctcccaggatgggcagctcatccgctttggcgggctggtgagaaaaggaggaaatcaaattggagggggagatcatgaatcttacatggcctaattaaactacctccactctccagcatttcgtgcacatagttttaggatagggtttcccaaactggcatggcctggagcaagacgctcaggaagacattcacatttcttgtagagtgaaacaagtgtggggaatgctccgttcccttctccccaaggtgcttcacagcgctcacgaacatctgaagagctctcagaagtgggaggcaaaggcatctctttcacccaggacttccagcatcttgcctacaccacgctgtttgcagcggctctgcagcatactgcagcgctgttcataacgcccatgtgggatcaccgcttagagaagcaaagaaagcactttggcagaagacggggtttccaccctcctcggcatcaaccagtgtctgggacgggaactggcggccgctgcggcctggcttcccagctgccgcccgggtctgcccctcccacactgcagccccgtacacccctcgctgtgtgtgacctttggaaaagttccatctctccaagcttcatgtttctcatttgtataaaaggaaaaaggtatgaacaccccccttgcagggtgttaggaagattaaatgggcggaatagggtgtttttttttccttctcccccgcctagaacaaaacccaggtttcaggttgtcacggtgggcgccgggggaccctggccacgggctcctctccgagttgctgcggaccgccccaacgcaagcggagaggacgggagcccggagtcatgcagaagccaggctggcaggggctcgggccgcagtggacacaggggctgccccgtcccgcgtctcccgcagccggattgtgcccgagagtctcccgggtctggactgggcctggcggcgtgggaggggcagtgcggcgggcggcgcttccggagagcggggcctgcgcgctgctcttccccgcggagcccgcgcagtccgcgcagccctcatcgcaactgggcccgcgcgcaggtgagcccggggcggggtcgcgggggaccgggaggcgcggcggggctccgtggggtgggcgacggagcgcggccggcctgggccccagagtcccggccccaccgagagccgcaggggtgcgcgccgcctctggtccggccttgccctgctggcggcacatccgcttcccttcttcacctttctggcacccgcaacacgcaagcggcatgaaagggccctccgaggagaatgtcaccttttctgtcgcaaagaagctcgcgcggggcggctcccctttcgcttgcctcgctggaagagcctggcgctcagtgcgttgtggatatcgtttctcctcacgttcttctctgctccggtcacagcctcttcctctgctcttcgggttgtcattgtggcagtgattcagcaagtgcataacattagttagggtcagggacctatcgaggcattacaccacagtcatgggcagctacacacgggctgggcagccactgtgccaacgactagggtgaccgcggtggaccagacagatccagtcttctggtccccaggggacagacaggtacgctagaatcacagcataccctagaagtgcaacagagagggggaagtgtggagaactcccgttgaaacaccaaacctaggggacaccaggatcaggaatgactcagagggaaccacatctagttagtttttagatttaaaagagttgatacgtaggcacacaaatcctaagtgtacagctcaaccattttccacaacacgcacatttcctgattcagagcaatcaataaaacatgactacatccctggcttctaacgccataaaataggtttgcctgttttggattttccatccatggaatcatatatcatgtacttcttttttttttttttttttttgagatggagtttcgcctttgtcctctgggctggagtgcagtggcgcaatctcggttcactgcagcctccgccttgtgggttcaagcgattctcctgcctcctcccgagtagctgggattacaggcgcctgccaccacgcccggctaattgttgcattttcagtagcgacggggtttcgccatattggccagggtggtctcgaactcctgaactcaggtgatccgcctgcctcagccttccagagtgctgggattacaggcgtgaaccactgcgcccagcccttcatgtactcttacgtgtgtgacgtctgacattcagtatgttttgtgatattcacccatgtttagttagcagtttattcttgttggtatataatattccattgtatggctagaccacaatttatttatccattctactggacacgggttgatggacagtcgtttccactgtggggttattttgtatcttgctgctacagacattcttgtgaatgtcttttggtaaacatctgtaagcaggcggggaacagtggctcacacctgtaatcccagcactttgggaggctgaggcaggcagattacgaggtcaggagttcgagaccagcctagtcaatatggtgaaaccccgtctctactaaaaatacaaaaatcagccaggcgtgatggcgggtgtcggtagtcccagctatttgggaggttgaggcaggagaatcgcttgaacgtgggaggcagaggttgcagggagccgagattatgccactgcactccagcccgggcgacagagggagactccgtctcaaaaaaaaaaaaaaaaatatgtaagcactgctgtttgagtatattcgtaggactgaaattgctgatgtgtgtatgctcatcttagtctatggccaaacacttctccaccggcagtgttcgagttcccatccctgcacactcttaccactacttgatagtctttttctctgtagccatttggctgagtgcccagcagtgatgcattgaggttttagtttgcatttctctgatgactaatgaactgttttgatgtctattgctcatttgaatattccttttgtgaagtgcctgctcaattcttctgctcatttttctgtcgtcttactagttccattgagtccttgaaatatttgtgatataagacatttattggatatatgtgtgtgtgtgtatatatatatatatataatatatattttatttgatttttgagacggagtctctgtcacccaggctgcagtgcaatggcgcagtctcagctcactgcaacctccgtctcccaggttcaagcgattctcctgctttagcctcccgagtagctgggattacaggcacctgccaccacacccagctaatttttgtatttttagtagagatggggtttcaccatgttggccaggctgatcttgaactcctgacctagttatccgcccgcctcggcctcccaaagtgccgggattacaggtgtgagccactgtgcccagccctggatatatatttttaaacattttaaccctcgggagattgccttttcactctcctatttatgtcttttgatgaacagaagttcttcattctaatgttttttattttatcattttttccccttatagttgtattatttgagtctggtttttaaaaaatcttccctagcaagaagactcagataaaagtaaaattaaagctgggcatggtggctcatgcctgtaatcccagcactttgggaggctgaggtgggcggatcacttgaggccacgagttaggagaccagcttggccaacaaagcaagatcctgtctgtaccaagaaaaattaaaaaatgaaaaaaataaattaggtaggtgtggtggctcacgtctttaattccagctactctagaggttgagatggaagactgcttgagccttggaggttgaggctgcagtgagctgtaatcacaacactgcactccagcctgggtgacagagcaagaccctctctggaaaaaaaaaaaaaaaaaaaaaaaaggtcgggtgtggtggctcatgcctgtatgtaatcccagcactttgggaggttgaggtgggccaatcacttgaggtcatgagttccagaccagcctggtcaacatggtaaaacctcgtgtctactaaaaatacaaaaattagctggatgtggtggcgagcacctgtagtcccagctactcaggaggctgaggcacaagaatcacttgaacccaggaggcagaggttgcagtgagctgagattgtgccactgcactccagcctgggtaatggaatgagtctgtctgaaaaaaaaagaaagtcatgggtccttctcacagtcccaggtgtgaacacagggggccaccctaggtctgcaccatagtctacaaacctctttgagaacactgtgttgtgtctatcaagctataaatgaattatattcaggactttaagtgacattgtcctgcaaaccataattaatcctacccaaacgttttagcaagtgtttgagaacaaaacagcctttgaaaccaaaattcttttaaatgtaaagtcaaagtcaggtgaagtatagatggtaatttatttatttaaagatgtaaaaactgtttcaaacaatttgaacctttaaacagaccaggttttagcactcaactgaaatccaatactttctccattcattggcctgatctaatcagacacagtgtagtagtttcctattgctgctgtaacaaattgccacaaacttagtggcctcaaacaacacacattgattatcctgccgttctaagatgggtcagcaaggccgtgctccttctgaaggctccaggaaagaacccatggacttgccttttccagcttctagaggccacctgcatcccactgccgcctgcttcccttggcacagctctttcgtctgcctcagaccttcctgcctccctcttgaaaggatctttgtggttacattaaactcacctgggtaatccaggaatccctccccatcacaaggttcttaatcacagctgccgaatccccttttgccacggaaggtaacatattctcagttccggggattaggatgtgggcctctttgtgggccactattctgtctaccccagatagtgattcctgcttaacagaaatcgaatatgaactctaagagatacatattctaattatatgccttcacaggctccagtacattccctatataatagaaattggagaccagtttgatattggatactaaatacactttggatttttttttttttatttttgagacttgagtcttgctctgttgcccaggctggagtgcagtggcatgatctcggctcactgcaacctccacctcccgggttcaagtgattctcctgcctcagcctcctgagcagctgggattacaggcacgcaccaccacgcttagctaatttttgtatttttagtagagacagggtttcaccatgttggccaggctgatctcaaattcctgacctcatgatccgcccacctcggcctcccaaagtgctgggattacaggcatgagccactgtgcccagcccactttggattttatacagcaaaactccataatgtttcctttacatcagtttctgcacataatattggaaaagcattctagaaagcactaaaggtattgtgctacttcttttctgaagaaattctttactaattttcttttctttatttttttgagatcgagtctcgctctgtcacccaggctggagcacagtggtgcaatctcggctcactgcaacctctgcctcccaggttcaagggattatccagcctcagccacccaagtagctaggattacaggtgtgcgacaccatgcctggctaatttttgtatttttagtagagacagggtttcgacctgtcggccaggctggtcttgaactcctgagctcacatgatctgcccacctcggcctcccaaagtgctgggattacaggggagcaccagcacacccggctaaattttgtatttttagtagagaaggggttttgacaggctggtctggaactcctgagctcacatgatctgcccacctcggcctcccaaagtgctgggattacaggcatgagccactgagcccgttccctttactaattttctatcaagtcatagttcttacaaagtgggtatttttggtatgattctactttatgaattttttcaaagcacaaagaaagcgactgcgtattagaccacacagcaaatcagagaataggcagagctagtgagtagagcttccagttggagatttgggttcattaccttacctacttgtcaaccacatctcaagatatgatgacagttaccaggtcttggaaagattaacacgtgtttgaatatgtgacagttccacagctccagctacaaaagaactgaaaaggaacagggaaggtgcatggcgtcttggattccaggaagtaggcagtgtgtatggttactggaatttacctgccatcttgctcaattatcctgtcaaaggtgctgttatttttctctttaaaacgtttccatgtttctcatgagggcttataccaccgcacttctggtggcatatactgctggacaactggatttcttcttaaccaagcaatggaaaagcaatttcccccaattagcatgcgttgccaaaagggcaagtcatttcataaaatgagaaactgaaactttaaaatctacatatattaagtagattaacatattatgttaatttttaacctttagaatatttacaaatcaaatgatgctctagtttacaagtgcaccaaggccaaataattaatattaaaattaaaacagaattgaaaaaatatttaaaaaatgcaaaaaccaagtgacatcatgtttactactgggggcaaaaaggcatcctgaacggccctagctgcagcctaccacttaggctgtctgaaatcccaagcatattaggaaagaaaagaaactcatatacatactcatagtcaacgtccagtgccgttttggtggcttcacatttagctgtgttgctttttcagatgtcttctctggttcctgtacccattccaaccctttgctctgcctcctttgctgctatggtttaagttctacttcttttttgaactttgatatatgatcacaaatcctcagcatcccttgtcttctacgcatcagtgaacaaagcattaatgtgcagcatagaatgacattctttaattttttttattgagatggagtttcgctcttgttgcccaggctggagtgcagtggtataatctcagctcactgcaacctccgcctccaggttcaagagattcttctgcctcagcctcccaagtagctgggattataggcgcctgccaccatgcccagctaatttttgtattttcagtagagacaggggttttaccatgttggccaggctaggcttgaactcctgacttcaggtgatccgccgccttggcctcccaaaatgctaggattacaggcgtgagccattgtgcctggccacattctttaaattttgaaaccttttattttagtgtgtctaataatacttgcttccatgagttctcaggtttgttttgatctcacagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatggcaggttgcctttctaagggattcttgggcctttgtatttccatataaatttagaagcagtctgacaacctccccaccaaaaaacctaaaaaacaaaaatcttctagactttggaacagcactgaattaatgatcagtttgggaaacgttaacattacaagtttaataaaccatgaacataatatacccctccaatatctagattattttatatacatagtagcccacattttctaagcatttattacatgccaggcaccattaggactttacataaatgatttcatttaatcttcacaataatgctgagaaggaggctctagtacttccatttcacggatggagaaacgagtttagcaaggtggccaaaggtcacggttaaccagagatgagaatcaggcactctacctgcagtctgcagtctgtaccactttttgacatgaccttcctgagctgacggctgcaggggcgatgggtctatggatggagttattcagggggaggcagacttggaggaaaagtctcccaagatttcctgcatgtgctctctctctactgttcagcttctgtctatctggatacataattatttgtccaaatagcaactgtccttcttctgccatttcaggccttacataggaagtccttctaaagagctgcctgccagctgcccttccccagatcccgaatatcctcctggccaggtggagcagagaacagttcctcagctggtcatgctgagctcataccctgtaagtctgaccacactacacagctttggctttatctagaatccagctccaatcacagtcgtgtctggccctaatctcatgaggaatgaaagacccatttagagaagaagcctctgtcaggcattaggagagaaacagaacttcgcagagctcatccatggggaatgagagcagggtaagtgcagcctttgtgattctctctctctaccctctgtaggatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctggtgagtggaaccggactcgcgactctgctgtgttcctgagtgtagtgctcagcctccatagggcgcggtgggaggcctgcctggtccaaactcagagagacgcaggaaggctgacgtggggaactcctgacctgaattcagggcctggatgctttgtggagagtgaggaggggaggcctgcgtcagctcagccagatctttatccttttggctcaaaggttttccaggcctgctcagctagctttcctagcctggaaaccactgtgctgagtgcttaacactgtctcttgtcgtccaaatctttgttccagaaccatttagaggagaagccaagcagagagagaaaatgaatcaatccccaccacaactatctgtccttatcaaaggctggggaagctgttttcatctccttatggagtcccatactccaaacacagacctgagcagtgtttctcccccacagactggttcaggcagaccctgctgaagaagcccaagaagaggcccggctccctgacatacctgacactgcattatctcagttaactttcagcaactaagacaggtccacaagtccacagtcaaagccgtgtccctgactccagagtgtgggttctgaatcacgaagctctctgctcctcagcaactctgagcagtagcctcttccccatttagcgacaatctaggatttcttggggccaaacagatgccagtcctccgtaccccttccttcctgtatacgtagcccttcctaatctaagtccacctcccctcagtgctgaaagtgggctttgggactgatggatccttgctagcataacgtagctctgcctgcagactcccggtggttgactagtcagctctagtgggaagttctgcttaaggtgggctgggctgggggtaccagatatcaaagggcctggagtagtgcaaggccatttctcttaaccaggctggtggaacactctcacataaggattccagagttctgacacgtccaaaacctttacctttagagggcacttttaggcaagtcccaaaagataaacaaaaatagcagagtgctgggcacagtggctcacgcctgtaatcccagcactttgggaggctgaggcgggcagatcatgaggtcagaagttcaagaccagcctgaccaacatggtgaaaccccgtctctactaaaaatacaaaaattagccaggtgtggtggtgcatgcctgtaatcccagctactcaggaggctgaggcaggagaatcgcttgaacctgggaggcagaagttgcagtgagccaagatcgcaccactgtactccagcctgggtgagagtgagactctgcctcaaaaaaaaaaaaaaaaaatagtggagcaacaggtctctgagaataagatgtttcccagtgcagggaggtgggctgcagtctgtctgtcctccctgtgaggtggggctcctccctgtgtgggcagtgagagggcacctggtaacacacaggcctgagcagtgtttctcccccacagactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttgtaagctactacaggagggagaaggggaacgggattcagctacagtatctgatctactttgacttttaggagacagccctgtagcctagtagttcaaagcgcagcttctggaaaaggctgtcggggtttgtatcctggctcctgcacttattaacccataaaaagtaacttggccaagttactcacccgctctgtgccttggtttcctcactgaccaacaggtttccattgctatgaaatgagaacagtatatacacgaagggctcagaacatggcctagcacatgtattcataacaggcagcgcctagcacaaatcaggtcctcaagttaatagctagtagtagtaacagtaatagcattaggtttctctgagatcaggctggagatgtccatcaagagctgggaaggtgccaggagggacattggtttagtaaggcaaaatgatgcaaaataataggaaagaagtgcatataagtgtatctggggagggccatgctattgcagtaggtttggaagtgtaatagataaaaagatagaagaggcaggacctgttggggaaaacagatgctgggtttgggaggtgtgacaacgctgtgattggtctctttcagatctgcagacactcagttgacacttgttatatcatgggaccccggaaattggagtgaagctagaaacagaaaacccatgcagggcctcggattcccacaaatgtgacaagaggtatagggagtgagtcacagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcacttcaaagagctgtagggaagatgcagtcagcactgcactgtattttttatttattgcctaggtgccattaaagacacaaacctagaagcctagaggccattctgaatatgggggtggggtggtggagggagcaagtgaagagatgggaatccagggctcagggttcaatgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccttataggacaggcaaggtttcattcatctgttctcagtaagtttgttgttgaactgaaatgaatttcattatttcctccaatgtgtacttttgtgcccccctctcacttctccctatcatgacccctcttttgctgaaaaaaatttttattattttttctatctctagttctagaaagagaaaatttattttttaaattataaactattttgccaggcgccatggctcacacctgtaatctcagcactttgggaggccgaggcaggtggatcacctgaggtcaggagttcaagactagcctggccaatatggtgaaaccctgtctctactaaaaaaacaaaaaaaatcagctgggtgtggtggcgggggcctgtagtctcaactactcgggaggttgaggcaggagaattgcttgaacctgggaggtggagattgcagtgagctgaaatcacgccactgcactcgagcctgggcaactgagcgagactctgtctcaaaaaaaaaaggccaggcatggtggctcatgcctgtaatcctagtactttgggaggctgaggtgggcagaatacaaggtcaagagatcaagaccatcctggccaacatggtgaaaccccatctctactaaaaatacaaaaattagctgggtgtggtggcgtgggcctgtagtcccagctactcgggaggctgaggcaggagaattgcttgaacctgggaggcagaagttgcagtgagccgatattgcaccaccgcactccagcctgggtgacagagtgagactccatctcaaaaaaaagaaaaaaaaattattttattatgcacaaaaggattaacaaataatatgtccactcatgtgcctaccacccagtttaagaagcaaaaccttatcatcccttatagtggtccctttgtgccctgaattgcagtctccccttcccccaccagaaataaccagcattttgaattttgaacttcttgcttttagcttttctctatacatttactacatatgtatgcacctccaccagcatactgtgtagttttacatggttttatattttatgtaaacagcgttacagcgtttgtattctgcagattcctttccttgttcaccaaatgtgagatttatccatgcggatggatgacatgccagttattaataatacactttcatcccacgatgtaaatatgccaccatttagttacacattcttctccaaatgggtatttggtgttcctaggtttttgctattaaaaacaatgagcctctgaacttttttgtacattttcacaagcaagattttctaggatttagcctagaaaatcctgctggggctgggtgtggtggctcatgcctgtaatcctaacactttgggaggccgaggcgagcgcatcacttgaggccaggagtttgagaccagcctggccaacatagtgaaaccctgtctttactaaaaatacaaaaattagccaggcatggtggtgcacgcctgtaatcccagctacttgggaggctgaggcaggagaattgcttgagcctgggaggcagaggttgcagtgagctgagatatcgcaccactgcactctagcctgggtgacagagcgagactccatctcaaaaaaaaaaaaaaaaagaatatacatactatttttctagaagatgccacagtttcttccaaattggctgtaccaatttaagttcctacaatttgtgtttaagagttcccactttttcatgttcttgctaacgttcagagttatcatatttttaaatgtttgctaatctggtggatgaaaactggtaaactattgttattttttttccttttcatcatttttatgaaaaaaaaaatcaagcatatactgaaaggaagaagtttgatgaatccctatgtgcctgtcagctagcttcaacaattaccaactctgagctactcttttatcaataataccctactcatatctctcactccccacaagatcatttgaagcaaacctcagaaatcactttattcctaaatatttaagtatgcatctctaacttattaaaatttttttggttttgttttttgtttttctgaaacggaatttcactcttgttgcccaggctggagtgcaatggcgcaatcttggctcactgcaacctctgtctcccaggttcaagtgattctcctgcctaagtctgggattacaggcatgcaccaccacacccggctaatttttgtatttttagtagagatggggtttcaccatattggccaggctagtcttgaacttctgacttcaggtgatccacctgcctcggcctcccaaagtgctgggattacaggcgtgaagcaccacgcccagcctgaaataatattttaccttttactttgtgctttttgtgttttactcaggaagtcctcccctacatctgttttcttctgtatttcttttcatatttaggtctttaatccacctggattttttgtttgggtttttgttgttctttagtcaaagatccaattcttttttctatttaaataaccatcattgactgactagtccatccttaccccacccctactgattatgatgtcactgctgtcacatattgtcatacgtggggggctgttactgggttctccagtctcctccctttactttatctgtttgtgtatccctgtgctggtgccacactgcctcgttcactgatgtttttaataagcctgcaccatttgtatgtcaattcttcctgctcttcttatccatcaaaaatcactttaacttttcttgttcctttactcttccatataaattgtttattcaaccatcaggttccaggaaaaagcctgttagtattttcattggacttacatggaatttgtagattttgaaaaaacagatatttttatgagtcttcctattcataaaaatagtatgtctccatttacttatgtctttaagtgtatttcagtaaagctttctatcttttccacattggtcagctcctctttttattagaattattccctagcatttcatattttctgttgctgttgtaaagggtaattttacatttttatctattactgatataaagaattgtaatttatttcacatattgatctagtattaagcagcatgctgaattacttaattctatatgactataaactttgcagggacttgctgttgcccaggctggagtgcagtggtgtgatcatggctcaccactgcctcgacctcctgggcccaagcaatgattctcctatctcagccctctgagtagctgggaccacaggcctgtgccaccactcctgactaatttttctgtactttttgtagagatggggttttgccatgttgcccaggctagtcttgaactcttgggttcaagccatctgcctgcctggtcttcccaaagagctgggatgacaggtgtgagccaccacacctgtcttgttgaattttctataaacagtcatacaatttgcaaaagaaaacaaaaactttagttccttgtgtggttcctaaggcctccaataaaacaaagtgacaatagcagccatccttgtctcattccttagaaggaatgcttcacacatttctccactaaatgtgtgcgttgtaggttttctgatacataattttttcttttttttttttttttagtcttgctctgtcgcccaggctggagtgcagtggcgcaaccttggctcactgcaacctttgcctcccaggttcaagcgattctcctgcctcagcctcccaagtagctgggactacaggtgcgtgtcaccacacccagataattttttgtatttttagtagcgatagggtttcaccgtgttagccaggagggtctcgatctcctgacctcatgatccacccacctcgggctcccaaagtgctggaattacaggcatgagccactgcacccagcctttttttaattattatttgaagaatttaagattggaattaattgctccttgaatgtttggtagactcatctgtaataccatttgagcctagaatattctggtttttttgagacggagtcttgccctattgcccaggccggagtgcagtgggattacacgcgtgagccaccatgcctggccagaatattctttattgtaaaatttaaagctgtaatttcaatgtcttgaagagttatagatctaattagattttccatttctcctggagtcaatttggtacaaacagtcaataaagactacaagaccagtttaagtagatttttcagtttgagtgtcctggatcatgtacacaatcatgaatgtgaagtctgtctgcatgaagaatcatctgtggttataaattcttaggaggttttttccttcttccctctggaacaacggttgaagcaggcaagtttcctaatcaccttctctcctttagtagggcagcatttttcttttttataaatagttggcctggccaggcatggtggctcacgcctataatcctagcactttgggaggccaaggcgagcagatcacccaaggtcaggagttcgagaccagcctgaccaacgtggcgaaactccgtctctactaaaaatacaaaaaaattagctatgcgtggtggtgggtgcctgtaatcccagctactcaggaggctgatgcatgagaatcgcttgaatccaggcagcggaggttgcagtgagctgagatcgcgccactgtactccagcctgggcgacagagtgagactccgtatccaaaaaaaaaaaaaaaaaaaaaaaattgttggccccttcattgagctagtggaccttcagggttcttagctctatagaaagttctgtatcttaattcctctttacataagctcaggtcttgtctcttgtcccttgaatcgggtcctagacgtctagagatcagcaatggcccttaaaatagcttccaccttaaaaatccccttaccactctatagattcaaactcccacatcatttttggttcctgcaaattttacttttttgagagctcagcaacgtaactaaaagaatgttttaaattttacatccagaatgttcgggtattttgtagctgacttgttttcagtttagtctgttataatccctgaaatggaactgggaagtatccaatccttctttagactaaaaaagaaaagatttgggaggtttttttttttttttttttttgagacagagtctcgctctgtcactcaggctggagcacagtggtgcaatcttggctcattacaacctccgcctccaggttcaagccattctcctgcctcagcctcccgagtagctggaattataggtgcctgctgccacactcagctaatttttgtatttttaatagagatggggtttcgccatgttagccaggctagtctcaaactcctgacctcaagtgatccacccgccttggcctcccaaagtgctgggattacaggcgtgagccaccgcaccttgcgtgggagaaattttaagatttctgaaaaacaattgaacagggctttataataaatgagtaagctaatacagcattgtctagtagaacttcctttgataatgaaaatgttctccatctgtgctcatacgatagccacaagtggatatcaagcacttgcaaagtggctagtgtaactgaggaaatgaattttaactactaccataaagattcctttcacactgaggtctggtatttaatagaacctctggtagctgaggcttcctatgagctcatcctttccttggcattctttttttttaagagacaaagcctcgctctcttgcccaggctggagggcagtggtgtgattatagctcactgcagcctcaaacttctgggctcaagtggtcctcccacctcagcctcctaagtagctgggactacaggtatgagccaccacgtggggcatgagccaggcctttttgaagagtagaattctggttttatattttaatcaaaattatacccatattgattaattttgccgctaatgaatacatttctctactatttcatttcaaatgtttctattttgctcattatattttagctacacaggtcattccttttgagacagagtcttgctctgtcacccaggttgaagtgcagtggcgcgaccttggctcactgcaacctgcacctcctgagttcaagtgattctcctgcctcagcctcccaggtagctgggattacaggcgcacaccaccacacccagctaatttttgtatttttagtacagactatgtttcaccatgttggccaggctggtctcgagctcctgatctgaagtgatccgcccacctcagcctcccaaagtgctgggattacaggtgtaagccaccatgccccacggtcattcctattttttaaaaatgtcaagcacattactgctctagggcctttgacagctaatatttactgtgcctgggctcttcatatggctgatatggctggttccttctcatcattcaagtctcagctcaaatgtcaccttttgagaggctgtccatgatcatcttatctaaagagcttggccgagcatggtggctcatgcctgtaatcccaacactttgggagatgggcaggtcacctgaggtcaggagtttgagaccagcctggccaacatggcaaaaccccatctctactaaaaatacaaaaattggccaggtgtgctagtgtacgcctgtaatcccagctacttagaaggctgaggcagaagagtcgcttgaacctgggaggtgaaggttgcagtgagccaagattgcaccactgtactccagcctgggtgacagagtgagactctgtctcaaagaaagaaaaaaaagggcggggggggggggctcctatccccaggctctttcacactgtccagttttgtcctattaacagtacttggccgggcacggtggctcacgcctgtaatcccagcactttgggaggctgaggcgggcagatcacgaggtcaggaaattgagaccatcctggctaacacggtgaaaccccgtctctactaaaaatacaaaaaattagccaggcgtggtggtaggcccctgtagtcccagctacttgggaggctgaggcaggagaatggcgtgaacctgggaggtggagcttgcagtgagccgagatcgcaccactgcactccagcctgggcgacagagggagactccgtctcaaaaaaaaacaaaaaacaaaaaacaaaaaacagttcttaatcattatcttgtttacctcatgtaccccatttgaatatacattttatgaaagaagaggcctcgttgtcttgcttagaactaatagccgctggcacatggaaaatggagacctggaaaggttaagagacttttccaaagttgcacagctagtcagtgttggggcccgacttcatggctctcaattatgggctctttttgttaaaacatagctactttggcagggtgcggtggctcacgcctgtaatgccagctctttgggaggcccaggcgggcggatcacgaggtcaggagttcgagaccagcctggccaacatggtgaaaccctgactctactaaaaatacaaaaaattagccgggagtggtagcagccgcctgtaataccagctactcaggaagttgaggcaggagaatcgcttgaacctggaggcagaggttgcagtgagccgagatcgcgccattgcactccagcctgggggacagatcctaagtctctcctaataatgctttctgcatcacacacacacacacacacacacacaaagtagtcctttttttttttttttttttttgagatggagtctcgctctgtcacccaggctggagtgcagtggcgcgatctcagctaactgcaagctccgcctcccgggttcacgccattctcctgcctcagcctcccaagtagctgggactacaggcgcccgccaccacgcctggctaatttttttgtatctttagtagagacggagtttcaccacgttagccaggatggtctcgatctcctgacctcgtgatccgcccacctcggcctcccaaagtgctgggattacaggcatgagccaccgcgcctggcctaaagtagtcttttatccaactcctaatctatatttctggtagaagtaatccaaaaatcaaactaacacatggtacactttgttattgaccaaaaactgactgtaaattgcatcttgttgctaacgttgagaatggcaaaaactgtcccacacccatgagatctgtctgaaaacctaaactcaaatcactggcaaaataaatgtgtggctgactgaagcgatgtaagtaccaactctttttttttttctttgagacgtagtctcgctctgtcgccagggtggagtgcagtggtgcgatctcggctcactacaatactccgcccgcgttcaagcgattttcctgcctcagcctcccgagtagctgggactacaggcgcgggccaccacgcccgggtaatttttgtatttttagtagagacggggtttcaccatgttggccaggatggtctcggtatcttaacctcgtgatccgtccacctcgacctctcgaagtgctggaattacaggcgtgagccaccgcgcctgtccgtaagtaccaactcttcacaaaatttagatctgttaaataacaccagtgaaaaacgggctaaccagaaacaatggtcaccaaagaaaccctcaacagcagaagttacaagtaataattttatatggcaaaaaaaaaaaaaaaaaaaaaaaaaaagagaaacgaaaccctgggagacgaatcatactgcaaatcatatccctgggtagcagggcagaaatacaggtaaacaaaatagagaggagggggatgcctctagcccggaaataagtgggtggtggagatggttcttctggccatattcgtttaccttttttgtcagcagaaaagtactgagtctacaaagtaaaaaactgaccacgatgaaaatttctgcaaagtaattaaaatgggagaaaaatggaaatggcttaaatactcggtataaaaaatcgaccaaggaatcaaatgggctcacggatttgcgtcagaaacgttgcttccccgataattggtcaacgtcggtgtaactatgattaaaatgtcagtattcaaacaagggctccaacactaccgtggcccaagggcgtcttcggctcccaccccggggcgtgggcctgggggtccctcttcactgcgcagccacctctagcccgccgctttcgggactctcagccttcttttcccttccctgagggccggccggcaccacaacggggccaaaggcagtaactcggttgaaaggcgcgccctgggacaggtcagcgggctccgccatgcgcggcacgcatcccgcaggagcgggtgccagagcagggtaggccgggagttagcagcccagccaggccgctggactcgggctaggggcggggccagcgcagggggcgcaggcgcacaccgcctccgcggcagcatggcggacgcagctcctcaactaggcaagaggaagcgcgaattggacgtggaggaggcccacgccgccagcacagaggaaaaggaggcaggagttggaaatggtacctgtgctcctgtccgcttaccgttctccggcttcagactgcagaaggtgctgagggagtctgcgcgggacaaaatcattttcctacacgggaaggtaccaggaggcaaccctgaggtgggatgcgggaagcagtgaaccaatcatcgcctcggaggcagatttttttttttcggatctcggctggaaaataccaatcattatcactccggggaggcgggagtgcgccactagaatgcatagaggggcggtgaaaggcggcaagattgcctttgaaattaaggcaatgaacacatctagctctaatttttctaatgtctccactagaaatatctactgggagagtgcattgcagattaaagatcacatgttacattccccaagccattcatcatccatttatgtatacagggactaggaacccagtcaatgttagatgtctcgctcatccctgtccgtggaaacgacatgagactgtaggagatgtgatctctgccttacgcgacttcagccgtaacaggagaacaatatattataattgttaattcagttctacgcacgcactttcatgcatgccagacactaaactaggtactggggatgtggagacgaaagttaccatccctgatcttcaggactacggaatatttctggcgagacagatacacacagcttgctccaataccaacgtgctcagcaatctggcaggggctgaggagagatggagaccattccaggaactagtgaggaggcctagccagagcagatatgggggttccccagaaactagtgaggaggcctagccagggcagataagggggttccctagaactactagcaggaactctcacctttgggaggatcagggaaccttggcctaggcttccatgcctctgtgtgtatctggtttttaaatttttatttatttatttatttatttttgagacggagtctctcctctctgtcacccaggctagagtgcagtgatgtgatctcggctcactgcaacctctgcctcccgagttcaagctattctacctgcctcagcctgcccaatagctgggattacaggcccccgccaccatgcccagctaatttttgtatttttagtagagatgggggtttcaccatgttggccaggctggtctcgaactcctgacctcaggtgatccgcctgcctctgcctcccaaagtgctgggattacaggcgtgagccaccgcacccgccttttttttttttttttttttttttgagatggagtttcactcttcttgtccaggctggagtgcaatggcactatcttggctcactgcaacctccactttctggattcaagtgattctcctgcctcagcctcccaagtagctgggattacaggcatctgccaccatgcccagctaattttcgtatttttagtagagacagggtttcaccatgttggccaggctggtcttgaactcctgacctcaggtgatccacccacctctgcctcccaaagtgctgggattataggcatgagcgactgcgctgggccttgttttttgttgttttttgtttgtttgtttgtttgtttttgtttcttgttttctgtttttttgtatgcgattctgtctggttctctcagcccagctgtcttcagtgtgcagcacctgttgaaggtgttagtcatgagagccttcgagctaggagtcacttgggagacctaggttctggtttctgtttcaatgctgactgttcatgtgaccttgggcaagtcactcaaggtctgtttttcatcttctgaaatggggagaacttgacagaggtcttgtaagcctaaaatggaagacaactgagaagccttgtattctggggaagaaaggtgtgagaactgccacaaggatttgggtggagatgccttctctggctgggcatggtggctcacacctgtaatcccagcactttgggaggctgaggcaggcatatcatttgagatcgggagttcaagaccagcctggccaacatggtgaaaccccatctctactaaaaatacaaaaattagccagatgtggtggcatgcgcctgtaatcccagctactcaggaggctgtggcgggagaattgtttgagcccaggaggtggaggttgcagtgagccaagatcgcgccattgcactccaatccgggcaacagagcaacactccatctcaaaaaaaaaaagatgccttctctgagaaaagaaatgtgaaatgtgagtgccattggctagacttccccagagggaagacttcagggaaggaaatcccaagtattgggaattcaaaggccctgggagcttctgtcttgctctccagagtctcatcgtggttctgcccttgagcccactgatgatgcctctgcccacaggtgaatgaggcctctggggatggggatggagaggatgccgttgtgatcctggagaagacgccatttcaggtggaacaggtggctcagctcctgacgggcagccctgagctccagttgcagttctccaatgatatctacagcacctatcacttgttccctccaagacaactgaatggtgagcaagaggtggccagggtggctgtatggagggagaatgggatggtgggaaattaggtggtatggtgaccagactctctatacccgatttgcatattctagtacaatagggagattacttccctaggggacatttggccatcggtgaagacatttttgattgtcagaatcgggggtggtggtggggtgttgcttctggcatctagtgggtggagatcaagaatgctgctaaacaccttacaatgtacaggacaggctcccacagcaaagtaatgtcaatagtgctgaaactcagaaacctggccaggcatggtggcccacacctgtaatcccagcactttgggaggccacggcgggcagatcacctgaggtcaggagttcaagaccagactctcggccaacatggtgaaacctcatctctactaaaaatacaaaatttagctgggcatggtggcgttcacctgtaatcctggctacttgggaggctgaggtgggagactcgcttgaacccaggaggcagaggttacaatgagctgagattgtgccactgtactccagcctgggtgatggaacaaaaccctatctcaaaaaaaaaaaaaaaaaagagaaaccttgttgtagtgtagtatgttttagggagagagtgtgattcatgggatagaataatatatatatattttttgagatggagtcttgctctgttgcccaggctagagtgcagtggcgcgatctcggctcgctgcaacctccgcctcacaggttcaagcaattctcctgcctcagcctcccgagcagctgggattacaggcgcccaccaccacgcctggctaatttttgtatttttagtagagtcagggtttccatcatggccaggctggtcttgaactcctgacctcgtgatccacccgtcttggcctcccaaagtgctgggattacaggtgtgagccaccgtgcccagccagaataatagattaatctactaattgaatgataaaaattgtcaacaacacttaggaaatccttactattgtatctacatgtattaacacagttaatcctcaaaacagccctcttgtaaggaggactttacgaatgaggaaaccggtttttgaaaggttaaataacttgtccaaaatcacacagccagtaggtggcgggaaagctaaggtttttcagtagactggggtcttgctcaccatactcattctgtgggccggccagtgtgtctggtgctgcaaaaatcagtcacttccctgaaggaacctactttctggtgggagagacaactagtgagatcaagggggatgggagagaagggcaagaactcgtgggttaaaaggcagagatttgtttttcattgcaagcatttcttaatttattaaaaagaatattccatgccaaaagccaggtgtgacatgtgcattttttctcaagatggttagattttgtaggcagctttgttggaaacatgagtgagactggttgaccttaaagattccttccaaccagcaaattctggaatttgttttacagcacatggtgactttgtcatatccttctgtcttcttgtttgccctccagcatttaagagcggtctggctttgcagatatcttgccccacagtcttttgatagatattcttttctgccctccatgaaagggtgctattgttgtcctttggaaatatgtgaacacttcatggtgagacaagcaaacctttcatgacttaatgcaaaacagccttgtcttccattgagcaaaagccagattaattggtgcaagttgatggaaatggacagctgtatttcctttctcaggcagtgacgtttaagcaaatgtattcctcagcacagggcggcagaagaatgacagaaggcaccgtggccaaacacaacttggggtggccccctgcattgcaggctctaggggctattattttactgccacaccctttccctcaccttccgaaatccctctacccaccctccccacccttggccaaaattcagaaggttctgcccgacagatgaaccctgtggaattcacaggctgtcctttttattttcccagtccttctgtggcattgcacacaagtggaggtagtccctgctcgccctttctgtttctattgtttttcccaagataagcactgaaagaggcagtgggttattggcccaccacaagtccttgttcccactcagaaccccaggtgtctccagggccacccccacccacctgggagcctcagatgttagttcatcttttcttttcctgcccctttttttttttttttttgagatggagttttgctcttgtcacccagactggagtgcaatggcacgttcttggctcactgcaacctccgcctcccaggttcaagtggttttcctgcctcagcctcccgagtagctgggatttacaggcacacaccaccacgcccagctaatttttgtatttttaatagagatggggtttcaccatgttggccaggctggtctcgaactcctgatctcaggtgatccaaagtgctgggattacagttacaggcatgagccgctgcccctggccttcctgccttcttggtatataagtcatccctcagtatccactggggattggttccaggactctccttggatactaaaatctgtggatgctcaagtccctgatataaaatggtgtagtatttgcatgtaccctaagcacatctcctgcctgctacaatgtaaatgctatgtaaatagttattataccatgttttttaggtaataatgacaagaaaagtctgtacgtattcaatacagacgcaatgtccttctttttttaagtatttttattcttcatttggttgaatccacagatatggaacccacaatacggagggccgactgtacatgcggtgcctttcgctcctgcttttcctaccaaaactagggatggggatttggaagtcgcagcggtttgcttcagggcccggttgctcccttgtttagctgcatagcttttccctgggtgatatttgaggtcaggattgtcaaactttttctgtcaaaaaccaaagagtcaatattttaggccttgtgaggcacaaatggtctctgtctcctcttcttcttttcctcccatcttccttcccaaccccttcttcttctgccttttctgccttctccttccttcttctttttctcaacccctgtgaaaatgaaaatatcactcttggtttgctgattgtacaaatagaggtccagctggccatagtttgttaacctctgttccagatttttaccactcaaagtgtggtttgtgaaccagcagtattcgcaccacctgggagtctggtaaaacagaatctcctccccatttcagactacagaatcactggagtctgcattttagcacaactccctggtgagccatatgcacgtaaaactttgagaggcactggtctttaaaaaaacaccatctgtatgccggcgacgcccacctttatttctccatccttgacctctccaagaactccgggctcatattgaaataaagccctccttgacatctccatttggaggtctcataggtgcaattcaagaatccgatgcgctaatgtacttaaaagcactgagcacaatactaagtagtagctgctgttattagtctcatgtgccaggccctatgccgcgtaccgtagcttcagagatgagtaagataccatccttgccctcacagtcttgtttggggtcaggggtggggacatagtggtgaaaagaggagagtttggtcactgcctggatataaggggtgaggtcctcgaaggttggagccatgtcgcccatattaggtgctttcaataagtgaagaatgaacccacaaactgacctatgtgtagatttgttttcctgtgggctgggcattccacagccacaaggtggcagcattgccaaaatagtcctgtggcccactccagctgtcccctctgtgggaaggccagctaagtcagagcctgggacctccctctccagtcccagccttggagtcaactcaatgctgcccaccccgagggccctgaatgtgcagttcctgcagcctcagccctctgtccccctgcatggttgtgcctttgagtttttctgctgtctctggctgcttctttagacctccttcctagaatactgtttgcctaggggagcccccacccctcatttctgagctggccacagtagaaatcatgggctcagctgatttttttctggtattcctctggtcactggcaactttcttttcctcttcaagtctggaggttttgcagtctcctcattcgtttatcccctccacgttctcagctgactgcaagaggctgctcgtgtgagccactcatccttccagctgcaatgtccatcccaacgacataatggagagagcatgggctttaggagttagtcatgctggggcactcatgctttctcatggcatgcactggggcagcaacatgctgtttctgagttttagcacagtgccagtgctgagaacaagcctcacgtcaggcagacctgggtgcgaatcctggctttgccatttgctaaccatgaggacctgggacatttctttattcatttaacaaatgtgaagtgtctgctatgtgccagctactctagtagaagcaaggtctgtgttggtgaagataaccgatgtctccctgtctttgcagttctagtggggaaggcagacagcaaacaaggaagcagatgtctgagtggccatgagcaggagagagcctactcagaccagggctctaggagggctctctgcagtggagctgacacccaggctgaggcctgaaagatgggaagaagccagctgtgcaaagaggggagaacactctgggctgaggaatagcacgtgttctggggatggaaagaagaacagaaatgaggctgttatgtcaggagtgatggggtgggatggtggcaggggtgtgtactacagatgaagttggggaagtagcttcagttattttctgttaaattaggttagaaactgaacttacctcagtgggtaggttatgaaacacataaggaagttttcacaactttagccactgcccgcagtgagagatatgtttcacattatggtctattacacatggactaatagacatgaatagaaatgaaactttatttattgagttagttagttagtttgtttttgagacggagttttgctcttgtcatccaggctagagtgcaatggcgcgatattggcttactgcaacccctgcctcccgggttcgagtgattctccagcctcagcctcccgagtagctgggattacaggcatcctccaccatgcctggctaatttttgtgtttttagtagagatggggtttcaccacattggccaggctagtctcggactcctgacctcaggtgatccacctgcctcggcctcccagagtgctgagagtacaggcgtgagccaccgcatctggccagaagtgaaactttaaacaatgcttacccatccgctatggcatactctgtagtatttcctatctagtttcagccttattggtttccttttttattttttaatttttaaaattatttatttatttttggggcagaatctctctctgtcacccaggctggagtgcagtggtgcgatctcggctcactgcaacctccacctcccgggttcaagccattctcctgcctcagcctcctgagtagctgggactacaggcacccgccaccacacccagctaatttttttgtatttttaatagagatgggttttcaccacgttggccaggctggtctcaaactcctgatctcgggtgatccgcccgctttggctgctcagagtgctgggattacaggagtgagccaccacgcccagctggtttccttttttaaaatgctggtcttaatcccctaaattgacttcatggccactgtcctggattaggacccattaagagaaggtgtatagagcacgtggcacagtagctgtcatatggtctgtatccaataagtgtaattatggtgttgcctcttatttttttccacctttcaatttatgtgagctttaaatggaataatatatataacatggaaaagtgactggctctgcccatgggtaggtttcctttcttcttcctgttgctgtgtggcacatgtgaggagctaatggcccgaaggctggcacctgagagcttcctctgaccctccaggctgggcagggcctgcatctcctttctgccatagctgtcaccctgcggcctgtcaatggagccctttattgcggtctgttctcctttacctggggaagaagggggagatagcagggagagaggtgtggctcagaaatccaggctgcctcttcaaaggccaattgtttccccgtgtaaaccaggaggtgaaatctcaagttcagaagaggagacaggcatttgtgagtgaggccagggcggggagcagaggggtgggatcctgggaatcgtttctctggttgcagggaactcccggtactgtagccacaggccagggttttccgccctgtgctatttgcagaggcaaaacccggacctcctgagggaggggtgaggacttgtttggaaggagcattttaaaagacaagtcattctcagaagagtttgcttggtagcattgttaatgatagaacaaactagaaacaatcaaataacagtagagtaggtagataaaccgaggtatagtcctacagtgcctagctacagcagtgaaaatgaactacagctgcctgtatcaatgaaggataaatctcaccatgtagggcaagaaaagcatgacacagaatacacatggtgcgattaaaatggtacaaagttgaaaaacaagcagaactgaacaatatactgcctagggatgcatacatgtgtaataagactatgaggacaaaaaggaaatgattaacccccaaatcagggaggtgattatccttggtcggggtgtggcaggacagagagaatgttaaaatttctggttatattctgtttcttggattgtgtgttctgagcatatgtattctttttattttacttaggtttttaagtggtacatattttatatacatacacacctgtgttttatatgtataatgtatttcccagttgaaaggtaagacaaattggcaggtccttagatggactagaaagatcgtcccatgaatttcaagggctgcatcctcattctgaagtgtggttttcagtcacagttctcaaagtgaaggtatttggtttcagcctcctacttctgggttttaggcatttgtggactttcatttctgcaggcttccccttctttggggtgtggggatggctgggccagccgcttttctccccaatgattgttgttctcttctttgtgtccgtatgtcctcaacgtttagctcccacgtataagtaagaacacacatatttggttttctgttcctgccttagttggcttaggataatggcctccagctccatccatgttgcagcaaacgacatgatctcactctttcttatggctgtatagtattccatggtgtatatgtaccacatttctttattcagtctagatgttggtgtggatgcagtgaaaagggaacacttctacactgttggtgagaatggaaagtagtacaaccattacgggaaacagtgtggaaattccttaaagaactaaaagtagatctaccatttgatccggcaatcccactactaggtatctacccagaggaaaataagtcattatatgaaaaagatatttgcacatacatgtttatagcagcacaacttgcgattgcaaaaatatggaacccacccaaatgtccatcaatcaacaagtggataaagaaaatgtggtatatatcataccatggaatactactcagccataaaaaggaatgaaataatggcatttgcagcaacctggatggaattggagactattattctaagtgaaataactcagtaatggaaaaccaaacattgtatgttctcactcatatgtgggagctaagctatcaggatgaaaaggcataagaatgatacatgggacttagaggaaagggtggggagtggtgagggataaaaggttatacattaggtacaatgtacactgctcaggtgatgtgtgcatcaaaatctcagaaatcaccactaaagaacttattcacgtaagttcctacctgttccccaaaaacctattgaaataaaaaaataaaaaaatttaaaaaaattgctctaccgtaaagacacatgcacacatatgttcattgtagagctattcatgatagcaaagacatggaatcaacctaaatgcccacttgagggtggagggttggaggagtaagaggatcaaaaaactccctatcaggtattatgcttattacctgggtgatgaaatagtctctatgccaaacccctgcgagacaatttacctgtaaacaaagctgtacatgtaccctttaacctaaaataagaattaaaaaaaataaaaagaatatttctgggctgggtgcagtagctcatgcctgtaattccagcactttgggaggccgaggcaggtggatcatttgaggtcaggagttcgagaccagcctggccaacatggtgaaaccctttctctactaaaaatacaaaaattagatgggtgtggtggtatgtgcctgtagttccagctactcaggaggctgaagttggaggattgcttgagctcaggaggtcaaggctgcagtgaactatgattatgccgctgcactccaacctgggtggcagagcaaaaccctgtctcttaaaaaaaaataaaaagagaaaagaaaaccagtaaaaccattaaggagtatttacatgattgaggccatattaatatgcatgctcaaccagagtgctaagtttctagtttttcctccacctgcccagtgtatcatctccatgccactcaaaggagattgctttattttctctttgagacagtctcagtctgttgtccagactggaatacagtggtacctctcagctcattgcaacctccacctcccgggttgaagcgattctcctgcctcagcctcccgagtagctgggattacgggtgcctgccaccacaccaggccaatttttgtatttttagtagagacagggtttcatcatgttggccaggctatctcaaactcctgacctcaagtgatctgcccacctcaccctttcaaagtgctgggattacagatgtgagtcaccacgcctggctggagagtgcttttgatgtccaggtcgagtggattctcttttcttgcattccaacagtccttcaaatcatgctgctttttagtttgtttcatatttgaaccactgttttattagcttttactttttcatggagtttttagttgcctcttttttcattgtggttaaaggaataatgtacctttactctgctcttgaaattatccagtgtgataatccattacatcaagcttgtccaacccgcagcccaggacagctttgaatgcggcccgacacaaatgtataaactttcttaaaacatgagattttttccgtgatttctttttttttttttcagctcatcagttattgttagtgttagtatatttcatgtaaggcccaagacagttcttcttccagtgtgacccagggaagccaaaagattggacacccttgtattacatcatatttccttccttgctggtaacattgtttccagaaagctctttcctgcttctccaatctggacaggtgattctttaagcaagttgttcaggtctcaatctgagacttccttttgcaacttctgtgagttagatgttttctgtattctacgtctgtttctttcttgttttactctcttgattagctgaagtacattttttttttttcatgtttttcttgagatggagtctcgctctgtcgctcaggctgtagtgcggtggcgtcgtgatctcagctgactgcaacctccgcctcccgggttcaagccattctcctgcctcagctcccaagtagctgggattacagacacccgccaccgcgcccagctaattttttgtatttttagtagagacagggtttcaccttgttggccaggctggtcttgaactcctgacctcaggtgatctgcccacctcagcctgccaaagtgctgggattacaggtgtgacccaccatgcccggcctctttttttttttttttttttgagatggagtctcgctctgtcacccaggctggagtgcagtggcgcgatctcagctcactgcaagctccgcctcccaggttcatgccattctcctgcctcagcctcccaagtagctgggactacaggcgcgtgccaccacgcccagttaattttttgtattttttagtagagacggggtttcaccatgttagccaggatggtctcgatctcctgacctcgtgatccaccctcctcggcctcccaaagtgctgggattacaggcgtgagccactgcacccggcctcccggcctctttcttatagtctggtagattgtctgcattttgtcttctagaccttctagtgaaggtgttaatttgacagtcatattttaaattctcctctctctggttctctgattatttcattctcatagcattttgctctttttttttttttattgaggccaaattgtgttgaatctctctggcacactaattagaattatttttaaaattatctcctgaccctcaaattattttatttcctctgggatctggttgtttatcttggtcatccttattcaggctgctggtttctttcaatggctgctgattcacatgagttcactcatatttcacagtgcagcacagtgtggcatgtccagtgacattcattgagacttggtacccgtgcccctttcagagtgaattaaagacatgccttcaggcaggaagttgagagaggccatattttggagtgttcatcctacagcttttattgtggtctggtctgctcaaccccagcatagtttctttctgtgtgtggagaagtgggggggctcgcggctctaaggccaagcctgtcacttcatagctccctgacacattgcacattagctcttgctcttcctgttcacacggagctttgcagagtgccattagccccacagccatcctgaagtcgcgtttcccactctctatccattgtaactgagggcctctcctgccaccccagggctgcatttggagttaccaaatttgcttgtgggccaggagaccctggagttttgccatccggtcctgttgcctccctaccccctctgctttctggacttcagaggactagcgagagggagggaaggagctgagggtttgtacaagaagcctgtcagatccagagtcttgctaaagtcagcgtctgcctctcctctgtctctaatagcagctctgtgctttcctagagacaggtaattagtggttagaggcttgctgtggagtggttgaagtttccagtaggatcctgaccacacccttcagccgtgtttatccttgatgtggaggtctcttcgggcttcacttgagcactttcagtatttctgtaatgtaggacagagaacaccctgccttgcttggcctgggaccagaggatgacttaagatccacggcagccagccttccctccaccctctggcctggtctccccgttaccatgcagccagggctgaggagagtgtcgcctagccaggggacatcccacagaggaggaaagagaaagcagatccaggagagcctcccaccaacctctcgttctttcaggctttctctggcatgccttgcgaagtccggttatctgacccatccctggctggctctgcctggctcttgtggagaggacatggcgggtgggcttcgactcagatcatgcattgctgttgcttcttctcagtgctcctgggcctgcacatctgggttaaataagttaagctggctcctctgagcaaaggggaagcaaaagccacagactgagccatagagatgagctcatcctgtagaagccatcagcaacggctggaaagcagtcttgtttgaacatgtgtatgggaaggagagcagactgtctgtggtttgtgttttcatgtttcatgtgcagcagcattttcctggggatttggctaagctagctttggcagggagcagagaggcagctgctcttaactttcctctagatagccctgcctcccacctctgagagcagttgggcttttgtgtctagacgggggacaaagggtggctttatatattagggaagggcttgcagcagatcctcagggtcttgatggacaagtcagagctgtgttagtccggggcacatcagcctgctcatctgagttgcagagagaaggaacatatgcctagaggggcgcttttcagctggaggcatcactatcatcattctcgccgctagaacatcctgtagatgaagagctgctgccctgaactccaccaggcccctcttctgggacttcccccttcatgcctcccaccccataatctaacactgctatacttggtaggggaggtggtaggggacaggatggtaccacaaatgtaggccaaaacagctattgtttctagttgtgagccagtctggaagcaaggtcctcttccgtccctttgtgctccccccagaacctgctgtcccgcagcatttggccacagtatcccctggtaaggctgtcctcacacggctctccagagctcaggggagtggactctccttccctgagctccccaggaagcatcttggagggcacaagcagagcatgagcagtgtcatctctgcatgtctgaccacaccccctgtctggacctcacttgctctggcacctcattttgccctctggtttcgctgacagctgtttacgtgtctctaggaagaattggaactagtcatgtttctcctatctgatagggctgcttttggaaaacatggccccagcacaggtatcttaggaacggcccgaaagaggttgggcctttgggatacgggagtattgcatagaggaaccagactgcctgggttcagatctcagctctgccactattaatagctgtgtgtccttgggcaaattactcaacatctctggggctcagttttaaggggtagcttccttttaacgtatttgttacacaagtgatatgtaaatatatataactccatcatccaggattgatctctcttaacatctcagagtatgtcctttcagattttttttttttttgagatggaatcttgctctgtcacccaggctggagtgtagtgaggcggtcttgactctccatctttaccatcctggccaggctggtctcaaactcctgacctcaagtgatccacctgcctcagcctctcaaagtgctgggattacaggcatgagctacggtgcctggccgtaatatattctgttctacagactgtactgtgaggtctaatcagtgtcgggtgttatcttaggcactgcacacacagtgtacgaaacagagtccctgctctcgtggacttgatgttccactggagatgatcttaaagaacaagcaagtatgtcacgtggcaacaaacagcaaagattgaaagtaaagcatcataagggagacaggaggacagggacatgggcttctagtgcaaaggggacagtttgaatgcccacctacttcctttatagcctgctctgacaatgatattaaaggaatattcttaaaaaaaaattaacccatcaagactacaagggcggggtgcagtggctcatgcccctaatcccaacacattgggaggccaaggtgggtggattgcttgagcccaagagtttgagaccatcctgggcaacgtggcaaaaccccatatctacaaaaaatacaaaaattagccaggtgtagtggtgtgtgcctatagttccagctacctgggaggttgagacgggaagatcacttcagtccaggacatagaggctgcactccagcctgggagacagagccagaccctgtctccagaaaaaaaaggagaggagacaacaaaatttccaaacctaggatacgtagggaggagcagtaactggatctgagagatgacaccttggccagcagtccctcaagtctgctttcccatttcatatggaacttgctccttccttgccccagcaggagagtagagcagaaatgtctggagagggtgacataccaggtagccagggaaggtggctcactcctgtactcccagcactttgggaggctgaggtgggcagatcccttgagtcaagagttggagattagcctgggcaacatggggaaaccctgtctctacaaaaaatacaaaaattagccaggcatggtggtgcatgcctgtcatcccagctactcagtaggctcaggcaaggggatcacttgagtctgtttggcagaggttgcagtgagccaagatggcgccaccgcactccatcctgggtgatagtgggaccttgtctcaaaaaaaaaaaaaaaaaaaatcacacgaagggtgacacaccaggtctggaagagattcaaggtacagctgagagtggggtcagggcactgaggtgtggagagatgagtggatgtttacaccttgagcatttgcagtgttgccgtgatcccccggcccccatccagctgctgccctttctcatccccagaatactgtcagccaggcttatagctccatatgtgcaattggaagtcatttgtggagaatctgcccagcccgagagaaaacctaaactattgaggttccctaatacaaaagaacagcctgaccaccttaacacgaagctccaggtgaccacagcgacacccacagagctgcccttcaggagggagtggacaggcaagggtgagcagactctaaataaagcctcagctgaaaaagagaagacaagaaaaagaagggaaggaaaagaaacctagaggagacagaaactgtgtggggagaagacatttcaagaactataattaatctcagagaaattatgctgctatattgaatgtataagaatattatcaataaggaattttattaaagctcttggaaattaaagatacagcagaaatggaaaattaaaaaaatagaagagtagaagatgaagttgtgaagaaaacttccttaaaagttgagcacaaagacaaaagagatggaagatggagaaaagataagaaagtcagacgctgaatccaagaagttaaatatccaaatgggtgttgcagaaagaaaaggcagagaaaatgaagaagaaaggtctttaaagaaataattcaagacagtttcccaggtctgaagaacatgatttttaagattgaaagggctcagcaattacctagcacaatggatgaagataaaaccactttgagatccaaccacaccatcagggcattggagacagaagaaaacaggtcacaaagaactgggcatcataatgatctcagactccacaacaacagcattcagatcttcttatttttatttatttttatttttttgagacagagtctcactttgtcgcccaggctggagtgcattggtgccatcttggctcactgcaacctccgtctcctgggttcaagcaattctcctgtctcattctctctagtagctgggattacaggcgcacaccaccacgcccggctcatttttgtatttttagtagagatggggtttcgccatgttggccaagttggtcttgaactcctgacctcaggtgatctgcctgcctgaacctccgaaagggctgggattacaggtgttagccactatgcccagccagcattcagattttctttctatcctaaaattcctttttttttttttttgagacgaagtctcactgcgttgccaggctggagtgcagtggcacaatctcggctcactgcaacctccgcctccgaggttcaagtgattctcctgcctcagcttcctgagtagctgggactacaggcgcgtgccatcacgcccagctaattttttttatttttagtagagacggggtttcaccatgttggccagtctatcctaaaattctttagcaagaagcaaaaaaatttttttgagacaatgtctcactttgttgccaggttggagtccagtggtacagtcatagctcatggcagcctcaaactcccgagttcaagtgattctcccacttcaccttcccgagtagtggcgaccagaggcaggtaccaccacacgtggctaatttattattttttgtagagatggggtcttgccatgtagcgcaggctggtctcgaactcctgggctcaatagatttcccccctgtttcagcctcccaaagtgttgggattacaggcatgagccaccacacccagccaccaaattcctaagtgtgacagtagaataaatatattttcagatgtttcaagtctcaaaatatatcttgcttgcaccatgtctctgggcacaacttgagtttgtgattcacagtttacaaatttgataattctgtactgttaccaatagttacaagagacctttttaatcctcttatctgggaaacaattttcaaaatacaattattgttttaccttgagcggtagaaagttcagctttagaaacattgtgtttatttccattgtaatattatatatgcaagctgatgcatgtatttttcaaagcaggtgtactttaatggttaaaaaaatacacatgatgcagaaagttctttgaacaagtaaggcattcaaacaattctaaatgtattaaagttgcatttctttcttttcttttttttttttgagacagggtcttgctcagtcacccaggctggagcgcagtggcacgatcacagctcactgcagccttgaccttccaggctcaagcgatcctcccaccacctcagccaccagagtagctgggactacaggcatgtgctatcacacccagctaatttttgtattttttgtagagatagggttttgccatgttgcccaggctggtctcgaactcctgggctcaggtgatccaaagtgctaggattataggcatgagccaccaaacctgaccctaaagttgtttttttgtttgttttttgagatggtgtcttgctctgttgcccagactagagtgcagtggcgccatctcggctcaccgcaacctctacctcccaggttcaagcgattcttccgcctcagcctcccgagtatctgggattacagaagcaagccaccatgcctggctaatttttttgtgtttttgtagagatggggtttcaccatattggccaggctggtcttgaacttctgacctcaggtgatccgtccgccttggcctcccaaagtactgggattacaggtgtgagccactgcacccagccctaaagttgtatttctacagttattgtattcacataacagattgcagtagcaaaatttttttttagtataatgtttaaattttatttttaactgacaaataattgtgcataatgatttctgttttatgctctggtggaaatttgaatacctatctgctgatctacttggtaaattatttcagagaattgaaaatattttcacagttttcctaatgaaaattccaagaattggatttataataataataatgccacactaaagtttgagaattacttctgggggtggcaaccggaagttctgggaagacacattgttcatgtgcctgttgagtttttttttttagacagggtctcactctgtcccctaggctggagtgcagtggcgagatctgcgctcatcacaacctccgtttcgcagctcaagggatctcccacttcagccttctgagtagctgggactacaggcatgcaccaccatgcctagctaatttttctgccttttttttttttttttttttttttttggtaaagacgggatctcactatgttgctcaggctagtcacaaatccatggtctcaagcaatctccctgccttggcctcccaaattgctgggactataggcatgagccactgtgcctggcttgcctgatgagtttaacacataagaggagatttatgtaaacagggaagtggatttggggatgaattagtgacatgtttatagaaaattaaacaagtggccagaatttgggtggagatgccttctctggctgggcacggtggctcacacctatatcccagaattttgggaggccgaagcgggtggatcacctgaggtcaggagttcgagaccagcctgactaacatggtgaaaccctatctctactaaaaatacaaaaattagcggggcatggtggtgggcacctgtaatcccagctactcactcgggttgctgaggcacgagaatcgcttgaacccaggaggtggaggttgcagtgagccaagatcgtgccattgcactccagcctgggagacacagtgagactcagtttcgaaaaaagaaaaaaaattaaacagtaaaaatgtaatgacttattccatacaccaaaaattatgctgaagagaagaaaataatcacagtaactatggcagtgaacagcatttacatcatcatcatagcatcagtgttgaatactgatttatcaaaaattgtggtaaagttgtactgtgaggttgagggttaggaagtatctgtgtatatgtgtgtgtttgtgcatgtgtgtgcatttggtgaagggatggtaaaaagagataaattctcatcttccttaatgagaagtcagtaagtaatagtagaagttaaaagtcaagtaggaacaagatataaaagtataatttagaattctggaagtatataaccaaagaggtggccagaagtgttgaaagtggtgcctttgaaggagctggaaattgggagcagggaggagcagaaaagtgtttttgaaaacaagcttcatttgactctttgacatatatgcaagtacaatttgaattaaaaagacaaacacagtgttaaaaagcatgacaggggaactctgtaaggagtgttggaggtgctcttaatatattgtgaagattttccagggatagatttttgagggtttatggttatcccaggctgtgtttggagaatgccagcaggaaggccaggcgcggtggctcacacctgtaatcccagcactttgggaggctgaggtgggcggattacgagatcaggaaatcgaggccatcctggccaacttggtgaaaccctgtctctactaaaaatacaagtattagccaggcgtggtggcgtgggcctgtaatcctagctactggggacgctgaggcaggagaatcgctgaaacccaggaggcggaggttgcagtgagccaagattgcaccactgcactccagcctggtgacagagcaagattccatctcaaaaaatacatataaataaataaataatgagaatcccagcaggagggtgggactggggagttggtcagttctctggctaccaggaagagctctgggcaggggtgttgccaggtatcactcatcctgagcaggcggtgccctcagtccacttgccagacagcgtatggcagggagagcctggcaaggccaccgggcctcttctgctgacctgccgtgggcagatggggctgccagtgtgggtcccggccctgagcaccacacggggctgtgggtccttgggggccactccaggccctgggcctcagtttcctcatatgtaaaatgcaatcataataatacccgttcatgttggtcataaggagtaaatgagttcatttttgcgtgtcaggcttagaatagtgttatagggctgaggttccgaaaggtattgacaccttaaaaaaaattttcctactaaaaaaaattccaatcctgcagaaaagttgtaagaatagtacaaagaactcccttataaaaggacttcacggccgggcgcagtggctcacgcctgtaatcccagcactttgggaggccgaggcatgtggatcacgaagtcaggagatcgagaccatcctggctaacacggtgaaaccctgtctctactaaaaatacaaaaaattagccaggcgtggtggcaggcgcctgtagtcccagctactcaggaggctgaggcaggagaatggcgtgagcccgggaggcggagcttgcagtgagccgagatcacgccactgcactccagcctgggcgacagagcgagactctgtctcaaaaaaaaaaaacaaaaaacaaaataaaaggacttcacctgttaacatttgccacattggctttttctgtctccacatatacgtagaataatgataacgatggatataaaaaagggtaaaattattaatttcaggagatttcccattcgtatgagacttctgtgacatacagtccatagttaagttgtgccagttgcttcagtgcagggcgcccctccccggatcccaaccccggatctaatccaatccctttagtcccgtctctttagtctcccttcatctggagcaattcctcagccttctttgtccttcctaactttgacatttttgtagtgttataaagccactagttttgttgaatgcccctggattttggtttgctgatatttcctcatgactggactcaggttatgcgtttttggccagaattccacatgatcaggaggcacatgatgtcggcgtgcccagcaggggtgacggtgacgcccatggcctggccgaggtggtagccttttgctgctgtaaagcgactcgtgttccctttgtaattaataagtaatctatgggagatatttttgagactgtgcctgtgtatcgtgtttcccaacgtgttttcacctgatggtttgattgtttattgagcattgactcctgaccaaactcctcctgaagttcagctgcaggtcaacatcttgacgggcattgaggtaaacaccagcgttcattgttttttggctgccatcgtaaaccttagcattaggaaatatattgatttgtatcagagaggttttatttcatctgggacaaaaatgctcttcctgggtttaagtcgaaaaggccagattcattgattcatttgttcactaagtatttactgagtgcttactgtatgccaggcactattccaggtgctggggacaaattgttttcttccggaagctgcatagtagttggggagtcagacagtccatccacctgctgctgtgagggagtgagaagtgaagaggaagcaagctggtggaggagacagaggaccccgaggttagggctgctgttttaccagagctgaccgagcctgaggagctggcctcagagcagaggcctggatgaagcgaggagcagcgtggctcgttgggtaggagggtcagctcggccgtgggagcggccagggcacggcctggagaggagcccatggctgacgcgagttagtgggtcagtggggagccggcgcggctggagcagaggccctaagcgggagagaggcagtgcatgaaggtggaaagagggccagggcgaggtgaccaacagcctcgtagtccacggcaggaagcgcgggagctgtggagcaggggacagtttgagggtggcagctcccacctcagtgtggccctgactgaggctttcggtggagacctgagggaagccaggccccttaggagtgagtgctctagggggacgtggggagctctgagagtcctgcagtcaggttcccatccctgcaggtgcacctcaggaaaggcaggaggatggcaggaagtgagcagttggaaaataagcacctgtggatgctcttgctgctgaggggaggcgggaggggctggctgggtgagacgccagtttccctgcaccctgggtggctggggcaggtctcccacaggcctcggcagaccagggcatgctcacaggccgggtggctttctgatctggagcagccaggagccccaggctgggagcccggctgggtgaccctgcccgcagaacccggctgctctccagcgcccgctctgcctctgtgccctgcccatctctcccccactctcagggagctccactgcccaacccaggcaacggaggcaacagcggagagaatccaagctagcctggggggagcgcttttctccatgtgaggcacttcctgaatctttccttctactgactcgtttaattctcccaacagccctggaaggtaggtgctgttattgttaccccagattgtagaagtcaggagactgaagccacagacagtgtcagtcactagcctgaggttacgccactaataagtgcagagccaggacttgcacccaggctgactggctccaaaatctctgttctcatccaccaagctccactgcagatgtatggatttccctcaggtccactgcaagggccaaggtggtgccgttcagtctacttcaagcagtctcccgcctcttgagatcttggtgtgcctgacctctgacctctggcccatgacctatgacgctgagctgttagagaacagagtgagaagcaagaaagagtcttttgctgctcctcagagagttgtgaggaggccttcatgcccctttttcagggtcagatccggggattcccaggattgggtgacatttatttagcaactcgtgatccagctgacacgttttattgaatgtaaacaactctgtgaggcagatttgatgaccaccctttaataggtgaggaagccaaggctctaagacgttaagccccatgcccaagggtacacagccagtatggagagtcatgtggccagcctggggccagtggccatgtcttcccactgtgctgctgtgccacccagagctgagggcctgggatgtttgatgggacagaagccacgtgcctggtatgtcatctctgtgcatccccactgggacttggaagtagaaattggaagtagcctgtggtgttgcaggagcactggctttagggtgagatggcctcagttccaggttcgcctctgccacgtttcacggtgtgatactggatgactcttttgagtcccagcccaccctcttcactgacgtatgaaagcggggttaaaaccacctatgacctcagaccaaatatgaaagtataggttgatagttcttagccgggttttgcggtgtgtgagtgagtatgaggacttcgtggtggtgaaatgtgcccgctgggttttcagctctctcgggtttccctgggagagcctatccgaacccagattaagaaagtcagagggaaccatgggtcttttgagaaagatccaagctgatttggaaatacccctaagatctatgttaaaacacaatgtatacatgttagagtaatgatgacaattgtaccagatgtttttaaaaataaaggaaaggacttaaccaaaaccaggtggttttggaccaggaagctagcctagagtctgtttaggaaaactgcaagacatccttctagtttaaaactgtgcttctcacctggggacactttttcctttcaggggacacattggcaatgtctggagacattttgggttgtcacaacttggggagggtgctactaacatcccaacagaggccacagggatgcagctgaacatccttcaatgcacaggacagcccctgcaacagaattatccaggccaaaatgtcagtggtgctgagattgagaaaccctggattaaacatcacagcacttatgtggtgtttactgtgtgccagacattgttttaagaacttcacaggtaattgacttgtttaatcctcccagccttatgacacaggagcttttactatcctcatttggcagatgaagaagtaggggcaccaagaggttaaacagctgaaccgtgctcccgggtggggccaaggtcccattcagaataaggagcaggcagagccaggacttgaactcagtctggctgcagagtctgtgcctggaaccactgcgctctgctgcactgcccatcattaaggggactactgggctttaaaccatatatatatatatatatatatatatatatattttttttttttttttttttttttttttttttttgagatagagtttcactcttgttgcccaggcaggagtgcaatggtgcaatctgggctcactgcaacctctgcctcccaggttcaagtggttctcccgcctcagcctcctgagtagctgggattacaggcatgcgccaccacgcccggttaattttgtatctttagtagagatggggtttctccacgttggtcaggctggtctcgaactcctgacctcaggtgatccgcctgcctcggcctcccaaagtgctgggattacaggcgtcagccactgcgcccggcctttaagccatattttcagctttgggtccagaaagccacatacctagaaatttggtatgtgagaagagttagagacctctcattcctgtgcctggaagatggagcaggaagggctggggtttgcctgatgaggggcccagtgacccacaggtaagaaccttgtgttttccagattctgagtgtggctcagctcgtgaatgcagtggcacaaggcactctgtgggagtggatcttgggtgcatgatcctcttggattttggcttccctcagggaatcaaagccagggtgggagttctctcctcaccgtggtgcctgtggcatagagagtgggcattgcttccctgtcacgggctgtgctgtatcattgcagatgtaaagacgaccgtggtttaccctgccacagagaaacacctgcagaagtacctgcgccaggacctccgcctgatccgagagacgggagatgactacaggaatattactttaccccacctggagtcccagagcctcagcatccaggtgactggctgcatgtctcagacgcagagcactgctcccgtggctggtgcctcctcttacgagtgtctattggggtcatattaggggccaggcgctgtgctgggcgaggggatgggggtacagtagagagcatggcggacagaatccccacctcgtgcagcttacatcccatgcacagtcacacggtgtgtgaccatacacagatatctcaggatctatgtgctctgtgagataatgagggctgcagagagaaatagacaggataagtgggaccagaaggcctggggcgggcaattgccattttatatcgcatggcgagagaaggctttgggggtgggggaactgatgctggtcttggtcccacctgatgtgcttgggcatgccatggaggctctctggggacctcaaagcaatccagtcctttggaagaatgtgtgtctgctctgcagtagccttgatccagcctcgggatgactgtgccattgctttgggtccatgaatgggtaaaaggctgatgttgagtgagtcccaccctgtccagactcttattcctggtttcacctgcggcaaaccggcctgcaggatctcagtctcagaggaaaaactcttccctcaccgactcccccttgcattcgtccaaaagaaggcaggaccccattggccccggggatttggtgcagggactccattcacaagctggcagtcgtctggccaggccagatgcaaggccatttagctccaagatcctgactcctccctgggcctaggcccagcgccaactggagcctctgcctggaactggccccatgtgagtactcagagttaaatatgactgatgcttattgatgagtcagtttcttgcccactcactgactctgacactgtgccttgtctttatcactcacccttgttctcttcgagcatttctcacttttctccccaagattcaggtcactgtggtggagggtgttgtgatgtgaggaactcacagccactcctccctggcccagaagaagggagggtacgctgtgtgtgtgggcactgcaaggtgaattgtacttgacaggagtaaggaaagggaggctgacagggcctgcaggaatgaagtttccttgggagacctgtgtgccgccagcccccttccccagcctggttcagccctggtctccctgggcagcagtttgcgtggggtgcatctggctcaagctgacttgtttgttgttgttgttgttgtttgtttgtttgtttttaaagtcccagcacttgttctgttttccaagtgaaaaggaactatatctccaccttcttagagtttctgctgttcagggtcctagggaatctcctggaacagttgttctgttgtgctggttgtgcagacctgagattcaagtaaggaagccctgatgtggttggtgtgagtagctgggattacaggtgcttgccaccatgcctggctacttttttgtatttttagtagagatggggttttgccatgttgctcaggctggcctcgaactcctgagctcaggcagtccgcctgtcttggcctcccaaagtgctaggattacaggtgtgagccactgtgcctggccatgtatattccttattatataccattatgcagttccattcggagaagagcacaatgaaaactccactactcttccaactcctgactgacgggagccgttcatgtattccttcttggctatttctagtttacaagcactcagcttaactggcaacactcattatgtttactgagtacctactatggacctggtcctatgccaggctttggagagtcaccaagatgatgaaacctagacaggatcttcacagtgtaacagggaagatagacttgtaaacgggcaattgtgacaatgggataagcactctgatgcctagacgaactaccgtggtgatgcagagggacagtgaccagcgcagacagttgggacttcacagggagaggatcctccccttgggtcttacaggacaaatagaagtttaccaggtgcacaaggggagggaggagcaagtccagaggcacacagagctggaatcatccgatgctttgggggagctgcaaggagtttggtgtgactggggcttgggctgctggagggtcagaggagacagcactgagatggtaggcaggggccaggcggaggcacgtggactttgtccagggggccaggagttcctgaaccttgcttaccatcaggattgcctgggggttttcataaataccgagcacagagcactattccatatctgctgaatctcacgcttcagggagtggagctgggaattctctctctctctctctctctctctctgatatttctgacaaccatcagatgtgagaacagttgccataggcagtgagggtgccctaaacggttttaagcatgtggatgatatggcccgatttgcagaattaattggtggagtgggggtgagcatagaacaggaagactgggaaaaaccagtatgggtctgaaccaaggtagggacagtggggaaggattctggagcaatttaagaggtaggtcttcacagggctggatggggcttagcaactgattgacgtgcagaggggagggaagaggttgggtgatgagtggatagaaggataattcatgacccagtataggggacagaaacagaagagtgggtttgcatggaagacagtgagttcagtttggaattcattgagcacttactatgtatagtccaagaactgctctaagcatttatgcgcatcacacctcatttatttatttatttattatttatttatttttgagatggagtttcactcttgttgcccaagctggagtgcaatggtgtgatctcggctcactgcaaccttctcctgccaggttcaagtgattctcctgtctcaccctcccaagtagctgggattacaggcgcccgccactatgctgggctaatttttgtatttttagtagagacggagtttcaccatgttggccaggctggtctcaaactcctgacctcaagtgacctgcccaccttggcctcccaaagtgctgggattacaggtgtgagccaccgcacccagcctcacacctcatttattcttcacagcagcccttttggagacaggtctcaaagccaggcagtctggtcccagtatctgtgccctaagccagagatactatttggctccttagatgtgaggtacttataacttcccagtaaaaactgcagtgggatgtctggatctggagcctttgagatcatctagttacaaatgtctgtttgtgagtcatccagctagacttcaacctcagcctggtgtttggattctcagtctgtcatctaagagcagcgtgacattgtccttaatttcggagccctggtttccttgtctgaaaaatgtaactaatggctcctccctcctgggtgttgtggaaattgagagaggtgccatatatcatgtgcctgctattgtttccagcacagaatgatgccaggatggcagccaccatcccctactctaggtaactgttcagagggacaggcacagcaatgggcagagctaagacacctgggagacgtggccaggccacacatggctggaggggaagtgcaaggcagcaggcagaagcagagagcaggaggtgatgaggaaggagcaagatgtctcacgggaggtcaaggcgggagagagggtaccgagggagctgccaatgtcacctactgcaaagaagtccagccaggtgagttgcagaaagctgatggcatcaccctctgcccagtttatcagcagggctggccaagttcttgggcatggtttcagatggtggcactccccattacatagctctctgtgtttgtgtgaattttgttctttcattctcctttttttttatctgggcccctggcctggaggcttcccgtggatgcagctccctgccactgtcccagaggcctctcccaggagacaggatgtaccttggcccagggtgcaggctcaggagccagatactcatggttggaattggctgacccagcgtgaacttccttgcacttgcattcttcttaactgtaaaatggggacaatgtccaggcgcggtggcttatgcctgtaatcccagcactttgggccaaggtgggcagttcacttgaggtcaggagtttgagaccagcctggccaacatgacgcaacccatctctactaaaaatacaaaaattagctgggtgtggtggcacacgcctgtaatcccagcttcttgggaggctgaggcaggagaatcacttgaacctgggaggtggaggttgcagtgagctgagatcacgccattgcattccagccaagtgtgaaactccgtctcagaaaaaacaaaaaacaaaaaccaacaaaaaaacctgtctctactaaaaatataaaaattagtcgggtgtggtggtgggcacctataatcccagctactgaggcaagagaatcgcttgaacctgggaggcggaggttgcagtgagccgaaatcacgccactgcactctagtctgggcgaaagagcaagactccatctcaaaaaaaaaaaaaaaaaaatggcgacaatgatagcagccacctctcagggttgctgtgacgctgagagcagtgccaggcagagtgcagctgctctcacagtcatcactccttcctgcagtcactcgtcctccagccccgctcttatttcctctctcaccacctcctttgctctcaccgcctttccctcttttcctgtccccagtcagttttgtagcctctggcataccatcccaccacctttgccactcgtgggggtctcccttatactggctgtgctaggtgctttcatgtgcgtgttctctgaaaaccttcaccacccttatgtagatatcatcagccccattttacaaaggaggcatcagtcgctcacccagtgacagctgggagatgaaaccaggtctccttggctcagaacctgttcactctcactcttatactagtcacaggcagatgccccttttctgtgaatcagggactggccgtggggaggcctgcttatggggtgcgttggggctgtctgtagggaatgccgtctccctccctcccttgtatttccgctggcttcctctggcatcacattcccaggagatttcaggtcagagaggaaatgcctctgtggatgtactggccatgcattgctctggccccggcactgcatgaggaagtggctgccaggtgtcctccagacccctcccaggaaggggcctcattcggtttcttgggaactgcctgtcttttgttgtgaatggaccacattgtgaccggcctgtgggtcttgtcaggggtttggggccctctgagctgaaatgcttcctgtgggtagagagttgcaggagacctcgaggcccagctgccctctcccccggtccatcccagctgagaggcgaggatgcaatgcagtgtgttcagccctccaggctcaaggtgtgaggttgtgtggaccataaggcagtccccgtgcctctagccttcggtgatgctacctgtccagcacttctgggagtggaaggaggaccatggatggctgcctggtagtgtcggttccctggcctccccatcccacctcgtgtccatggctccttctcctacatcagtgagctcggagaccattctgactgtgaggaggaaggggcagtagtatgtcctcagccactcccctctctggtttcctagcaggtctctcccccagatgtagggcagagttcactgtcctgcatgagttcatgtttgcaaagggccctgagagccgggggaagtagaggagagctgggggtactggggtttgaggcctgtgagctcaggggccttctcagcccaacctcctgcagcctcctaacctcagacaggcctccaggaccatctctgtaaagtaatgtccttgggtcaacacaggcctgggaaaggtcctctgcagactgttgacagcagctgatccaagggtgacacaagggctgggagccctgggtagccctgaaaggtcttggtgaggtcactgtctctgtgtctctacatagctttcgtttctgctttgccatgcggggtctgtgtcagcagagactgctgataaaccggcatctgcagcggctccaggcgggcagaggtgctgagcccactgctgatgagaatcccagtgcggcgggaaacgtgcacacatgagctgctagaggcaaaggctctcactgctctggtgggtagctggcccctccacagaaggaaaccgtggtgccctcagcctcctacctctctttgccccatagtcctgaatagagtgaaataggatccatggaggcagctcttcccctgagtcctgtgagcggtggagggggtcactgctatagagggcagacacagcctgggtttggaggcctccgcagagcatgtgcactatgctgaccaggaagagcctggccccttccaagctgcagagacccttgtgatgacgcatggctgagtgccagctggagtgggaagggggaagtcccttctggacccctaagaacagatgcttggggacagggcagcccggatgtagatcctctgagcgtggcggccttttatggcttggttctgtctcctggagaggccagggaatgccctgagctcagtttggggtatctctcaaggggtgatgagtggatttgtgaaccatctctctccccctcctttcagtgggtgtataacattctcgacaagaaggctgaagcggaccggattgttttcgagaacccagatccctctgatggttttgtcctcatccctgacctcaagtggaaccaacagcaggtaaaggtttctggctggaatgtcctgatctctggccaccctgctgtaagtgctggtccttctgactgccctctttctcacgctggcctgtctctaagcagattataattaaccaacaagggttggcctgagctctctgtggggactgggtggatacctgtcatacataagtgcttttgctttaatgggtcagcttaaagccctttctggctgtcctcccacccaagaggtaaaatggggtgatgtttgtgcccatgactacataggccattccttaccagccaagtggtctgggcagccacctgtgcttccacccgcatctggagccctcgggtggggtgtttccattttctccattccccttgacaccagcagatccaggcaggcccgtgttctgaagcactggcaggcaggaaccatggtgaccaacccaaggcatctcctcctcagcccgagctgtggagtagcttagcccagacttctactcaggccccttggccccgtgccctgcctccaagcacctctgcttctcctactttcctaaggagcaggtttgggaggagccgtcctccctcacaggtatccctttccagttccctatggtcttctgtctctcccagaccagcccaccaccagagttatcacttaccaccacctcttttatacctgagagtatcagaagcttttataccctgacagggtcagaaacaggcagagccactgtgttgcagagagtgctgttcttaacacagactggaacctggctgtgctcagcctgcaacagaagaagggcctggataaggccgaggtaggcaggcaggcatgggtgctgggagcagacagacatattctctcctgcactttcacctgtggagtaatccaggctcagatgtgccgttctgctttcggtgggcccgtctagtttctgcacccgtcaaaggctggagagactcttgtagagaaggtgccttggagtgagcctcgtctgcccctccgcgggctcgctccctgtgctttcccagttgtggctgcctatgacaccttcagttttgacgtggggtaaaggggtgggattgtggctcagggttacacaggcaagtgagcataattcgtctcttgacaagaggcttgtgggaattcccaaatgtgacccaaggggtgggaaagaatttgaagggattttccgaagttgcagcattgatcgatgattccctagagccaagtaagttcaaagaagagggctctccttgtgtggggcgctgcagtgagaggctaaggggacgcctgcatccactctgcccttccctgcagcttctctctgcctgtgccaccttcaggccttgaaggagggagccaggactggctctgtaggcatttgaagaggtaggacctgatggtcccttgtctcaaactgagtggtggctctgcaaacccccatctgtcttgtggggctgccctgcacctagagatccggggtcagagcctgggtcacaggaggcggggcccaccgttaatgagaatcccagcagggccatagaggtgtggggtaggaggaggaccttctgccgcaccagactcttgaagactgaagagcttgccaggggatcgcagtcttaaggtcatggagggacaacaatagacttgtccgtctgtattccagaagccctgaatgcatttgagcccacggcagagaagagaaatctgccgtccttctgaccccagtgcctccaggctctgcttcagctgccagtggaacctccctttttctgtcccctttaagacaggaaagactttaggagctgcactctggctgccagccacagggctggaattacttgtcctcaagggtcatgaaagggccagcttaaacgtcacactttgcttcatagcgatgcaggtgtggtccttcttaacatttgcttaattctttttttttttttgagacagagtctcactctgttgcccaggctggagtgtagtggtgtgatctcagctcactgcaacctccacctcctggattcaagcaattctcgtgcctcagcaacccaagtagctgggactacaggcgtgagccaccgcgcccgaccttaattcttacttgacttttgatgatgctgtattttagcgtctcaaatctttgacttgtgacagcactgaattggtagctctctttgaattaggcaatgtatccagcaggaagataggccatgcctgggcttctatcctttgtctttgggacagggaagggctggggatagggaggcaccctggtgtttgctttgaggagctttcctagccaccttgaatctcctcctgccactggtcctggaagttactgtctccaaactgatgcccctgaattaaagagataatccattttttcatccattcaacatgtatttatcaggtgcctgtttgctagagactgtgcctccttagaggttataacatcccttcttctgttctcttaaaggatcacctgtgtgttctttttttttatttgtttattttcttgtaggtttagttcatgcatgtggcaaaaatgcacacagtacagaggatattcagtgaaagtatgcttcctcaccccacagcccttcctttcccttccccaaaacaactattgttgctatttctttgtctctggtaacctttctatattgggtatataaacatatatgtacatgtatatatggatacacatgcattttcagttcacatgatttaaattctttggtctaaagttctcagaccaggcaactcttcctttgagtcaccccagaggttaagagatggctctccaacgctccagcaattctctttcttcctgccaggaaactattactttgattttactgtcttgacttgtaaaaagagactgacgatgtctatctgtcttcccagagtgactgatgggccaccttctggggcgccagcctgaggccctttcctgcccctgggctagcttttttcagatgacttctctgagcgaggaggcctttggctgccagcaggaaattttgggtcatgtctaatatcaaagaatggattattttccctcccttacccagcctgtgaactgacacccaacaccatgggctgacacccagcaccaggctccatgccctattctgtgccagtggagcagagagttgcgagttagcgtcgtgtttgtgatttgtcagcagacatcatctaaacaaatgttactattatttgggagtttggtgacagtgacgcatagaacagccgaaaacatacaccttcaccaccacgtgcacacgtgcgcacgcacacaaattcaagttcaagcaattttgtttctgggcttctctttggactcctaagtccaaagtgagagaatacatttcttggccacaggccatgagagagtacacaggggacttggggcaaactgaggcctggtgcatgtagctcagctacacgtggagcttcctgtgggctcatctgcagaaggtctaaggcagagaacacagattcttagaactctggcaggaaagaatgttcatggcatgtaaagaccatggcatagttggatatcagccagtcatatagaaaagcccatcctgaattttcaatttgaggccccaggaaatgtggttgggtgagtcatggtcctcaaattatcttcacaaggaatctggtagctcagactgcagggcagggcactgctgggttctccccgtgcctggcccctcagagccttgatgtctggggccttccaggcgcatggatggaattaccaggcaaggccagggtttaggtgagcagggtgggttttctcagcaagaggaagagttcatttgctctctggcacaagatcttgactttgattctttgtactgttgtgacctccaggttttcagccaggttgtgctcaggaaggacagcaggaaggtatcctgtgcgataggggaagagagaaacaagctaactgccctggtgttgtgtgtgctgctgagctggcccttggctcccttctcagccttcagaccccactccaccccttcatgggccttgactccaaacaaatcaagttgcttcctctccccttccgtatacattctatgccctatacattcttgcctccgagtctttgctctgtttcctctacctgaataccctttctccaaattctaccttttttctagacctgatcctctgccttctcttccaggaggccttcctgggttcatccaggtagctagagtctttccttcctcctgcactgggattattttgtgtcttacagtagagctacttgcatacatgcgataagactgtaaactctcggagggagagagttgcccttgctctttcttgaacctcctggctccctgccccgacagctctggggagtgagcatatagaactctctgctgggcgcggtggctcacgcctgtaatcccagcactttgggaggccgaggcaggcggatcatgaagtcaggagtttgagaccagcctggccaatatggtgaaaccccatctctactaaaaatataaagagcatggtggcacgcacctgtagtcccagctacttgggaggctgaggcagaagaatcgcttgaacccaggaggcggaggttgcagtgagccaagattgcgccactgcactccagcctgggcgacagagcgagactctgtcaaaaaaaaaaaaaaaaaaaaggactctcacatggtattctctagcaagaagcgtacacagtaggcctgctccttaagaccatcccacacgcccggggtatgcagatgccctgcggggtttctcctggtgctgtaggcctcaggggtgggtgcttcctggcttacgtgagaactccagggttggcagcctccccaggtctgttccctgctgagcctggtctccccttgctctctacgcagctcgatgacttgtacttgatcgccatctgccatcgccggggcatcagatccctacgcgaccttactccggagcacttgccgctgctcaggaacatcctccaccaggggcaggtgagtggcttcaccaaaccacgtggaagctcagagaaattagactcagattccagtgtgttcctgggcccctttcctcacctttcccagagtccatcttggagagacttctctctggatgccagtcttggggaccccattaggctcttgaggttgaagagcagggctctttgtccctggtcctgccacctttcctcaccctcacacgccttcctcggcctttctccatctgggatgcacttccacccctcaccccatagactctggtccttaagtcctggcccctcctactccaggatcacctgtctctctcatgacaaccatgacaaccacatcatgccagagtttcttgggagtatgggcacatgacttcgatatgtgtgtacacgtgtgtctccttgtctagattgaagacaggctgaattctgtagcacctggtgttctgggatactttctctctgggatatttgttgaattgaatgaaattatcggggctctaaacagagcccaggagcacggggagatgggggaagagtgtctagaatcttgggtgtggtcctggcctgacatttggaccctaaccagctgagtggcctggggcaggtcacttcacctccctaaaccacattatctagatggatcccttctaaatccaccatcctaaggggctgggtctgagtcttttttccactctgaaatgtgatgctctgcctaacacgccagagctagcagtcacaacgatgcccagccaggagagaggtttgcccctttttgaccagtgatgcttcgaggtgttaatgcagacctggaggcaaggctctgcccatacccagcttcccctgctgctgggccccgatctatcttccctcctgctcacccacggcaccaccccttggctgcctttatctttgtggggtgacttgttcagatcctgaagcagtctctggatattacaaatggcaaagaatggtgtctttctcttggggagatgccaggccaacactttgacctgccctagcagctcagacagctccaccctggcagacagacctcacttactccaggaagcccctcgggtgccttggccctggtctcgccccgctgcagggattcctggggtgagctccaaatgcagaacacagttctggggtatatactgagcccactgaggccctagtacttttctcttcacctctgaccacctcagggatttgcccacaatggagatgagagtctccgcttaattctatgcctcacagcctcctgaaggtggaggttggtagaaaaagacccacccctgagcaaggtggaggtgggcaaagggagccagggccaaagtcaatgctttcctcttctgcaaggagcccgctgagacttcgccaggtctgtgtgggagcagcccctcccataccccttccacagtccctgctctttcaccaagttctcagcatagccccatccccaacttcattgtttccaagctccaccctgtgctatgctaaaagagagaatgaggcttcctcccatccacttcatgactgatgaaatgcttctaaatcatgaaagtccccatagtcttgggaatctggggcctgtctgtagacactgggccttccaagattcccagcagcaactgtttgaggaagccagtgttttttccacgttggggtggggaatgctgattgaggccgctccccacttcttttgggagagtctcagctttgctgctgtcacctgcacttgtggatttcctagactagaagacagaggaagctgaagcagacagcaggtagagagctgtttggagggtttttgtgagctgtcccaggccaatccaggattcagatgggaggagggtctaggtggggacatggcgccgggcctcaggcagcacggtgactcctgacctgcctgcccctgtctcatcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactcagtgtggacagcgtggcctgggaggcagacagatggtgggggacagtgggtgggtagaacctgtgggaaggccttgagaatggtggaaagtctccaggtggtggtttcaactgacaggtgggagctgccctggaagggtgccgagggccttctccaagccccagggctcaccgtccgtggtggcttccttctccccactctgtgcctctcctgtttgtacaacttcttattctgctcctccccatcacccctcctccttcccctgccatccacctctcctttgaggagttccccaaaaaaccaaacttggaagctttcaggaaattatctatacaggtttctgatggcacttcctccttccagcagtgaggtcacacctccctgtgagtcagtcaaccctgctgataaacttcttgttgacgaggataggggcttggtgcctggaaatcggcgggttttaataagaatcagattatgcaaggccgaaaagcctgccttgctctgttatttggtcagcgagtccccagccttgagtttttatctcggcaggaagacaaaacagactcacatgaagcagccagaagatcaagtgcaaaacagtgaatcagcaagggcaaatgatatggttgcagttgaatacaaaagcccggaggcggctcgggttcaaggcctatcagaggcagatgttcagaggatcttgagaccaggaagggacctcaaagcgtcagaggctgatgagcagttaggcagccaacagggctcaagcggcgcagggacatggcttgtatgggcgggcacacaagtaaacacacaggctctctccagcacacaggaccaaggcatcatgctgccagaggggctggtgtttgccactttgtcagagtagggctgtggattttgtgccttgcttgggaagctctcagggatggcaggatggcaggctcctaagtgacagcaggggggaagcttgaggcacagtgggtggtccttactctccatcccctgcctgagaaccaggaagcctcattcagagattagcccctttactgcaggtggtagcccaggtgcagccaacctgcttcagggtctcagggcctgctgtggacccccatggtcctgggagagactccttagaaacagcagaatcacgaacatggtgaaacccatctctactaaaaaacagaaaaattagccaggtgtggtggtgggctcctataatcccacctacttgggaggctgaagcaggagaatcccttgaacccgggaggcggaggttgccgtgagccaccgcactttggcctgggtgacagagcaagactccctctcagaaaaaaaaattaaaaaaatagaaacagccggggagtggagggtgtggtcagaaagcctcagggacctgcttcagccttcagggagttcagatgaggcacaatgaagccactggcctccactcagccattcttccctgcagctcttttttttttttttttttttgagacaatctcgctccatcacccaggctggagtgcagtggcacaatctcgactcactgcaacctctgcctcctgggttcaagtgattctcctgcctcagcctcctgagtagctgggactacaggggtgcgcccccatgcccagctaatttttgtatttttagtagagacggggtttcaccatgttggccaggctggtctccaactcctggcctcaggtgatccacccatctcggcctcccaaagtgctgggattccaggcgtgagccaccgcgcccagcccctgcaatacgtcaacagtccctagattcaggcaacatggagttgcagccaaggaactttgaggtagtgaccaatgcagggaggtctgacagagaatcagcaggatccatttcatggccaccacacatctgactgactccttcttgggctaagcaaatacttttgtgggcagtgacactggcagctgctggggtcttggcaggaggttggatggaggtcttctcccagagcagtgtccagcttgcaggaatgctccctgcgtctcagttgtgcccattccaggtccaggggaaagaagtgacccgcttcccctctgaaagcagatgtggtcccaacaagcaaacacggtctccatctccagcaccacaactgccacggagcagagggaggcctccctgtggagcagcccttccctgtggcctcagcccatgccctcctgcccagcccccagtggtgctgctggagggtctgactccacgggctcccgctgaccttgccgttccttcccctcatctcgtagcgcctggcccctggaggaaggtgggtaggaatttgacaccggataaataaatgtttgaggggcaagagagatgggacagagttcacccaacaggacagacgaggctggcagtcacagcagagggcaggcactcaggtctggagaggcagggcatggagacagggacccacactctggaaggtttctcgactcccccgaggggctggccagttctgtcttccttctgcccactctgtggggaggagcctctctgggatagcgtcccctcactcctctcccagcctcgtttatcttcaccacagtacagaagggggcccctctccaggcctcaccacttaacttttcttgtacatggaaagacaagcctctgctagaggcctggcaagggttccccttcagagccagccagtgctctgctgctgtaatctccagggaccctgccggccacggcccccatgcagctccctccctcaatccaaccctctttgggcttatcaccctcaaggtctagagtgcaccagggttggctgctctgccaagtcctgttgagactccaaaagcatagtctgtctttattagggtgaccttcatatcagactcccaggtaactcaagatgatagctttgcaatatagtgcctccttttattcctatttgtgagtttctccgctttcctcactagactgagagggtcttgagggtaggagctttgttttagttatctctctatccctggcccctaagacactacctggctcagcaaaccaacctttgagacaaagcaacattataacactacattcatatagcagatcatttcatgacccacattctccttcctttttacgaagaaatgggctcaggatgtcttgtccagcattatggagtgaacgtcagctccaggaagcagagacttctggccctttgttcaccatttccccagaacctagggtggtgactcacctataagtgctcaaaaaacatgtggcgaatggaggaccagagctaggctctgaatgaggcctcctggatctcacgcaggggatggagagtaaggaccagcccctctacctcatgctttcttcctgctatctcgtaagagcccaacatccttctgtcctgagcaagccacaagctgcagccctgccttgacaaaatggcaaatgccagcccctctggcagcatgacaccttggtcctgtgtgctgcagagtgcctcatgtgttgaactgtgtgccctcagaagcatgccatgcccccgctctgctggagcagtggcagatgtcacccttcctagataaatcctggacggctccacgactggcttttagccctcaacacttggcctacattctttctggcttggttggagaaggaaagaagcagttggaggcatgactgctattgttccttggcttctctccatttgtctcaaactttcctaatagagcaaaattgctgagtggtctctatttaccaacatgaaacagaaaaataccatctcaggctccatattccatgtccctgttgaatacagatccccgaactgagaaataagaaacaactacatacgaagtaatacttgaaaatgtttctcttgtaatacttccatatccaaagcatttgaatatatttattttattgatgtaggtctgccaactcttccttctcaggaaggactgtttttattccaaacatgtatatataaggttaaaatgtattttttaaaataagataattattgatagttgtttttaaaatagccttgcttagcaaaataaatgttggcaaccctaagtttgttctattataatattattgaaattacattgaattctgaaatccatgtcaacttgaagttaccaagttttaaccactgttagaaaataagcaggaatgaaatctgtttcaagcgtttcaatttcaatacaatttaataaacaggctttgagcatctacccccacccccttttggtttttttgcaagcacctggaggcagagctcatgtggagcttacaatttagtaggaacacaggcattaattacaaagtaattacaatgctgatgagtgtgttgaagtggagggggctatggggcttcagccccaaaaagctaaacctgcaggctaaaactttaaaaaaatatatttaattggcaaataaaaatagtatacatttatggtgtacaacatgttttgttatatgtatacactgtggaatcactaaatcgggctaattaacatatgcattatgtcacatatttatcattttgtaatggtgagaacatttaaaatctctgtgagcaattttcaagtatacagtacattgctttttttgtttttttgaaacagagtctcactgtgtcacccaggctggagggcagtggcgcagtctcgactcactgcaacctccacctcctgggttcaagcgattcagcctcccaagtagctgagattacaggcgcacaccaccacacctggctaattttgtagttttatagtagagacggggtttcaccatgttggacaagctggtctagaactcctgacctcaagtgatctgtctgcctcagcttcccaaagtgctgggattacaggcgtaggccaccaccccccgcccagtacattgttattaactattgtcaccatgtggcacaatagatctctggaacttcttcctcccatccaactgaaagtttgcattctctgaccatctccccattccaacaggcaaccaccattctactctctgcttctgtgagttccactttgttaggttctacacacgagatcacgcagcgtttgtcttcttgtgctctaggctggatcttggttatcagcccaatgacaagcagagtaaaggcccggaagttagggagaccagggctcagtgtggctggcactgagagctgagcttctagcgtgggcccacacatacatttaagactgtagccaattttcctttcagaaccacgatgaagaaatgaaagccaaggccaagaaaatctttaatgttctgttcctcccctgcttgggaagtagagtggtctgaaggctccaacacagaatctgtgccataaccaagtcttatctggggcaagttacataactgctcatgaaataggagtgataacaatgcttcccccagacggtttttctgagggttaaataagaattttgtgggacatagtaatcactcagtaaatgttctggtctgagagtgaccaaaaggatggaactagagatatttgggcaagatatttgctatggcctgaacgtctgtgttcccctaaaattcatatgtggaaatcctaacacccaaggcaatcgtggggcctttgggaggtgattaggccatgagggtggggggcccccattaatgggattagtgcctcataaaagagatcccagagtcacccctaggcccttcctctcactgtgaggttacagtgagaagatgaccttgtatgaaccaggaagcaggctgctggcatcttcatcttagactttctagcctacagaactgtgagagatttctgtagtttataagccatccagtctacattttgtataacagaccaaacaaatattaaaaataacttcgtgattagaagtgctacaaaatgctagactacgcatggaaccaagagtttctatttatttactttttgagacagtctcactctgttgccaggctggagtgcagtggctcaatctcggctcactgcaacctccgcctcccgggttcaagtgattctcctgcctcagcctcctgagtagctgggattacaggcacccactaccacgcccagttaatttttgtgtttttagtagagatggggtttcaccatgttggccaggctggtctcgaaattccgacttctggtgatccacccacctcggcctcccaaagtgctgagattacgggcatgagccaacactcctggccaaccaagaggtttcaaggaaaaaagccgtaaacttttggtggttaactgactgtggtcctaaacagaggcaggggctgtgtgcaatgacttctcaggatctctttcagcctacaggttcctggaatgcatttcagctaacactacaagagtgatgtcccttgctactgagaaccctgggaacagctcagctccatggtccagccatataaatctgataaaaataggagctgaaataccatcctggagttgctatttttaaaatcatctgagatgctggatggggtatatttcttcctcaaacacatcttgctgtttcctcctcttggtgggcaggatgctaacgtggcacatgatacaggagctgttccacgctgctgctcacacccactcctgccagagaggggccgcagggccagggcttcccagatctagatgcacctgctcctccctctgctcctgaggcccctctggttgccccagcacagaggtgtcctgccacttccaccaagcagaaacacaggagagtttgggaggcaaaggaaatgggaatggaggcagcactgatggcttggaaggggactaagacctgttgttcctctggttgccttggtcccactttggcacagttaacatccaaaagaaacagtccccatgggccaaagccctgcttatcccatcctactgcctcttgctgagccgctcatcatgtgttgtagttgcaccaaaggggggcctggggccaaaaaagcacatggagaggagagaggagagaagaggagaaggaaagatggaaagacaagaaaagagagagagagaggaaggaaggaaagaaggaaggaagaaaaaaaaagaaagaaaaagaaagaagaggagaaggaaagatggaaagacaagaaaagagagagaaaggaaggaaggaaagaaggaagaaaggaaagaaaagagaagaggagaaggaaagatggaaagacaagaaaagagagagagaaaggaacgaaggaaagaaggaaggaagaaaggaaagaaagaaaaagagaagagaaggaaagatggaaagacaagaagagagagagagaaagcaaggaaggaaagaaggaagaaaaagaaagaaaaagagaagaggagaaggaaagatggaaagacaagaaaagagagagaaaggaaggaaggaaagaaggaaggaagaaaggaaagaaaaagaaagaagaggagaaagaaagatggaaagacaagaaaaagagagagaaaggaaggaaggaaagaaggaaggaagaaaggaaagaaagaaaaagaaagaagaggagaaggaaagatggaaagacaagaagagagagaaaggaaggaaggaaagaaggaaggaagaaaagaaagaaagaaaaagagagaagagaagaggagaaaggcaccagaattgcttccctcctgccccaaagatgacatggcttctaggcagtgagctaagcttgtggccatgctgttaagaaactggagggaaaagatcatcatgagtaagcacattgtggcctaacctgaggggagcagaattacggttagcttctgggcacctagtaaccaggcttgggataagctgggggagaggcctgaatacagcttataggttagaaaaggcacgccacctgcatagtaacagcacacacttatatatagcaggttatgctttcagaccaaattcgcatccattgcctgatttaatgccaacaatagccctttgaataagcagttatttcctttcccctccccccaccccagtaagaaaactaaagctatttagtggcagagacaagagttggaactcaggtctccaggaacaaatgctggttcttaagttccattttctggtagagtgacatttacgtgattcacggcaagaactgcaaactgtgcttagatctagttcatcaaatggccaagtttagaggctgggctgacgcttggatcagttctgtcagattcacttagttatgaagggcagctgcttactccctttgggccagtcttcccatctgtagaacaaggaggctcttccctcttcctcgacttgcccgaggcagggacttagtcattgtgttctttatacccagcttaattccaggcctggagatggcatgcaataaatagttgttgaatggctcacgcctgtaatcccaacactttgggaggccgaggcgggcggatcataaggtcaagagatcgagaccatcctggccagcatggtgaaacctcgtctctactaaaaatacaaaaattagctgggcatggtggcacgcgcctgtagtcccagctactcgggaggctgaggcaggagaatcacttgaacccgggaggcagaggttgcagtgagccaagatcacgccagtgcactccagcctggcgacagagcgagactctgtctcaaaataataaataaataaataaataaataaataaataaatagttgttgaatgcatgtctgactgattaagccaaaggcaccatattcaaacaaaatcagacactggtgcaatgccaaacagcttctgcccgtgcaaggaatgatttagcatggagcacagtcacctgcagaggaacaacttggaggcagactctccttactcagctcacttggagcagagcttcctgagttgggggttcttgacagataagccctccagcttcagcagaagcaggcttggagctgccacttctctgaacccccttgcacttactgtcagtcactcacaccttgcacttattcacatcctatcctgcctcgttcttgaatggagtccatggtgagccttctctgtgccgctggatggtaagcttcctggggacagggaatgggtctgatagtttccttggagcccctggcgctcccggcactgggctgttgatacgtggggctccggaaacactgtgctgacctgtgaaagggactggcctaaggggctgtggattgtcctgtagggtgacttctgaactgttcttcagcctgggcagttcccaggtttatttggggggatgcctgggtccaaagaaccagggtcaggggcccaggggtttcttcctggagacaggatgcctggcgccttcaataacggaaaggaaactgagaaactttctgaggccaagataaagagtatgcaagtgaggggtgcagagagagcagtttaggggcagcaggccccaaccgaagcagaggaagggcccacgtctgggcccaggggactgactggctgccttgcgtgcatggggcacgggaagcataggctcccggaacaggaccctgccccagtttccccagtgagggaaggacaccgttccccgtgggatagagcactgcaccctttcttgattctcattgttcccgggagcgagcgccttggctgcgctgggcatacccaccctggcgccattcacaggcagtgcctgccctggccctgtgctcaccccatcaggcctcctcttccgcctctctggcacccacggcgcccctgcttgcctctgtccgggtctcggaggcgcgaacaccatcccaagcctgcgaccgcgcggcatcacccccgcccttccccctcctccaccccgccctttctacccctcccgggagctcctgggagtcgggccgccgtgtgcgcaagcgtgtccagccccttccccgcccccaacccgggcccgggtccccgcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtgagtacgcggcggcggtgcgcgggggcccgcggggcggggcggggcggggagccgcggggtcctcggccgcctgaccccagccggcgccgcgcctcccggagggggtcgggccctgcacgtgggcgcagcgcgggtcggggtggggctgccacagccctgcggagctgctttccggggtccctttccctggaccagattttcgcgggaagccggatcctctccgttcccttggagtgagcaagcgggacagttctgcggaaagtttccgcccccaatcccccagccctgcgcccggactgaagcggcggcccccacctccagcatcctcgagcgatggtttctcccacaactaccccggtcaggtccagcacttgggagctgactgtgctggaggtgacaggctttgcggggtccgcctgtgtgcaggagtcgcaaggtcgctgagcaggacccaaaggtggagttgtcagtgggaggccggctgtgcccagggtcctagggccacgttatgggggtcgtcaggcctaggccactgtgcctcagggctgcatgggtggtgagcagtgggagggatgcgatggggggagtgggctcagctgtctgctgtgggtgtttcctcggggacctggctggcagggacctcccggccagcccagaactgccaacatgtctgccagcactgcccctccattcccagtcctggggggaggctctgtctgggcagcttgaggcctgacctactgtggctgcttcctctgctccccagcctgggtcctgagggcctggcttaagggaactgctgccagaaggctgggagtgtaggcagtgttcgggtgcccagctgtgccctgtctgacctcatggccacccacaagctggcaccccccacaggcctcttggggaagcctgtactttccaccgccggaggcgggtaccgcgtggaagccaggctcaggcggactcattctttttgaactttgggaacaggcctggtacaggctgagttctcacaagagacacacacccgtgtcactgtctcctgagctgtgccggacccgtcctacagactccacctcctctaggtcctggccctggcatctgccagggggattttaaatgagttgatatatgctaagtgctttgaaaggcgcctgcacggagggagagctgtataaatattcactattggtaatatttctcccatgctgttactctccaaagctgcccgataattctagagtgggttccggggacgtgcccgctgtttggggcctagaaatgaactcgggaggttgttttgcttgctgagagctggtctgggaatgccccttgaccgttccctgccctgctcctggcccactcccagactgctcctgtgcctggccccattgcgctgggtgggtgatcctaagctgccccatgggccctgggctctgtcaagacatggggagcttgccaggagttggggccagatcccccagactccaagatggtaaccgaggttgtgagggtgcacatggaaggaagagttagaagagtgaattggaaattgccagcttggactttgggcagagtgggtgtctttagcttggggatgggttgttgttcagagacaacagggccgccttctctgtgagctggcggcccaggctgaggtgcctctgggctgccttccctacgggaagcagtgactggccctctgcttctcaggaagagagtgccgtgcccccgccagcctcccaacctcgttagactcctagaatccggttttctggatagaactaagaatctgctcctttctggacttttaatcctggaaagggctcccttccccagcaggagcagagagaccaaaccccctttctgtgctccatcttgagctgtcattctgtcctaactccccactggccaccatctgcccttgctttgggggctaccccaggtctgacttgggcacgttctctgggtctctcctcagagaggctgctcctggggttgtcccaatggaattgggaattcttctcagaatggctcaaaggtttgcaccatctgttggagggaagggatccctctatcttggactaatacaaatgtttccgtgcctgccaagttccagaccctgggccgatagggaaaggagctggctggggggcctgcaggggatggagagggagcttgggccccaagtggggtctgaagtccaagcctacagattgccatcaaggcagccgctagagcctagcccagctcctggcccctcggagatggaccttagatgctggagagcggggcagtccagcagtgcagggtgggacaccccgagcaaacagcccctgcttcctgccccctcagttcagtcgcactgggccggctggacgtttccctgcaacaggcccctgctggtggtttagctcccgctccgtgtttccctcacgctgggatcctccttcctactcaagacccacgaccttgacctgaagcttttggttgccgggaggaaatggtgagtgtaggcagatttgggtgactcttgttattaaccccctcttctttgttgcccccttcccagaggcttctgtatgagtgtcctgagtggccctggatggactactggctgtccctggcctcagaatcaccccaacccctgccacatttcggggagggaggtgtgtgaatgatgtcctttattctacagactgaggaagtggtcagtgtagcttcacgtgagagcagcagcgtgcgatgcccaggccctagccaagtgctggtcagctttctgactggagcccctgagccctgcaggggctgaattcccccaaaggttgcttgggttgttgcatttcggggttagagggtgtgggtgtccagagctgtgggtttttagtgttggctgagccctttacctgggacctacagcctggccacaaccccatctctgttcccctgtaccccacactgccctgtgataggatgtgataagatggtaggattgcctatactgaagccctgggtgccactgctggcccagcagggaggaggttgctgctgctcgggctgaagtgaggtgtgggtctggctgggcctccagtttcccacctgggccttgattgtgaggaaggcctggcctggctgcagaagcccagaagcacctgagtaggagagttcctttgtcccacctgcagctcattcaagcctgtgcatgggggttggggtcctcaggatcttgctttcctgtttaggggaggcagccccaaagagtgctgggaccagtttggagagtgctaaggaatgctggtctgcagcgaccctacttgtgctctgcgtcctctgccaactgcagcatgggtgaacatctgtacatctgtccccataatgaaaatggcctcagcaaataacaaaaatattaccatttagcaatcaggcacttattaaaagcctggcccaataaacttaaaaaaaaaaaaaagatgtgctagacactttacgtcccttcatgtgagcttcacacaaccctgtaattaagcccatttataaatgaagaaatggaggattgaaggattaagttacttggccaaggtcatacagctcgtaagcagctgagctaggactcaaatccaggcttgcttccaaaaccttcacttttcagcccagttctcaactgccccctggagtttgctcattttgccccatgaagaaacagatcccagctcaaaggcgtgaaggggtttgctcaaggccacagtgtattagtgtcaaaggtggaacacaaaccctgacctctgagtgctctcccgaaccccacatcccggccgggccgtaccctgagcacacgcttgtccgctttctcagctgggcggggcggggcaggacaaggttcttctccctccctccttccctccttccctccttccctccttccccgtgggccctcccagcctccccagcccccacctctgctgctttcccttggcaattgcttccatctggcctgcctgcagctcctattcctttggaaatgtggctgccgcccacatggctgcaaggcaaccacggccacacgtggggaaggggaggggccctatggggtctaagcacagggaacccagccaaagtggctgctcctggcgtctggcatcctgattcctgccaggcagaagcaccttggctgcctggccctccttgatgcccgtcctgggctggctcaaggccagagaggctcccaaagacccaattctccttccaacatggtgagctgttttgcccacagacaagctccgcaccggcagccctccctgtctcttagaggttgctcaggttgggaggagggattcctggcaggagagaattaggggccagccggggtataccctgggttcccactgggttctgatcatttggagggaagtcatgcaagggactgacgagggcagaggctgagggatccgcggagttctgggcaggcgaggaggcagctgacttgctcatgactgtgggtatgcgccaccacactaggctaatttttctattttttgtagatacagggttttgccatgttgcccaggctggtttttgtttgtttgttttgttttgtttttgagacagagttttgctcttgtttcctaggctggagtgcagtggcgcgatctcggctaactgcaacctccatcttctggtttcaagttattctcctgcctcagcctcctgagtagctgagattacaggcacccgccaccacgcctggctaatttttgtacttttagtagagacagggtttcatcatgttggccaggctggtctcgaactcctgaccttgtgatccgcccacctcagcctcccaaagtgctgggattacaggcgtgagccaccgtgcccagccgagcgtgtctgtcttgttcactggtgtattttcttaatgcctggaatgatgtctagcaaacaataagcactcaatagattcttgtgtgatgagtgatggaaatgcagctcaggtatgctgatttgtctttgctgcatctttactttgcttcctcctcccagggcaaagggaaaaagtttcccttttgccagttgagctgtttgccagagaaaggtctggccccatctgtgtgctgccaccttgggggtctctgttcagacctcagagaggcaggcaggaacccaggtgaggatgggcaggagcttgtcccctgaggagtgcatgccccattccacccaccacagggtcggctggccacatttctctacccatcacccctccctagtaaccttcaggtccctgcagacaggtcctgacctcagctccaatccctatgtcagtcctctccttatttgaggcccaagaaaggtacccctacggtggaaccctcacttgggtcctgagagggagtgacagctttggaagagcgaggggttcacccacatttgcctcctcctgaacagctccacttttattccttgtacatattgcgtttccacttcaatttttttttgaaactgtgacagagggtttcttggctttaatttttttttttttttgaaaacccccattgagttccagttgtgacccccctgtggttctcattttctggtagcatgccgtgtggggtctcacctcctcgcctttgcttctgctgccccctcacatggcttgggcattgttggtaatgaccttgctagactgcaaatgtccttcagtatcaactgaagccccagtcctgggaagcctccgtggccacccagcaccggcacttcctcccccttcctccccctgcgttctccactccctgcaggtcctatgcctgtgacagggagggaaccctgtgctggggtgaccccagcatggacctcagtggggctcaggctgaaccaaaggtaggtggttctgggggtagtgcctgaggtggttgtatggagctgtgagatttgtattcctagaagcaggttggaggctctcagcccttccctccatgcatggccttggatacagcttgcagcctgccactgtagcctccatttccttctccgagaaattaacacttctttttttttttttttgagatggagtctggctctattgcccaggctggagtgcagtggtgcgatctcggctcactgccatctctgcctcctgggttcaagtgattctcctgcctcagcctcccaagtagctgggatcacaggtgtgtgccactactcctggctaatttttgtacttttagtagaaatggggtttcaccgtgttggccaggctggtctcaaactcctgacctcaggtaatctgcccacctgagcctcccagagtgccaggattacaggagtgagccaccgtgtctggccaacatttcttccttttttttttttttttttttttaagacggagtctcactctgttgcccaggctggagtgcagtggcacaatctcagctcactgcaacctctgcctcccgggttcaagcgagattctcctacctcagcctcccgagtagctgggattataggtgcccaccatcacacccggctaatttttgtatttttagtagagatgggggtctcaccatgttggccaagctggtctcgaactcctgacctcaaatgatccacctgcctcggcctcccaaagtgttgggattataggtgtgaactaccgtgctccgcctggccaacacttcttaatgggataatgtttcagataacatccagtgcccggactccagcactctataaatgctggctggtgtgcttttctgggattccagggtggggtccagagactgaagagggtctgctttctggcccaggggaagaggggcaggtggctcactaggagctgtcctggcatcctttgtccccgtccacttaccagttatgtgacctcgggcaggtcttgcactctggcactcaattagcatctgtgttaattggggtaagagtatctgccacgtctcacagcctggtgatggacaaacaaaacaaacattttttaggctgggagaggcctcagaggttggctgtcatattgcaaacgagggagcagagactcagaaaagtaacttagttgtttaaggtcacagagcacctctctccccacaggcagggagccggtaattgggctgagcctcaggagtaacccttctctctctgcctctccagcccctaccttatgcctggcccattcagctggtctgttctccaggcccctaggactgggtgggctaagatgagtggtctagaaatccctccccagctgggctggactgaatgaggggctggccgaggagcgggtgttgatggagtatgggagattgtcctcacaggcagtgtgggccgtttctctagacctcctgcccccatctccttcctgtccctgtttgagccgtgctcttcttcttcaatccctttctgtctgccttctctttccacccctagatttctcaccatcttcagtgatccctcctccttcctttctgcctcctctgcattctctccttgcccttgcttctctgatctgccttttttctccagcctcagcattcaggttgtcctcatagtggaactgggactctgggggtggctgggttgggttgcctggaggccgggaatgttcaggagagccttcattgggagcccatgggagcaggagtcagctcctcctgttggcagctccagcattttcgaacaaaaatggctcttccaggagttgagtttggcgaagagacagtgcctgcccaaagtatgcaatgcttttatctttagctcagctcctgagccctcatgcaactctttggacatcttcctgcaaaggacggtgggatcttgtctttctggggcctcagggtctccaaagatgggctgactaagcttccctagcctgggacctgaaccctccaccctcctctctcttgagctctttctcccaggggaagctgctcgaatgaggggagttggccaacacagttttctactctcagaccccattgaggtgagcacacaacagtgttctgtgtgagggtctggatacactccccaccctcccaggcccggcaccgtgtcgccctgccccagcccagagcttgcctctgttggctttgtgaccctcgctttgtactgtggctttgttctgccttagggaccagctggtcccctgctgtggttccacacagtggagactgatccctgaccactcattcagctgcctggcggccctggggcaagtgtttgtcccccatctcccaaaatggcggggtgcaggggctccctgcccggagtcccaaccctgccaaggcagagggaatggggaacagctgcgctggcccattccggctccatatggatttggtttgacaacaaagctccctctgtgtgttcccaagccccttacataaccaggggctgtgggcagaggaggaaaggaggaggaggtggagatggggaccaggagacaccaggatgggatggctggaaaggacacagggaccgggaggagagggcaggagacgagggccagagaggaggagagggtgggagcaggagggggaagtgctggtcttgacctcccagttctgcctcctgcttcctggggaggggagggtggagtccagccaccgacttctgcttgtggatgctttgtcttcttttctttggacctttcccaccagtcctggataggctgaggaggggccgtgggacctgtctggggtgaggtgaggtcaggtgttgggctggatgtgggaggctgttccttggccgcagcctgtaactgaataaatgccattaaaaggggaatccatttcctccctcactcctggcttccattgccttcccccaggccccagccctggttccagaatccctctgaccactcctcttgtgctcaggagggcagaataactgcagcctttccctgtgccctgccaggctggtcccgggccccctctcagcccactcatccagggatgcagctctggccttggcccacccccatcagagggcctgtggccctgatcaccgcactccccactctgtgaccagacgttctctcctgagcatcgctgaccctgcagctgtccaaatagagcaagaagtgaatgttctctttggggcacagctggactggcagccctgcagggtcaggtgagctgccagtcctgggtgtgttctcgggggtgggggtgggaggatcacgtcctgggctgagatcccttcagctcctcctgggcaggaggaaacagccatgcaggggcggccaggaggactgggtggcgggtggttctgggctctcccagcttcggttggggctgggaccctgggggacatgctctcctgggtgttcccaggctctgtgtctggcctgtgcctcagtgtgtgggttttctggcaccaggcttccttgggaagagcctctggttgtgcaccagccctgagggtggggctcatcccaggctgcaggggactgagggccgagctcttccaccttgaggacaaggatggttcctcagggctgggaggaggaggaggcgctggccaggaccttagattacgcagggcatggtgttggggcctcacagatgatggagaagccagagttcaggcacttggcatgacccctggcatcgccttcagttgatttagtgtctctgccctgggatattccatgggaccctgggctggcttctgtgtgcagaggtgggtgtgggccatagcccagacctgttgaaccagttgtaggctctggaatcctctgtccccaggtagtgaccaggccctgacaggccggtatctgtccctcccatcaccctcccagttatgggtgcagatgaccctgaaattgctaaagcctcagggcttgagcccagaaagtgtgagcaggctggtggggcagctggaggaaggccttgcaggttcctggatttgggtgccgggtgggctgagaggacagtccctgtcactgggactgggcacaggtgcagagaggctgagacgggcccagaggacagtgagtgtgtgttgtgtgggcgccgggccaggaagtgccctccatggggcagcaggctctgcagtaccctcggccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgccccttagaggctccgggctgcctggtgatagctcccagggacctgcaagctgacaaacaaagtctatacgagccagagctggggtgggaggaacccagtgggcctgggggaggtaaagcagcagcagctgctgtagctgagcccggcccacggccagccctgaggaatggaggaagagagtgccctggctgggggagcccctcaagccctggaagctgtatgtgggcatggggtggtgggggcgtgcagagaggaggaggactgagagctgggtgtgtgtgtgcgcatgcctgtgtctgtgtgatctggttcccgggtgtctgagtagggaccaatgtgtttgtgctggagaagcctgtgtaggttactgacatggggaggggtggggcttgctttcctcaccccgcttcccacgtcttcattgagtcctcatctgggggccctgttccactctccttcccgtgtgcagggccctcccctctggcgagtctgcctctcactcgctcagcccctttaaccctgctggctcctaatgagacttcaggtgtggaccctcgaaccctcagctgcacaggtctggaaacatccttgttcatcaagcaccaggctgaccatggtgtccgtctcagtgcccagcagatgttctggtgaggggaggcgggagtgcaaggtctgccgagtgagggttccttccgggaggaggcagggtgagcgcagaaaccactgctccaaaactcttaaaagcagagccgagagcctgaattcagaggctgtactgtggggcagggctggaatttgtggcacctgcagggctgaacgttgcctttgctgtccctgcttggggattttggggtactgggtttggatagagtgtgtcatctgcagagggagcactgttctggaagtggactctgctcaggtgtggggggcctgcctgtagggggcaccgtggtggagatggagcaccgctcatgacaggaggctggtgtctggtcaggctgagggatccgtgtgccagcccttctgggaaggctgaatggggcggaactggtcagggcctggcaccaactccaggaggtgctacacccagacagacagatggaaagccacctccctagaggcctcctccccctccccttctgcatgccaccacaccccagcagcgtctcctgaggctgggccatgggtgaatctgagtcgagggcagggcagagtgggagtggcagtgcctctgcctgtctccctggccgtggcaggtcctttgtcacgtatggaccaggagaggtgagtatgattgtggtagtggtgggggcagtggctgaggacccctctctttgctgggctggggcagagcttgaatggagaggggctgccttgtgcctgggaagggaggaccaggtgtcgctggtaccttccaggtcctgaatgcttgttctgtgcctagcccctgctgaggctgcggacgttacaaaccaggatgtgttttgaggctcaggacacctctgaggacttgctgctgttacccccatttaaaagacgaggactctgaagatctgaggtgcatagagtgtagggattaaaagtagttctggctgaattttaaatcctggttccaccatttttgagctctctgatcttgggacccttaatgtatttgctctgtgcctcagtttccccatctgtaaatgagaatgaaagagtaatcccacatccattggttgaaaacttcaataagattatgcatagcaggccgggtgtggtggctcacaccagtaatcccagcactttgggaggccaaggcaggtggatcacttgaggtcaggattttgagaccagcctggtcaacatggtgaaaccccatctctactaaaagtacaacaattagctggacataatggcgcgcgcctgtgatcccagctacttgggaggctgagcaggagaatcctttgaattcaggaggtggaggttgcagtgagccaagatcacgccactgaactccagtctggaccacagagtgagactgtctcacaaaaaaaaaaaaaaagattatgcacagcacctgcagcacagccccagggatgatttttaaaagtgaatccagggccaggtgtggtggctcatgcctgtaatcccagcacttggggaggctgagacaggattacctgacatcaggagtcagtgaccagcctggccaatatggtgaaaccccatctctactaaaaagaaatcccagattctgccatgccacagtgtccaagtcagtcacctgctcgcagtcggccctcaggccctgtggctcctgtttctgctgacttgtccagcctcacagtctggggaggccttggggtccccagcctgcgctgggacaggggtattattccgtcagcccttctgtggaacaagtagggaaggagtgatgtgacctccgtggctctcctgggacacaggttagtcctgtgggtgacctcactttagagagggctggccagctgtgccggaattaggaagtgggtacagctggacaaaaggtggctggagccagctctacagaagccacacctgctcatgagaagggtatccttgtgagtacaggggaaatggcatggagaaagacaaacactggtgggtggctctgccagcttcccctggggtgcttctggcgatgcccaggcctttgcacgctcagatctttgcaccccactgttttaacttggagaggagaggaggaagttagctgctctgaatggtgttgctgctaatctctacagcactttcctgtaaattaggaacggtaacacacacacccctcccccaccccgttggagaagccctgcaccagagcatacagtttggcaagtagggggagggctggagcccagcctcacttgccaccctggccaggccgtgattgcccagggtgcatactgtggctggtgctctgccacctgctgtttctgtcctcagggtaggacacaaggagggcaagtagggctagtcagtgagaggcacaggtgatgcgtgttctagggcttgagatcagctgcttccatttcagtaattgtctttggaggtacgttgtttgctcaagcaacctcccttcaagatagtgcctttttctttctctctctctcttttttttgggggggggaggcagagttttactcttgtcgcccaggctggagcacagtggtgtgatctcggctcactgcaacctcggcctcctggattcaagcgattctcatgcctcagcctcccgagtagctgggattacacgtgtgtgccaccacgccctgctaatttttgtatttttagtaaagatagggtttccccatgttggccaggctggtctcgatctcctgacctcaggtgatccgctcgcctggcctcccaaagtgctgggactataggcatgagccaccgtgctggctgatagtgccattttttaaaatccctatttacccagtggaaaacctgagacccggaaaggtcattcacactcccagaagtgatggttggtccagaattcaggtccaagtgtgagacttcaacatttacattccttattttttcttcttccttttttttattttaatcaaattattacttcaaaatgtatcacactcatcagtttgaaacagttaagcagtacaaatgggaatatgagagaaagtcactctcccacccgccctcttgagaggcaatagccttgttttgcatccttctgagtactctattcacataagatgtatctgaatatgcatgtaattcttttgtgaaagtgcatttggagatcactgttttacacctgccttttacatcttaatattatgctttggagatcagttgacatcagcatgcatcgatttgcatcctatttttcacagctgcatagtgtttcgttgtgtgtgcctaattttttaaaacaggtgcctgtgcatagatttcatgtttccatcttatgctgttagaaaaagtgctgcagtaaagatcctaacagacaagtctctttgcaaatataggaaacttttctgtggaataagcttctggcacggaagccccggggtaaagggtattttgataaatattgtgaaatgtcttcccagaaggtggcctggttttcacttccagcatacatctgtgagaggtcctgcttcccacactcccccagcactgtgtagctcaggacccttgttttttgctgttactatttgtgaaaaatggtatctcaaccacaccggaagttttaaatgtagataaatgtcttatgtgccatttatatttctctacagtaaagtatatattcatagccttagcttatttttaaattatgttccttcattgtttggggagtggggggtagacttgcatgagtatgttataggctaagggaattaactgataagttaatatatgtacatcttgcaaatgcacttcttagttttttactcttttaagtatgagcttgctcacttgctctctgtatctcacttaaactttatgtgagtgtattaatctttcattatttagcttctgaatttatatttcttcaatctccattcctttttttttttttccttgaaatggagactcgctctgtcacccaggctggagtgcagtggcacgatctcggctcactgcaacctctgcatcccgggttcaagcaattctcctgcctcagcctcccgatttgctgggactacagacatgtgccaccacgctcggctaatttttgtattttttagtagagaccattttggtcaggcaggtctcgagctcctgaactcaatcaatctacctgccttggcctcccaaagtgctgggattactggtgtgaaccactgtgcctggccctcgttcttttttttatatgaaaatatttcaaatatgtaaaaattaatataacagacctccatgtgataatcagccagatttatcaagtgtgaaccttatcccatattagatattttttcctttaagaaataaaatattacaagtatagaactaaagatgtgctactatgatctattctattcttccccacattcctttttttttttttttttttgagatggagtctcactctgttgcccaggctggagtgcagtggcgcgatctcggctcactgcaatctctgcctcccagatccaagtgattttcctgcctcagcctcctgaatagctgggattacagacgcacgccatcacgcctgtctaatttttgtatttttagtagagacggggtttcaccatgttggccaggctggtctcaaactcctgacctcatgatccgcccaccgtggcctcccaaagtgctgggattataggcgtgagccaccgcgcctggcctattctttcatcatacacataagcacgcactatttacaaatatacacaaacttagtgctgttttctgattcatcctttatctatttgcaacactttaaaaagttaatgttatgttttcacattgatcccagttgacctgtatggattaatttcttcagttgacatggctatataatattcagttgcgtgaatgtagcacagcttatgtagccatccctctcctgacgatagttaagttgtttccattttttgctattgtaacactgctaataaacatgcttgaatggggtgtcccgtacaagggagggttactcggggctgtgcccggaaatgcaatcgccagattgtaaggtatgcacgtgttcagcctgactacatattgtgaagtgctcttctaagcctttgtatcaactggtactcccaccagcaatgtgtgagaaactatatttggttttaatctgtattccctggttactagtgagcctgagcatcttttctgtctattaggtgtttgaatttaatctgtgaattgcctttttgtgttcttttttattcctttgattgttttggtggtggttatgataaaatgcacaagcacaaggttctgttgacctgttgaccgtcttaaccctttttatgtgtatagttcagtggcattaagtacatttagaatgtgctaccatcccgccatccagctccagaaatcttttcgtctcgtcaaactgaaacatcctcctgctagtcaatggctcatctccttttcccctcagtccttggcagccgccattctgctttctgtgtctatgagtttgactgcttttgagtacctcctataagtggaatgatacagtatttgtccttttgtaactggcttatttcactttgcatagtgtcttcaaggttgatccatgttgcagtgtatgtcagaatttctttttttcttttcttttcttttctttttttttttttctgagacagagtttcgctcttgctgcccaggctggagtgtaatggcgcgatctcagctcaccacaacctctgcctcctgggttcaagcgattctcctgcctcagcttcccgagtagctgggattacacgcatgcaccaccacacccggctaattttgtattttcagtagatacagggtgtctccatgttggtcaggctggtctcgaactcccaacctcaggtgatctgcgtgcctcgacctcccaatgtgctgggattaaaggtgtgagccattcacccggccgtctttggattttatacagcaaaactccataatatttcctttacatgaatttcctttctttttcaggctgaataatattccattgtacgcatagatcacattttgttcattcatccattgatggatacttgggttgcttcccgattagctattgtgaataatgctgctatgaacatgggtgtacaaatatcgctttgatattctggtttcagttctttggggtatataccccgaagcacagttgtgggatcctatcttgtctcttgttttctctttgcttccatgttttttctcattgtttcgtgggaatactgatattatatattcaagtatttgttgattacatgcactgtacctgacttgtttaaagcctgatgtcttgagtactgtgcacccctgtgcctggctgagtagtggaggaactttgaaagggtctgttctggagagggggtgctgctctggagaggcggtgctgctttggagatggattaatcaggaacttgggtgctgattctaggaggtactgcatctagaaagatgggaggtggggagtgcaacttccccaattttgcctttaacttcagatccttggggtgggtgcattgcttctcctgggatggaggggtgccggggagcccctgaccaggacctggagcaggtccacacaggcactggatttgtcctttactttgggcccaggctgcactcttgattccacctcctcacactggcttcagctttctcaccctcagaatggaattcaaagcctctgcccctcccaggcagacaccaaggtatgattttcaagtggttggtgtcttgtgactggcagctgataaacgggtgatacagtgtttctatacaggagtctgcagtgccaggctgcaggggcggacgggagggggtcgtggtgggtagcctgtggagcctgagggtgggaacagagagacttcttttgctgtaggtggaagcctgtctggctcctttccctcaaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctgcagcgtccagccagggactgtgccgcaggggccagaagatatctgacctactgtcactgcctcttccactctgttccacctgcactggagcgatgctatccgatgaacagatccatttattaattcaacacgtttgtattgagagcctgctgggtgccgggcactattgtcaacatgggtaatacagcagcaagcaaaacaagagaaacatctttgcaagcaggggagggggcctgcagtgttgggtgtgtggagttgttgctgggaagtagagaagctgagtaagagctggacaaagaggccaggcacagtggctcacccctgtaatcccagcactttgggaggccgagtttggcagatcacttgaggtcaggagttcgagaccagcctggacaacatggggaaaccccgttcctactaaaaatacaaaaattagctgggtatggtggtgcatgcctgaaatcccagctacttgggaggctgaggcacgagaattgcttgaacccgggaggtggaggttacagtgagccaagatcacacaccattgtaccccagcctgaatgacaaagcaagactttgtctccaaaaaaaaaaaaaaaaaaaaaaaatagagaaaaggaaagctggatgaagagagatagccaagcccatgtctacggaaaagcattcttgactgagtgaacgaaagtacaaagcctcagaggagggagcatgcctaggtagccccctagacctggtgaggctggtgcgtggggcagcctccatggagaggagttgggcaaggagggaggaggtgctggccagtagagcacgtgtgtctctgtgcgtcagagcaaggacccgggctctccccgtaagtgagaagagtccatggaggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaagttcggcagggaagccagaggagtccgcagcccgggagacctggcctacagcggagagagtcagtccatgccagtggtgggatgtggctgcaaaaaatggtcggattcatggaagtctggtgtccatctggcaggcgttagtggtcccacgaatacagctgtgtgccttgaacacatactgcagagcttccagagagcaccagggctgtgggggctagagactgtgtctcgtgcggaagcgtggctgaggaggggcttgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtgggggttctggctgaagtagccagaattccagtgccagctccgctcctcacgagctgtacaacctgggccggttactgacccctttcccaccttagttccctggctctacaatggaggtaattatcgtgttgaactcacagggtcgagatcatatttaatacttgcacagcccttagaagcatctagcacagtggtcctcagcatttggaaatgtctggaaacattctgtcacacctggggagtgggatttccttctggtgtctagtgggtagaggccagagatgctgctaagcgtcccacaatacacaggacagaccccgcaacaatgaactgtctggcccccaaagttagtggggcagagattgcaggatcctgattccttttcttccttttttttttttttttttttgcccctggctatgagtaagagatcctggtttcgcacaaagtgaacgtgcagtacattgtttcagttgttaattcgccatgcaatacatcgttagtcacgtattattgtttgtcaaatgtgtataaaacatctgccacattcttggcagtttaatagaatctagagatataaagaagttcctgaccacagagttcatagcctcacaggcaagataggaaaacacagaattatataatacgaaattacattatatcatagagcatattctatagtaagttactccgattggcttttggtattaaaatgtcttcagtttcagaggtcccaggatagtgggcaatatttgaaagccagtaaatataaaataaaatatattacctgtgtgaaagagaatttttcaggcacaataatattttaaagagtttatttgtgtaagaagtgaattgggaaacagaaaaccgaaagaggtttagtggcccaatgacagtttcagaggcaggtgtttggagagtgaatgtaaaagcaaaatgaagaatttatttgatttaattggttgcaattacaaaattgctttgtttggtttaccttgttggaagtttcctagtcacataaccatatgttagttggctacttatgattggctgaagttttatttgtgtcaaacagaagcatttaccataaataaccccagttaagatttgattatgctgtcttttaagcaaggttaaggctgttgttaaggcctcattggttttgtttggtaaggaatttttcaggcctggtctccaaattttgctttaacaattccttgcttctggttattctctcagcaagctgatagtgtgactagatgacacagtattactctctgttaccaccaccaatgtagtcactgggacaaagagtcaggtagatgttgttgtcatcatcagtaggtaggttggggatgagaattccatggccacagttagcagttacatagtcagtgttgctttcctcaagttgaatgatcctcatggtaactgtttgatatttgagcagctgttggaaatcatttagaacccttgagagaatacaaggcaccaggggggtaaacataataattataaggagaataatagccaaggattgaaaaattcctctgagcaaagattcccaggagccaagacttaaccagctgagtgaatcaatggagaaggcagtgcccatctaatgaaaaacccatgtgtgttctttaaggtattttaagttttcggtaatacctgatttgttaacataaaaatgacactttttttttttgagatcgagtcttactctgtcgcccaggctggagtgtagtggcgcaatctcagctcactgtaaactccacctcccaggttcaagtgattctcctgcctcaacctcctgagtagctgggactacaggtgtgtaccaccacacccagctaatttttgtgtttttagtagagatgggatttcaccatgttggccatgctggtcttgaactcctgacctcaggtgatccacctgcctcagcctcccaaagtgctgggattacaggtgtgagccaccgtgcctggccaacaccttctttttttttttttttttttgagatacagtctcactctgtcttgcccaggctggagtgtgcagtggtgtgatcttggctcactgcagcctctacctcctgggttcaagtgattctcctgtctcagcctcctgagtagctgggaatacaggcgtgtgccaccacacccggctaattttgtatttttagtagagacagggtttcacccaggctggtctcagactcttgacctcaggtgatccacctctctcagcctcccaaagtgctgggattataggcgtgagccatgcgctcggccagcaacacctttctaccaattagggaacaaggtctccctttttgagcagttaaagtagcaagaagtcttctattgtacagtactactgaggccaattcattcatcccagattgtactgcttaagataattcgaagtgtcaattaaactttttcagaagttggtaaaatattaattgatttttttcaattcactcaactgagagaaacgggctcttacagaagtatgaaatccagaaccccttcgtaagactgtgtctgggatattatgattctcttttgtgaggggtcactttatgtacaaatgactctaaggatttgtatggcaattgaagagtcatatctagtcattttaggtagaagatagcccacaccacagatccagactggctaggtagaacacctttacatactttgttgctgcataaaatgaataattcggtgttatcgatagaaagggtcaaagtgcatcctattacccacgagttgggggtgatacgaatgtcatggttattctccgtcacatctgcgtctgcacagcgccacgttgaatggttatggtttcaattggagtaggaacaaaaaacatttctatgaatttgataaaatgactgtatgccatcatcaattagggatgattggttttctttttatttgagacggagtcttgctgtgtcactcaggctggagtcagtggtgcaatcttggctcactgcaacctctgcttcccgggttcatgcgattctcctgcctcagcctcccaagtagctgggactacaggcaccaccaccacgcccagctatttttttgtatttttagtagagacagggtttcaccgtgttagccaggatggtctcgatctcctgacctcgtgatccaccctcctcggccccccaaagggatgactggttttctttccaaatatgacctgagcattgatctgtccaataagcaagactgttatgtacattatgtagtggatctattgaggcatacgattttcctgtagcatttccattgaaccaatgtctagttctagtaagttctctgatgatatggttgaggctttcatggtcatgttcagattttatatatgtgtctcatgtaggaatctagtcttcataatctgtgtcaaacctaagaatttgagtacagagggattctggaacactgcccagatttggcccagttccattcatgttttctgtgcgtagagataagttaccattaatgacatcaatcgtagttgtaggccatccctttgcctctgttgcttcttccaagagctacactggttgatcataaatatcagccaactgccaagggaaggataccaacccttttcataacgccattttcctgaattgctcactcaagtgtgtatgggagcaggttctaatattagttgtgattctttccatttatctagaggattacgtagccaccaattgctttgcttagtagtgaggatggcttcatgttgagcagtagatcttagaggatattcagtgtggataatgaaattccctaacgaaaataaaagtgtgaaccttttgtgctaaaacaaaacaaaaacaagtctgagtcaatagaagggggccacatggagtcttgtttcattgtcttgggaaagctgtgtctatttcatgatatcatctacttttatggaaggatttctcttgggtatccttaattttgtttttatattattattattattattgagacggagtttctctcttgttgcccaggctgcagtgcagtggcacgatcttggctcactgcaacctccacctcccgggttcaagtaattctcctgcctcatcctcctgagtaactgagattacaggaatctgccaccacacctggctaatttttgtatttttagtagagatggggtttcaccacgttggccaggctggtctcaaactcctgaccttaggcgatccaaccaccttggcctccttaagtgctgggattacaggcatgagccaccacacccggcctgttatccttaattttaaatcacatgtggattgacaagtccaaaactctaagagagctctcattagctgtgaaacatgtacccaaggttcaagatcctgacattttgctacggtgagaatagtaactgaaactggtgtagtgtctttcaatggggctcaagggcagttgttctctgctgtcttttacaaaagagctagtctcggccgggcacagtgacttgcgcctgtaatggtagcactttgggaagctgaggcgggcggatcacctgaggtcaggagtttgagaccatcctggccaacatggtgaaaccccatctctactaaaaatacaaaaattagccgggcatggtgacacatgcctgtaatcccagctacttggaaggctgaggcaggagaatcgcttaaacccatgaggtagaggttgcagtgtgccgagattgtgccaccgcactccagcctgggtgacacagcgagactgtatcaaaaaaaaaaaaaaaagatccagtttccagattccaggtcacgtaaggtgggatcatcaataggcaggtcacagaaagcctccttcacctggtgggatatactttggcatcatacatcaagaccttgcagtattgagtcacatcagagccaccagtagagtggataaatgaagttctgttatgaaaggcacaagtcgttcagtatttattttgtgaagggccactttatgtgttcccctaggggctgatgttcttgccataaaggtcggtgataattcttttggccaaggtaattcagttgactctgttaatttagctaattttagttttgtgataccatttctgcattcagcctttccagaagagagagtgatgagggcaatgatagtgccgtcaggtctgtaaactcttatttggtggataacctgtcaaataaagcgaattgccctagcactagagacctcctcggcaggtaggtgggatttcatctttctggagcctgagcatctccaaagaagagctgccgcatggagcttccctgactggtgacctccaccctcttctctccagagctctttgacccagaggaatctgcaggaatggagggagttggccaaagtagggagatttttactcagaccatatccaggtgagcacacaacagccttttgggcttgggctgatgcgtgcatttctgtctgtacatgcgtgcctggaagtgtgcagatgagtgtgtgagagagggtaatggccatgcatccttgcatagacaagaacatggggtgcacttctgcatgtgcacagcccctccccaacccgggcctgtggtgctgtcctgcccctagcccagagctggcctctgttggctttgagaccctagctttgcactgtggctttgctcggccttagagaccagctgctcccctgctgtggtctctcatagtggagactgatccctggccacccattcagctgcctgagggccctgggaccagtgttcatccccccacctcccaaaacagaggtgtgtaggggttccctgcctggagtcccaaccctgcaggatggagaaaatgggcaccagttactgtgacccattccggctccatatggatttggtttgacaacaaagctccctctgtgtgttcccaagccccttacataaccaggggctgtgggcagaggaggaaaggaggaggaggtggagatggggaccaggagacaccaggatgggatggctggaaaggacacagggaccgggaggagagggcaggagacgagggccagagaggaggagagggtgggagcaggagggggaagtgctggtcttgacctcccagttctgcctcctgcttcctggggaggggagggtggagtccagccaccgacttctgcttgtggatgctttgtcttcttttctttggacctttcccaccagtcctggataggctgaggaggggccgtgggacctgtctggggtgaggtgaggtcaggtattgggctggacttgggaggctgttccttggccgcagcctgtaactgaataaatgccattaaaaggggaatccatttcctccctcactcctggcttccattgccttcccccaggccccagccctggttccagaatccctctgaccactcctcttgtgctcaggagggcagaataactgcagcctttccctgtgccctgccaggctggtcccgggccccctcccagcccactcatccagggatgcagctctggccttggcccacccccatcagagggcctgtggccctgatcaccgcactccccactctgtgaccagacgttctctcctgagcatcgctgaccctgcagctgtccaaatagagcaagaagcgaatgttctctttggggcacagctggactggcagccctgcagggtcaggtgagctgccagtcctgggtgtgttctcgggggtgggggtgggaggatcacgtcctgggctgagatcccttcagctcctcctgggcaggaggaaacagccatgcaggggcggccaggaggactgggtggcgggtggttctgggctctcccagcttcggttggggctgggaccctgggggacatgctctcctgggtgttcccaggctctgtgtctggcctgtgcctcagtgtgtgggttttctggcaccaggcttccttgggaagagcctctggttgtgcaccagccctgagggtggggctcatcccaggctgcaggggactgagggccgagctcttccaccttgaggacaaggatggttcctcagggctgggaggaggaggaggcgctggccaggaccttagattacgcagggcttggtgttggggcctcacagatgatggagaagccagagttcaggcacttggcatgacccctggcatcgccttcagttgatttagtgtctctgccctggggtattccatgggaccctgggctggcttctgtgtgcagaggtgggtgtgggccatagcccagacctgttgaaccagttgtaggctctggaatcctctgtccccaggcagtcaccaggccttgacaggcgggaatctgtccctctcatcacccccccagttatgggtgcagatgaccctgaaattgctaaagcctcagggcttgagcccagaaagtgtgagcaggctggcggggcagctggaggaaggccttgcaggttcctggatttgggtgccgggtgggctgagaggacagtccctgtcactgggactgggcacaggtgcagagaggctgagacaggcccagaggacagtgagtgtgtgttgtgtgggtgccaggccagggagtgccctccatggggcagcaggctctgcagtaccctcggccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgccccttagaggctctgggctgcctggtgacagcttcggggacctgcaagctgacagagtctccaggagccagagctggggtgggaggaacccactgggcctgagggaggtagagcagcagcagcagcagctgagcccagcccccggccagccctgaggaatgggggaaaagagtgccctggcttgggggggccctcaagccccggaagctgtatgtgggcatggggggcgggggcagagaggaggaggactgagaagtgggtgtatttgggcaggtgtgtgtgtgtgaccaagcttgcgggcgcctgagtatggactagtgtgtttgtgctggaggagcctgtgtaggttactgacatgggagggccggtgtgagctgcagggaccggagagctgctggaaggggctgtctatgccttcaggctctgagtgtggatgcagctgggcctgttcaggcagattcaccagaggggctactgcgcagagcctgggccctggacacctagaagggcccctcctcccctcgtcttccctccctcatggcccacctttactctgagggggtgggcttcctgcgggggacaaactggagagggactctcttgccgccttctctgttcctggggacaggctgctgcagggtggagggcttgcttttcctgcccaccctcatctttgccgagtcctcgtctgggggccctgccccactctcccttcccaatgcagggccctctcctctggcgagcctgccttgatactccccggctcaacccctttaaccctgctggctcctaatgggactaatgggatttcaggtgtggacccttggaccctccgctgcacagttccagaaacttgttcatcaagtgccaggctgaccatggtgtccgtctcagtgcccagcagttgttctggtgatgggaggtgggagtacaaggtctgccgagtgaggcagaggaaaggggtttctgagcccagatctccggtgctccaagacactcaaaaccagagctgagagcctgaattcagaggctgtactgtggggcagggctggaatttgtggcacctgtgtagggactccagggctgaacgttgcctttgctgtccctgcttggggattttggggtactgggtttggatagagtgtgtcatctgcagaggcagcactgttctggaagtggactctgctcaggtgtggcgggcctgcctgtggggtcaccatggacaggaggctggtgtctggtcaggctgagggatccgtgtgccagcccttctgggaaggctgaatggggcggaactggtcagggcctggcaccaactccaggatgtgctacacccagacagacagatggagagccacctccctaggggcctcctccccctccccttctgcatgccaccacaccccagcagcatctcctgaggctgggccatgggtgaatctgagtcgagggcaggacagagtgggagtggcagtgcctctgcctgtctccctggccgtggcaggtcctttgtcacatatgggccaggagaggtgagtgtgattgtggtagtggtgggggcagtggctgaggacccctctctttgctgggctgggacagagcttgaatggagaggggccgccttgtgcctgggaagggaggaccaggtgtcgctggcaccttccacgtcctgagtgcttgttctgtgcccagcccctgctgaggctgcggacattaaataccaggatatgttttgagactcaggacacctctgaggacttgctgctgttatccacatttaaaagacgaggactctgaggctctgagaggttaagtacctggtccaggtcacctggtcagtttctttcttttttttttttgagatggagtcttgctctgttgcccaggctggagtgcagtggcgatctcggctcactgcgagctctgcctcccgggttcacaccattctcctgcctcagcctcccgagtaggggactacaggcgcccaccaccacacccggctaattttttttatttttagtagagacagggtttcactgtgttagccaggatggtctcgatctcctgacctcatgatcctcccacctcggcctcctaaagtgctgggatgacaggcatgagccaccgcgcctgacccacctggtgagtttctgagctccagacaactcatcccaaatttcatgggtgcatagagtatagagattaaaagtagttctggctgaattttaaatcctggttccactattttcgacctgtctgattttggaacatttaatgtattccttctgtgcctcagttttcttctgtgtaaatgagaatgaaagagtactcccccatcaatttgttgaaaacttcagtaagattatgccaggagctgcagcacagccccagggatgatttaaaagtgaattcaggacagggcgtggtggctcacgcctgtaatttcagcactttgggaggctgaggtgggaggatcccttgagcccaggagtttgaggccaccctagacaacatagtaagaccttgtctcaaaaaaaaaaagcgaatccagtggtgtcactctttgttatcaatgccctccagtgacattcatgacacccaaacttagaatctgagcttttagggtggcctgtgacatctataccacgtgtccccgtggcctccctggcaccccctttccttcctggctgtctgccaccatatggaactttctgtgccttgcacccagccagctcagagtcttgggcacttctctcagtctggaaccttctcttgcctaccccatcttcccatggctgcccttcatgtaggcctccggtttatagccggctcctcagagacatggttctatccccccagtggccaagggctggtggccctcactctctgcccctgtgccctgtgttagtggtcctgtggttgtcattgccccgtcatctccaccatttcctgtttgccgtgtgtctgtgccccccaaggatgaatgccatgagtccagcatgtcaccctgtttctgtcctgccacagtgctcgagtcagtgccctccctgcttgcattcggcccacaggccttgtggctcctgtttctgctgacctgtccagcctcacagtctggggaggccttggggtccccagcctgtgctgggacaggggtattattccagtagcccttctgtggaacaagtagggaaggagtgatgtgacctctgtggctctcctgggacacaggttagtcctgtgggtgacctcactttagagagggctggccagctgtgccggaattaggaagtgggtacagctggacaaaaggtggctggagccagctctgcagaagccacacctgctcatgagaagggtatccttgtgagtacaggggaaatggcatggagaaagacaaacaccggtgggtggctctgccagcttcccctggggtgcttctggcaacgcccaggtctgtgcacatccagatctttgcactgcgctgttttgacttggagaggagaggaggaagttagctgctctgaatggtgttgctgctaatctctacagcactttcctgtaaattaggaacggtaacacacacacccctcccccaccccgctggagaagccctgcaccagagcatacagtttggcaagtaggaggagggctggagcccagcctcacttgctgccctggccaggccgtgattgcccagggtgcatactgtggctggtgctctgccactgctgtttctgtcctcagggtaggacacaaggagggcaagtagggccagtcagcgagaggcgcaggtgacgcgtgttctagggtctgagatcagctgcttccatttcagtaattgtctttggagctacattgtctgctcatacaacttcccttccagatagtgccattttaaaaatcccatttacccaaaagaaaacctgacacctggaaaggtcgtttgcactcacacaagtgatggttggtccagaattcacatccaagtgtgagatttcaatattttttttcttcctcctttttttaaatcaaattttatttgaaagggtatcacagtcaccagtttgaaaaaggtaagcaggccaggtgtggtggctcacacctttaatctttgcattttgggaggcagaggcaggcgtgtcagttgagcccaggagtttgagaccagcctgttcaacgtggtgagaccccatctctccaacatttacaaaactagctggtcatggtggtatgtgcgtgtggtcgcagccactggggaggctgaggtgggagggttgcttcagcctggtgggtggctgcagtgagctgagattgggcctttggtcttcagtctgggctacagagcaagactctgtctcaaaaaaaaaaaaaaaattataaaggtaagcagtacaaatgggaatatgagcataagtcactctcattccagacctctgacccccaggacttttctcttgagaggccatagcctttgttttgcatccttctgagtaaacctattcgtgtacagacatatctgggtatgcatgtaactgttttgtgaaagtgcatttggagatatggatatcgttgttttcacccatcctaagttttgatgctatggatactatgttttggagattagacgataccagcacgcataggtttgcagcctctttttcacagctccatagtgtttccttgtctgtgagcagatttcaagttgtttccatcttaacccctagaaaaagtgctgttgaagatcctgacagacaagtctgtagaaacataggaaactttgtagaataaagttctggccatgggccaaattccctctgagaggtagctctagtttttcttcctagtacatctatgagagctcaggtccctcgtgttttgctgttatgatgaatgaaatatgctgtctccatcacgctggaatttgtagatgtagatgaccatagtttcttatttgccattcatttctttacattaaggtaaatattcatgtcctttggctatttttattttatttcttttttcttttcttttttaagacagagtctcgctctctctcccaggctggagtgaagtggcttaatcctggctcactgcaacctccacctcctgggttcaagcgattcttctgcctcagcctcctaagtagctgggattacaggcacctgccaccatgcctggctaatttttatatttttagtagaggtgggggttttaccatgttggccaggctggtctcgaactcatgacctcaaatgatccatccaccttggccttccagaatgctgggataataggtgtgagccactgcgcctggccctttgcctatttttaaattaggtttcttgtttttttttttttttttttttctgatttacgtgagcacatcataggctcagtgaatttactgatatgttaggtataggttgcaaatgtactttagtttttcagtgtctttttttttttttttttttttgagacggatttttgttcttgttgcccaggctggagtgcagtgcaatgacacgatcttggctcactgcagcctccacctccttgggttcaggcaattctccagcctcagcctcttgagcagctgggatcacaggcgcctgccaccatgcctggctaatttttgtatttttagtagagacggggtttcaccatgttggccaggttggtctcgaactcgtgacctcaggtgatccacccgcctcagtctcccacagtgctgggattacaggcgtgagccaccgctccccggctcagttgtcttttaagtgtttcatttgtcttctctctactcctccctctctctcttgcacttgctgtctgtctcacttaaattttatgtaggtgaatatattcatctttccttgtttagcttctcaatttatatttcttcactatctctattaatatgaaaatatctcatctatataaatattaatgtaacagagttgcatgtgataatctgccaggttgaacaaatgggaatattatctctcatatgacgttagatttttttcctttaagaaataaaatattgcaagtagagaaccaaagacatgcccctgtgacctcttttattcttccccatctccccagaatataattatcacttaaagttgggtgtcaacctgtatttcattctttcatcatacacacaagcacacactgtttatacacataaataatgttgtttttggacgcatactttgtttttgcaacacctttaaacataagtttttacttttattattttatttaagataggatcttgctctgtcacccaggctggagtatagtggcgcgatcatagctcgctgcaacctctcatctcctgggctcaagtgatcctcccaccttagttagcctcctgaggaactgggataatcacagtcataagccaccaagcccagctaagttgtttattttatttttttattttttaaataaagatgaaatcttgctatgttatccaggctggtctcaaactcttgggctcaagcaatcctcctgccttggcctcccaaagtgctgggattacaggcatgactttaaaaagttaacattatgggccaggcgcggtggctcacgcctgtaatcccagcacactgggaggccgaggcgggtgaatcacgaggtcaggagatcgagaccattctggctaacgcagtgaaaccccgtctctgctaaaaatacaaaaaaaaaaaaaaaattagctgggcgcggtggggggcgcctgtagtcccagctacttgggaggctgaggcaggagaatagcgtgaacccgggaggcagagctgcagtgagctgagatcacgccactgcactccagcctgggtgacagagcaagactctgtctcaaaaaaaaaaaaagttaacattatgtcttcaagtttatcccaattgacccatatggattgatttcttcagtttacatggctatatagtattcaggtagcacagtgtatatagccatggctgtactgatgatagtgtttccagtttgtttgtttttttttgctattgcagcactgcctaataaatatcctggagtgggttgtacttatatacttcaaaatggaattaccagattgtaaaatatgcacatattcagcctcactagatactgtgaagtgctcttctaagcctttgtgtcagtttgtacttctgccagcaatgtggaaatgagatttggttttaatatgtattccctggtcacgagtgagcctcagcatcttttcatatgtccaccaagtgtttgggtttaatctgtgaattgcctttttgtgttctttgctttttttttttttttttttatttctttgattgttttggtggttgttatggtaaaatgcacaagcacgaggttgtatttaccatcttaactctttctgtgtgtatagtgcagtggcattaagcactttcagaatgtgctaccgtgctaccatcccaccatccatctcccgaactctcttcatcttgccaaactgaaacatcccacccactagtcaagaactcctcatttccgcctccccccagcccttggcagccaccattctgctttctgtgtctgtgagcttgactactttaagtatctattctaaatggaatgatacaggacttgtctttttgggactggcttatttcacttcgcgtagtaccttcaaggttgatccatactggtagcagaatttcctttctttttcaggctgaataatattccattgtatgcgtagaccacattttgtggatccgttcatccactgatggacgcttgggggttgcttccacattagctattgcaaagtcaataatgctgctgtgaccacgggtgtacagatatctctttgacatcctggtctcaaatattttggggatatacccagaagtgcagttgcttgatcctatcctgtcccttgcttttccctttgcttccttgttttttttttttctttttgttttatgggagtgctgatatattcaagtatttgttgattgcatgcattatgcctgacttgctcaaagcatgatgtcttgagcacttagcaaccttgtgcctgctgagtggtggaacagttctgaaaaggtctgttctggagtgggggtgctgtttcggagagcgatgaatcaggggcttgggtgctgactttaggaggtgcggctcttggaaagacagagtgtgacttccccagtgtggtctccttccttttcctcaccacttctcctacctaaccccaagaatgagtccttgagtctgtctcagtaggtggatctgcattcagtgcagggcagagcctgggtggcagtgcctctccttgcctccctggctgctacaaggtcctgtgtagcatctggtgtggacccagcagccaggaggagagctgagtgtgattggggtcgtggtggggccagtggcagtggatctctctctttgttgggctgggccagcgcttgaattgagaggggctgccatgtgtctggggagggcagaacccagcgtcactgacaccctccagatacagagttcttgctctgtgtttggcccatacctaatgttgtgaagtggaaatactggggtgtgttttgaggctcagaacacctgtgataacttggtcgtgtgtgtgtgtgtgtgtgtgtgtgtgtgtgtgtgtatgtgtgtgtatgtgtatatataaaattattttccttaacaccactgacctgaaggcagttacacgtaatttacaaatgaggaatctgaggctttgagattgtcaaggtcacctgaccagtgactgcagaggctggattggcctgtgggcctgagtccgtaccccttttcactggctcctcctggaggccacatgtaccttgcgcttcctggggcttggtcctggggtttcatctcaggttgacccccgttaggaggaagtaagtaggaaggaaggagatttcctgggtattagggtgtcctcaagcctgcagctctcctgggactgcacagagtttactgtcggacatcagttctgatatggtgcagcagacatggagctggtaagtggttaagatcagtcggacatgacaacctccagttctgcagaagccacttcatttgcctggggataaagcaggtccttgtgagctcatcgacatgcatttggcagaaagtgcgctggctctgccagctcccagtgtgagcttctagcaagccccttgtgccttagatgcccaggtcttttcagaataagcctggcttgttttaacttgatgcaacttgctgctcacagtcatcttattgtttgctgatgaattcagacctccattcatttaaatatttgtcagttatctaccatgtgtcaggcattaaatttagtgctggagatactatgggacataagaagtccctgcttgctgggagtgcgtggtctaattggtacttgggacagtgtggtttaactgccacaaagttaataaagcagcatgatgtgacagagctggatgtgggggagtgaggaagcttctctggactgggtggtctgaaccccatgcagggaggaaactgtggctgggaggagaggaggccggaagagaggtctgggcttgggtcccaaccactgattccagatctctcaacatttgtaacacgaccaactcctgttcttttttttttttttttttgagacaggctagagtgcagggggacgatcatagcttactgcagcctcgatctcctggactcagggggtcctcctgtctcagcctcccaagtatctaggactacaggtgtgtgccaccacacccggctaattttatttttatttttatagagacggggcagagtctgcagtcacatgccttgcaagtagcagagacagggtttagtctcggtagccagtgcctagggcacaggtcttggccagaggagagaaggctcaggtgaaccagtttcatctgacctgcttgctaactcaaacatggctgcccaactgcgtgggctggcaaggtatgtgaggtgggtagctgggtggcccgccccttgcaggcactggggcaggatatcagggggtccagaagaggttgggtttaggcagagtagaggtgattgtgtgggccgggggagcaatgtcaccttgaatgtgtttccatacccagggcccagatggctcaggaggagggggatggggacggggagagtgaggtctttttgactttgatgtgctttgactgcacatcagagtcaaacgagtcagaataagcgggacccctccacaggcatctcagccctcctaatttagcctttctgaagtggagccttgggagccgatgaagcttaataaactctcctggtgcttccagtaggcacttgagggtggacaccaccgtcttcaggtcataggaagtgtgagctagcaggaatcctggagattttctagcccaacagtgtccggtcaaaatagaatgggagccagaaatacaagccacatgtaattttaaattacttttaaaacatttaaatttagccacggttttaaaaagtaaaaataggtgaaattcgttttaatattttaacccaatatagccaaaatcttggcatttcaacatgggatgagcataaaataatgaaggtgatattttattctttttttggggtactaaatctttgaaatccggtgtgtattttccacttaaagcacatgtcagtgtggactggccccattgcaaatactcagtggcctgggactggggtgaccaagtgggatgtggtggggctggtgcagtccaccattctcacagcaggcatctggggtcaggggaggcagggcactggctgtgctggaagcaggggattggctgtgctggtgggaagccagattccagccccagacactggtacctttggctttagatccttggggtgggtgcattgcttctcctgggagggaggagcgcccgggagcccctgaccaggacctggggcaggtccacacaggccctggatttctcctgtatcctgggcctggccctgctctcttgactcccacctcgtcacagtggcttcagctttttcaccctgagaagggaattcaaagcctctgcccctctcaggcaggcaccaggatatgattttcttttttcttttctttttgtttgagacaggatctgacttggtctggagtgtagtagcctgatctcagctcactgcagcctccacctcccgggctcaagtgatcctcccacctcagcctctgaagtaattgggattacaagcacatgccaccatgcccggctaatttttgtattttttatagagatggggtttcaccatgatgcccaggctgttcttgaactcctgagctcaagcaatctgccctcctcggcctctcaaagtgctgggattactggcatgaggcacggggccctgccctgggtatgattttcaagtggttggtgtcttgtgactggcagctgataaacgggtgatacaatgtttctgtacaggagtctgcagtgccaggctgcaggggcggatggtggggggtgggtgggtagcctgtggagcccgagggtgggaacagagagtcttcttttgctgtaggtggaagcctgtctggctcctttccctctaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctacagcgtccagccaggggctgtgccacaggggccagaagatatctgacctactgtcactgcctcttccactctgttccacctgcactggggcaatgccatctgatgaacagatccatttattaattcaacacgtttgtattgagagcctgctgggtgccgggcactattgtcaacatgggtgatacagcagcaagcaaaacaagagaaacatctttgcaagcaggggagggggcctgcagtgttgggtgtgtggagttgttgctgggaagtagagaagctgagtaaagagctggacggagagagatagccaggcccatgtctacagaaaagcattctagactgagtgagcataaatcgcaaaggcccagaggagggagcatgcctagctagccccctagacctggtgaggctggtgtgggttgggcagtgatacggtttggctgtgtccccacccaaatctcatattgaattgtagctcccataattcccatgtgtcatgggagagacctggtgggagataattgaatcatggtggtgttctcccccaagttgttctcctggtagtaagtgtcaggtgagccgatggttttatgaggggtttcccttttcacgtggctgtccttctttcttgcctgctgccatgtaagatatactttttttcttctgccatgattgtcaggcctccccagccacgtggaactgtgagtccattaaacttctttttctttattaatttcccagtctcgtgcatgtctttatcagcagcacgaaaacagactaacgcaggcagcctgtgttgggaggagttggcaaggagggaggaggtgctggccagtagagcacatgtgtctctgtgcatcagagcaaggacccgggctctccccgtgagtgagaagagtccatggggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaggttcggcagggaagccagaggagtccgcagcccgggagacctggcctacagcggagagagtcagtccatgccagtggtgggatgtggctgcaaaaaatggtcggattcatggaagtctggtgtccagctggcaggcattagtggtcccatgaatacagctgtgtgccttgaacacgtactgcagagcttccagagagcaccagggctgtgggggctagagactgtgtctcgtgcggaagcgtggctgagaaggggctcgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtggaggttctggctgaaggagccagaattccagtgccagctccactcctcacgagctgtacaacctgggccggttactgacccctttcccaccttagttccctggctctacaatggaggtaattatcgtgttgaactcacagggtcgagatcatatttaacactttcacagcccttagaagtgtctagcacagtggtcctcagcatttggaaatgtctggaaacactttgtcacacctgagaagagggatttcctactggtgtctagtaggtagaggccagagatggctgctaaacaccccataatacacaagacagaccccgcaacagtgaactctctggcccctccaagtcagtggtgcagagattgagagatcctggtttcgcgttttgagcgtgcagtacatttcagttgttagtggaacatgcaatacatctttattcacatgttattacttatttgtcagatgtttgtaaaacatctgctacattcttggcagtttaatagaatctggagatacaaagaagttcctgaccacagaggtcatttaggcaagctaggaaagcacagaatgatataacacaaagttacattgtaccataaagcatattctatagtacacttaactctggtgggctcttggtataaaaatgtctccaatctcagaggtcatgggatagtgggcaagacatgaaaaccttgtataatataaaattttgttacctctaagtgctgaaattaaggtataaacaacgtctcatgggaaccaaaacatcagtcatttggaagtataagtcaagccttcgtaggagaggaaccatttcagcccgatattaccagagtgggatggtcccagcgagcgggatgtggagggttaggatgttatcttagtctgttttgtgctgccattaccaccaagtaggtaatttataaggagcagaagtttatttggctcacagttctggaggctcggatgtccaagatctagaggacacatccggtgagggtcttcttgctgcattgtctcatggtggatggaagaagggcaaggtggagagagagagcaggaaggggcctaattgtccttttataaggaacccactcctgtaataatggcattaaacccattcatgagaacagagcccttgacccattcatgagaacagagccctcatggcctactcttatgagaccccacctcacaacattgttaacatttaggatcaagtttctagcacatgaactttgagggacacattcaaaccatagcattctgccccagtccccaaaatggatgtccttgtcacatgtagaatacatttgcttcttacctataatcccaaattcttatttgtttcagcaccacattaaaagtccaaagtccacagtctcatctaagtcagctgtgggtaaaactcaaggtatggttcatcctgaatcaaattcccctccagtcatgggctgtgaaatcaagcaagttgtctgcttccaaagtacagtgatgggacaggcataggacagatattccattccaaaagggagagataggcaagaagaaaggggcaactggtccagacaactccagaacccagcagggggaacaataccaaatcccaacttgacaataatcttctttgactccatgtcctgccttccagacacactcgggtagggacttgggcccccaaggcctccggcagccctgcttccctggccttgctgggctcattccatgcagcagctctcaccggttggagtctcatgcttgcagctcccccaggttgctgttgcacactggtagctctgcagttctggggtgtcaggatggccttactcccacagctccactaggcttcctggggactctcagcagctcagactccacagttctgctgggcattgccctacaggggctccctggtggtggctctgaccctgcaaccagtctctgcctgggtcccgagtctgtccgcaatatcctttgaaatctagttggagggagccaggcccatagcccctgcattctgtactctggtggcattaggaccatgtgggatgccaccaagactcaccacttgcaccttctagaatggtaggtcaagctgcacctgggcccatttaagccatggctggggaggcagaggagcactgtgcccaaatgtgggagcagagacttgaggtggccctggacagtgagccacaggtcctgagggctcccaagacctggcttttgacatagttccttccctcagattttggcactgccggagctgtgatcacaggtcatctctgcagtacctttgggatcattcttattttcttgatgaatagcctctggcttcattcttattgtactaatctccttatcaaactgtggctctggccaatactaatctccttatcaagtggtccatactaatattcttattaaactatcaaacggtaacatgcctgcacccttgctttcctctcctgaaagttctttcattctctactacagggccggtctcagaatccttccagtctctaagttctgtttcgcttttcattataaatttctttctttctttccttctttttttttttttttttttttgagatggagtctcactctgttgcccaggctggagttcagtggcacgatctcagtttactgcaacttctgtctcctgggttcaaaccattctcctgccttagcctccctaatagctgggatttcaggtgtgtgccaccacacccagctaatttttttgtatttttagtagagatggggtttcatcatgtcagccaggctggtctcgaactcctgacctcaaatgatccgcccgcctcagcctcccaaagtgctaggattacagacgtgagctactgcgcccaaccctgcttttatttataagtttcatctttaaattatttatttcttctcaagttttacagtatacagttaaaataagtcatacagcaaccaaaatgctttgctgcttaggtatttcttccaccaaatagcctagtttatcactcttaagttctgcctgctatacagtttgaggacctggacacaatgtagccacattctttgctgctttgtaacaaggatgactgttatgccagtttccagtaccttaatcttcagatatatctgagacctcatcagaatggccttcacgatcgatatttctaccaccattctgatcacaaccacttagtctaagaagtttcagactttccctacagatcttctaatcccgctttattgcctgcctgcctccctccctcccttccttctttcctctctgctctctctctcttttcttcctttccctcccctcccctgctttcctctcccctctccacttcttggcaccaattttctgtcttagtccattttgtgctgctgtaacagaataccacagattgagtatattataatgaatagaattttatttggctcatggttctggaggctgggaagtccaagatcaaggggctgctctggcaagggccttcttgctgcatcatcccatggtggagagtggaatggcaagacagatcaagaggggacctaactggccttttataaggaacccagttccacagtaatggcattaacccatccatgagagcagagccccatgatctaaacaccttttattaggccctgcttatactgttgcactggggatcaagttgcagcacttggacttcgggcaacacattcaaaccatagcaggcaccttaataaaggtggaaaagggatgtggcagctacagtgggagggaaaaggtggctcccttagtgtgcttgggaggagggtaagagatgcgtttgcagttctcatggccgcagactgaaggggcctggttacctaagggaccttggcttcatgtaaggagtgcggagtgagtgaagcaagagggtgatttgatccatatcatttcttagaaggataccatgttggcagtttcgaagaaggggcatgagtgaggaaacagttgtggtgaagagaccagttaggaagcctgtaacttggggtgggatctggaaccaggctgtggctccggaagaggagctggagggctgcactgtgaagtatttctcagagtctagacaatgtgaccttcacactggggctgagttttgtaaaatccgacatccccagtttcacctatgatgccaggcctgtggtaaggagctttgcaagcatttgctagaatatgagcaaatggaggtagaactgataatatttagtaaccatggggggatgaaagagggaggtgttgggagactgggttgataatatgggggttgggagtgaggagagagtccagctttgaacatcttcttccatttgaggaatttaagatcatccagctagaaaattagaaatactaggatggagtgtggaagagaaattagtgctgaaaataaagagctcgaatcatcagtgtatgaatagtagttaaacctctgaaaatgagtgaacttgtcccctgaaaatgtgtggcaggggagaagcgaggttcaaggacagtgcccccgagaatgccagcatttaaagggtggaccctcggtggctcacgcctgtaatcccagcactttgggaggctgaggtgggcggatcgcttgaggtcaggagtttgaaaccagcttggccaacatggtgaaaccccgtctctactaaacatacaaaaattagccaggcatggtggtgggtgcctgtatcccagctactagggaggcacaagaatcacttgaacctacaaggcagaggttccagtgggttcgtgccacttcactccagcctgggtgacagagggagactccctctcagaaaaaaaaaaagaagaagaagaaaaaaaaaaaggtgggccccggcagcagagcctactgtcccggaggcaggaggaaaacctgaagggaatcttgaccttgacctagaagccaaggaggaggcatggccaacaacatcaaaggcctctgagcagcgcagtgaagactgacaatagacctttcttaagtttggcaattagaaggtcattggcctcagcaagagcaatttcagaataaaaacaagagtggagggagtggcataggggtcgggggacagagtaggaagtgagggtgtagtagaggggaagaagtttgatcactgagggaaggagggagatgcaggggtagcttgaggaggagatagagcagagagaggtttgctgtttattttaggaagaggagacttgagcatgtttataagtcagagaatagagaaggagaggtgggagacacagggaaaagaggagtcattgattgggaactattctgggaaggtgaggtggatctggtgtctaggtggaaggatttgggggaaagaggggaggtaggagagtctagacgtagacagcaggcagacaggggctccaggttttccctacagaactgaggacagtgatggccgagcgtggtggctcatgcctgcaatcccagcactttgggatgccaaggtaggtggatcacttgaggccaggagttggacaccagcatgggcaacatggagaaaccccatctctactaaaaatacaaaaattagccgggcatggtgacacatgcctgtagtcccagctactcaggaggctgaggcacgagaatcatttgaacctgggaggtggaggttgccgtaagctgatggcaccactgcactttagcctgggcgatagagcaagactgtctgaaaaaaaaaaaaaaaaaagaagaagaagaagaactgaggacagtaagagtaagtggtcgcttgtgatcacagaaccagcaagtaaaccgcgagcttctgcccctctggtcttcccagaccccttccccggaacattaagccatatcgcttttatgggtccaggggctctgaggggctgggcatcatactgtgcccctgggggcatatctagttctgccccacttggttgggcgggtacctgctgagtactcactgtgtgttaggctgtgaatgctggggcagcaggaggcatggtttctgcctccactgggccttatttcttcaccttgtcccccagttctgcccttgggtaagttctgtggcagaactgaccagctcccttcggccagggacatcttggttcctggcagagcaccaagaagagcagattgtcttcctacccgggggcacctttgcccagcaggtcgggtgagctggcctcttggtgagaggctggtccccttggacatgagtggattcgatgcctgctttcccacccaggtactctactgtggctttgctcctgccctttatgctcagagctagaccagcaatgtgggggagctgctggggaaaggcgccatgttgtcttgaggtagcagccagccccggaagccctggaatgcctggggccactgagcaatcctcaccctcagccccacaaggggagggcgtggctcgtgaaattcctgattgggtatagcccagcaagccccaagactcgcccagtttgcttagcgcaacactgacgctgttttggaatgaagacaagacaatgtagaactttactggggaagaggtcgaagaagggctaattgtcttgttgttcaagactggttagcgctgctcacctctgacgctgctcacctctgacgccaaaggtttttccctggaaggcagccctggaggatacctgtgtatctgtctttcacaaaaggtgaaatgagctctttgtagtgtttcccgcccaggctgcattttagaatcacagaggaggtacggcgctgatttgttttactattccctattcatgcctgggccccacccctaaccaattaaataaacatctcggagagtggggcctagactttatatgtttaagctcctcaggtcattgcattgtgcagccaatgctgtgacctatgaatacaaaggaagatgaaacgcaccctggtcatgcaaggaagatggagagagggagcagggagggtgagagaggctgcagttcgtaaggtcctgaaatgttagagctggagggatcctggttcggagcactgcaactcaaaagagtagttctagccatgcagcaggccccattagggagctggttagaatgcaaatccccgcctgccctgcaccccatctggcaccctctgagtcacggcgtgcacatcgaggtttgagaagtgtgctttcaggtcacccacagatcatccagaccagtggttctcaaccttggctgcactttagaatcacccagcgggcttcagcgaattccagtgctgggctagatgaattaacccagaatttctaggtgttgggacccaaatactcatttaaaaaattttttttgtttaagtacttcaggtgagtctcttcttcagccataatcaagaatatcaggcttgaccagtgcttctcaaacttggacagatagatgaatcgccagggtatcgtgtttaaatgcagattctgattttataggtctggaaggggccaaagaatccacttgtctgggctctgggatgcccatgggactgatctggccttttttgagcagtgggaataggctgacttctcagtttgacagcaaggaaactgcaggtcagagagggaggtgtgatcgtccacggtaaccaacctgatatgcattcagtactttctgatgtactctactgtgtgccaagcagcatgctacatgtgggactagagctgcgaacaggacagacccaattccaaccctcacagagcttatatcccaactggggagacagacagaaagaaaacaagtaactaagctgatgacagatgggaaaagctatgaaggcgaggagggccatgtgtagggaacgactcagagattgctgtggggtgaggggtaggtaaggcacgcccctttcagaagagctgtcgggggagttactaggacaatacctttaactggggactcctgctgattacaaactgatcacttttctttactggacaggactaggcttcatcccctctggggtttggggatggtgcttctgactctcctgaggcagtctgaccctggtccctgcctggctgtctcctctgactcaagactctgatccttcagtgtttgtgggttcagagcagagcctgggaatgagcccgctggggagcaggacactgactccaccataggacagggctcaggatcattggttaatggtttgtaaaatggaccaggcctcatccagatgctgtccccagcccctatgaaaacatggaaagtttccactggtgcacaaacactagtgcttgcctccctttcctgatcaaccgtcggactcacatgggctgtttgtgaaaatgcctgtcccaggccatactcaggctgaccaaggtggtctggtctccagggaagggccgtgaaatgtatttttaggaagtggtccaaaggactcttctgatccagatcatcaggaagcatggcgtggatggaagaaactggcacttggcatctggtgcctctgtgtggctgtagaagctacagaaatgtcttctgcagtgactgcagcgtggccctggctgagctggtgcttgtgaggaagcctctgcttgtgtgcaggggtgaacagcagctcaccccttcccatgcacagtcctcaccttactaccttcacccttactggaagcatctcttgacttctctttggccagccagaccctcccagctccctgtgctccccatttaaacaccttccctccctgagcttagcccatggctgggtggggaggcgtgagcactgtttgcatttggtcagggcctagaagggatcaaggaggcctcatgaggaccatgtcatagccccaccctcactccccacccctgacctgagcaaacctgtttggctggattgatgatggagaggcaggcagtgaccagaccaagagacgccttggatggtggagaataggtgaccctctgttgggtaaaagaggactcaagccctcacacagtgagttggctaactttttgtctcaacagtgggcgggggtagctgtctgcctcctggagctggcccttcctgggtcaaaatgcagaaggagatggtgagaagaaccacaccagagaggctggagtaggccagcctggcttgggaccgagtcccgagtccctggctggaccctcggttttcccttccgtggcagggctcacctggatccttaatgccgcccttggaggagttaggaggatcctggatgagaaaactcaccctcaggatgattgccccagggagcagcttcctgctttctggtggaagggaggggcagacagtgggtgtgtcctgctccagtgtctaggcaggagagtttgtgaagctgaccggacacctgtggctcttatttcctaggtggcccgaggcagccgggatgacagctctccccaggaatcctgctgcctgctgagaaacatggtcagcaagtcccgtgagtgtcatccgagggctcccccaccctggaggacaggcctcagaagccgtcttcagcaggatcctgggacctctgggggctgtggagggacagacagggagccaggggcccttctcttcatcttgaaggacagtgggtacaatcagggtcaagccctcagccagggccaggagagggccagagactgcttctgttgagttaggggtcggagggactcagaagggggcaggtgggaaggtggacgggggttgtacctgcctgttgctgcctctagctcctctctgcatgtgtcctgcaggctggaagctcctggccatgttggctctggtcctggtcgtcatggtgtggtattccatctcccgggaagacaggtacatcgagctgtgagttcaccttccatgtccttccagtggctcttgtcagggacagggcttagggatggagcatcatggagcgggggacctagtagggcaggaaggttccaagagccggcacatgacctcatcccttcagctgctggtacggagtgtttccatgagggtgggtgggggtagggcctgggatgtctcactgggccctcacccagggagtgcaggggcaggaagacctggatcctcaaggacttgggttccaagtggaacttaacttgagatgattcctccccggcaccttgggaccttcatgccgtgggagaaggcttaggctgcctggaacatgggtccctgggtctgactggggcttctgcctcctgtccttttttctctccagtttttattttcccatcccagagaagaaggagccgtgcctccagggtgaggcagagagcaaggcctctaagctctttggcaagtaagtacttaaggatgaggagggtagagcagggcatggagcgagctgggattgagggtttcacagtgtggggagtagatggaaagagcagctgtgttggtggacatgggttaggtgaagccagggagggaagagaaggccttataatattagtcatgggcctaaccctacttctggcatcaagattaattctgttctcatccccacccggctttcacctctgtgcagctactcccgggatcagcccatcttcctgcggcttgaggattatttctgggtcaagacgccatctgcttacgagctgccctatgggaccaaggggagtggtaagttcctacccggctcgtgggaaccatgggctcaccctgaccacgttgcttcctattctctgccgtccacggccccagtgcccaagttctgagcctgactcgggtaccagggtcaggggaagaagaaggcagccagcgctctgaggagcagtggagggagggcaggcagccttcagaatgctatctgtcacatcagtccctccgcctggtactttttgtagaggatctgctcctccgggtgctagccatcaccagctcctccatccccaagaacatccagaggtaaggcggcactccgactccagtctgggcaccttctcctatttcctgccccctgcccgctccccccactccccacccccccgctctgtgaaacagtcatggactggtaccatcccagccaattctcatggtagcctagcctgggcatctgggtgcagagtgggcagaggctgctcgagggtattgcaacagtggggcaggcgtttctcattgatacacccccccatgccttccctccactcctctgccctcttctgtgctctgcgcagtctcctcctcttacaaagcccagggctgtaaagtcagcatgaccctaagcaggaccacggggtgatgcctgcttcatggggaccaggggctgagggggcctaggaagtggtcctgagatgggcccaggcagatccagggcagcgagcctgggttagagtgtggggtgacatagaccactcctctttctatggcagcctcaggtgccgccgctgtgtggtcgtggggaacgggcaccggctgcggaacagctcactgggagatgccatcaacaagtacgatgtggtcatcaggtgtgtgtgactgtctcttcctactgttgtttgggaactggatgtccgagccagggactgtagacaggcccaggaggcctctagtgatgggaatcctcctcccaacccccagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtaagttgggggacagactgggggctgaggcctggcggtggggacgctgcccgagtcaggacctcacgctccttgatgtccgcctggcagtcctaaagaggctgtgaggggacagcatgaaccgggctcccggaagtcagcgccttaggctgccctccaagggtggtgctctgataagctgccccagcaactgggtataaaagcctgcaggcgtcaggtggcagcagccacaggcacccatgctccaggcgtgtctgtgacaggaaagctttccgagtaggtgtttgcctgtgaggaactcgggagctgagcaaccctccagcagccatctccaggctgagggcaggttagagcaatgaggcctgtgtccaaacagatggtccccagaaagagttcactacatcactttgccatccggtcacaggctgaactgtcccatctggcatttttgtcaagtgtttagacagcctaaaactttagtcccttctacctgtgtggatgttcttggaagtggtccatggtttagaccctccactctatacacctggtcacctggcctcccgagggggtgcctttcctcctctctttccctggtcctctcctggtctcccatctgtggcacagacttcacctccctttcctctcaccttgtgctcctgaaggcctctgccatcgcttggaccccctcgcctcgctgaggaccactgggttggatttgagaaacagggcttcacccgcttctgtctctctcttctgaccccatcctcctaggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcaggtgatgatgggaagtcaggcctgagggctaggatcctgggcgggaagtaggagggatgatcctatgggcttaggaagccctggaaggatcccataacagaggcggcggtttgcattttccctccaggaacacacctgtcattaaagttgctgctgcaaaggggagtgcacactttagagaaccaaggggcatttactaagtggggagggatggggatggcctggatcaggtttaggggctggtgtgagaggatggttttggcaggcgctggtcagaatttgtcaactggggagctgctggaacagtcagtggtctgatctgtggaacaacttgagccatgcagagttactgttagatacttcatctgtgatcttatcttgaaacactagtctgaacgagttataagagttggagctaaacagtttgtcttgcatgtcatgatttggtatggtgtgtcaattcagggagtcaatgtagttttgcaagttatgggtttttgttttgttttaaagatagcgtctcactctgccacccaggattgggtgcagtggtgcaatcatagcccactgtaacctcaaacttccaggctcaggtgatccttctgcctcagcctcctgagtagctgtgagactacaggtatgcaccatcacgcctggctaatttttaaatttttttgtagagatgggggtctcactgtgttgcccaggctggtcctgaactcctggcctcaagtgatcctcgtgtctcagcctcccaaaatgccgggattacaggtgtaaggcactgtgtctgaccacaagttatgtgttatgtgtttcttctttttaacctgatgtccttgagccatagcaagttatggttttgagtgcagtgccctggtggtcttcagctggtgggctttaacccactttgtagcttcccaagtacttccacccatatcttggagcccctcggggaggccgtgtgggatggtgagagacaggcactagcagacacaggtatggcgcttggctgtgctgtgtactgtgtggggcttggcaggtcaactgctcagatccttgtttttcttgcctgtgtggtgggataatatccataatgaccttttaaggctgttgtaggagtttgaaaaataataatgatgtaaaatacctattctggagaccggtacacagggcctgccctttaaatatttgccagattttgaataaatgattttattgtttactgaacatttcctgttattccatgttctgtgttgaatggctgcttttgtgactgctcaatgccaggccccgagtcttcttgcttggcgaggaagttgtgctccttgctctaagggacctcagtctagcagagtaagaatgcaggttgcactgtggggtgataaaattccacaatggagagttgttcccaatgccgtggaatctcagaggaggggcagacatctgctgagagatgtctgggaggctccccagaggaggtggtgctggagccgggcctggaaggatcaggcagagagctggggaaaggcattccatttggccagagcaggcggctcctccagcactgaactgtttccagtacaagtggcgttgaagggcaacaaggagtttcatgccattcataggattacagatggagaggaggctggagagggagatgagagagggcgaggacctgaacccagctcctggcagtgggaagggaaaaggaggagatggactcaacattgtgttggttgtttttttttttgagatggagtcttgctctgtcacccaggctggagtgcagtggggtgatcttggctcactgcaacctctgcctcccaggttcaagtgattctcctgcctcagcctcccaagtagctgggattacaggcatgtaccaccacacctggctaatttttgtatttttacgaaaatacaaaacacaggagtgctggtctcgaactcctgaccttaggtgatctacccgcctcggcctcccaaagtgctgggattacaggtgtgagccactgcgcctggcctgtattagctttctgttgctccctaactaataccacaagtttagccggctaaaacaatacccatgtactggctcatggtcctgtagatcagaacagcagggtgtggctggttctctgtttagggtgtcacaaggctggactcggtgtgtcaaccagacagttctcatctggaagcttgggggaaaattttgcttccaggctcattcttgtggttgaaataattcggttcctgcgattgtagaactgaggtccccatttccttgctggctgtcagctggaggctgggggccacgctcagctcttggaggtggcccacatttcttgaccgtacagcctccatcttcaagccagcgacggcacaatagatcctttctgtgcttcaaatctctgacctccgtttctgatcttgacacccggatttaaaggttcaggtaattaggtcaagctcagcaggacagcctctccttttgtgttcaactgtgccatataaagtaacgtcacgtaatcgcatcatattcacgggctccccacacgcgcaagggaggagattacatgagggttagcgtcactggggttctcttacgattctgccttatatattttacaggtggaattgagagatttctgaccaattctgggtttctagcttggacagccggtagggggcggggggtggtaacatatttaactaatagagagagagtgcaaggaagaggaggaatttggtgagtgtaaggagactgtgtccaggcagagctggctagaaggccatggaagtgtggctcagcccagctggatgagataacacactggtggtgaaagcaacaagggtggaaaagaaggtccagccagggagtggaagatgagaagacaggagagctcagagagggagaaagctggcatgtcgacaggcctgatgaggtccaggaaaggctcccaaatgggtatgggcagctgaaattgtgtgcaaagcaggttgctgaagcggaggaaggcggggctggagaagtgagaatatcaggctgcccgtcactgtggatgaattaggcatgagcaactgaggttctcagagcagccagtaaggtgaatgggaaaggtactgctgtcctgctttaaaggagagggcagccaccatggctcacgcctgtaatcccagcgctttgggaggcagaggtgggtggatcgcttgagcccaggagttcgagatcagcctgggcaacgtggtgaaaccccatctctttaaaaaaatagagcgccacccccataaagggtcgcacagttagtgcatgtcagagcacccaggtcttctgaatgaggtcaggttctccaaggaggagggcagaacacttcctttcctttgaatgagttgcttaacgcttttgtaagccttggttttctcatctgtaaaatggggctgatgataatagctacctccaagtgtttttgtgagactagatgagataatgttttatagtaggtaggtaaaatactaaacatagtgtctggcacatagtgtttaaaaagtaactgatatgatgatggctgtcattctgattgttagtcttatctctacaggccccaggcctcccccagatgtgtggagctgtaccatccagaatggtagccgctaggcacatgtggctatttacttatttatatttgtttatttttagagatgggggggtctcactatgttgcccaggctggagtgcagcagctcttcacaggtgcattcttagcgcacgacagcccaggagtcctgggctcaagcagtcctctgacctcggcctcctgagttgctggaactatgggcatatgcactactgcacccagcacatgtggcgatttaaatttacaatttaattaattaaaatttaataaaataaattcagttcctcagctgcactggccccatttgcgtgctcgttagctcgtggcttgtcttgttggacagcgcagatggagaacgtttccgtgactgcaggaagttccactgcagagcgctggcagagatgatggtgggaggagcagggctcccactaacaccctcctgcccctgttcctcagaagcccaccacgggcctgttggccatcacgctggccctccacctctgtgacttggtgcacattgccggctttggctacccagacgcctacaacaagaagcagaccattcactactatgagcagatcacgctcaagtccatggcggtaagtgcctggcttgtgagcatggtgggccagggcgtggacgggcagacagtcagaggggcactgggtgagtgggagcagtgctgagacccagaggtggctcccgcagtcagaactggaaccgaggcacctggactccctggccagcatcctccatgttcagccacatgggctttgtcttccttccaagagccagcctggggaagggagctcccaagaagtgtggggccattgggaggggcagggagactttcctggggacagagaggtccctgggagtccctcagtttatttccttggctgtctccacaggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaagcagttgtgatgtcctgtgtcctttcaggtgggggaaggcatgggacagggtgtggcagtgggcaggcttgttagaccagagcagggcatggtcactcaggaaataatgacttattgagtccagtgttgggtgcccggtcatgcattatcaccctggcatagcaggagagtgagtggtgctcacagcacccgtctgcaggcacccagcctggcacccggcaccctgggttactgcccagaggagggaggggctggaggatgccagacgagagtgccagagtcctctcccaccttccttcctctcttccccaccattcttcagttacccaaatctcatgcttgggaggtatgtgttttaaggacaggggtggggtcagacaaagaaagccaagtttcccttctcagattaagtgggaaccagaaaatggagtttatggaaggtcttgccagcggcccaggctgccaggatgggatgggcaggcctggagggcagtgtggaagggatttggcaaggcctaacagccagttgctgggccaggggatgaaacggcttctttcctaggtctttagcatcctaacaatcctgccgtttgcctgtctctcccgccttcgttctccatcttcccagatcctgcttagctgccaactgggcttcctgccaccccacagctgttcctttacatctggagccaggagggagagttggaactccccacttggggaatggaactggcagctgtattcctggctttctcggaaagagttgcggccttgaggttttgagacaagccaggctgggacaggacagataaagaggggcagcagtttgggaggaacagaggaagatgacatggttctccacagagcgttggaatggccttgtggacacccacttcatcccccagaatggccccaaggaccctcccagggaacagaagggctgctctctcagcagcctggctgctttgccaggggagaggggggttctgagagcgagtagagccccagcatctgcagccccaagcccactcccctccacacgggcaaactttgtcttgaaggctgtgtcctggggagcgagcttgcagacagcaggggttgtgagcgtgtggggatctcaactctgctcaccccgatgcgtccccagctgccgctcatgtggagatgcaagggagtgtccgttttcccatccggggccattgagaatggctgtctgcatacatgatccagctggcctggactgaggccactgcctgttactgaacgtgcctaaactcaagctagaatccggcacacaggggtgggtcagacccgtctaaactccacacacgcacacatgtagatatgggagcattttacattcttggtgggttgtttgtgattctgtgtgcggacagtccttcctgctcacatactgagaagactgtgaatgcggggtgtgtgtatacccaaatagaccattgtttgcttgggggggtggggatagctttctccagggtgcccaacatcctacgcagattgaggcaatactggccaagggtcggagctgagaatggggctttgatgtggggctgttggatggggttctttggttttctgggaaagggactttcagtcttcaattagcccaaccaacgggaatgaactgcctgccagcctgcctgggactgattaaaccataccctggaaatgaggaggggaaagagcacagtagggcacgtgcttgagggcaagtcaggagatctgggttctccaccagcctctgtcgcctttttctgtaagaacgtgggccagtcatttctctgcaacaaaagggtgggtccagctaaggagaaccgcttgtctcagaattacctagggagacttgggaatagagattcctgggtctcacccaggctgctggggacagcaggatcatcgcacgggcctcttgactctacggcctgcgtgtaaagcctgcgctaagccccagtgtccttcagcggcgtcaattaggcgcacgcgcagtttcctctccggaggggcgggcagggcaggggagggaggagctactgatgtagctcgccccgccctggcgtcagggccgtgcaagcgttgtccgcatgggcgccgcgccgaccctcgcggccgtgggaacccgcccggaatctcgcagggcctgtcgcgcttcgtccaggttgacggcctcctccccgcgcttttcgggatgctggccccggcgccccgcctcaggcgaggccggcccctccctggcaagcggctcaaggcttggcgacggctcaggggaggctgggcggactagggggccgcgcccctccgaactctcgctgggcctcggtcatgccacctgctttgggttcatcgcagaggctggggtgaaactgccttaggttgcgagggagtggaagagctctgtcccatcgaatttagatcctggaagtccacagaggggaaactgaggcccggaggagagaagggactccccgcttcgtcaccttgctgggcaggataagagtcaaggtctctagtgcgggaacacttataaatgttactctgtgttcacatcacatggtgtgccttaattttggatgccaaggattttatttacattttccaaggacacaaatgcattccgttgctttcctccagaggctgcctagcctacgaggagtttgagcttggaacaggtttttgtgggagacagtaaggtgcgatgcacaccaaatagggacagttggaccgtgagttcaactccctgctctgtcgtttagccgagtaaacctctgcttctccatctgcaaagcagtgatcatgcatgtctctctcacaatgaggttttaaagacctaatgggaaaatgatcataaaaacattttgtagagtgtaaagtatgatatcaatattaattggaaagctgccttgcatcgtggaaaatgccagagggtatgaaacaggttaggtacatttgtagggccaaatacttggccaggtagtgagtaacatggctggttacagaaaagtctttgtcttcaaatcacccacaaggtaggtaggggaaggtaagacatcagtgaaatgactgcaacacaggctttgcataatcaaacgatgaatagtgtttaaactgctttatattggtggttttctttttctttctttcttttttttttttttttgagacagagtttcactcttgtcacccaggcaagagtacaatggcaggatctcagttcactgcaacctccgacccccgggttcaatggattctcctgcctcagcctcccgagtagctgggattacaggcgcctgccaccacgcccagctaatttttgtatttttagtagagatggggtttcatcatgttgaccaggctggtctcaaactcctgacctcaggtgatccacctgcctcggcctcccaaagtgttgggattacgggcgtgagccaccgcgctcggctattagcggttttcaagttgaagtcggacacctttagggattcttggggaaagagatttcttgggagacattatccatttcaatggtacctagcatgccacagtagattcctaaacaaaggttgagaagtataacctgagtttgtcagctctattctaatctctccaacctttttgaagtcttcattatagcttcggaaaactgttagtttccaacattcccataattctgtactagatgtggttccaagaaatcagacctttctgacttaaaagtttaaggaggggtatgcgcgtggtgtgcgtgtgggtgtgtgtctgtctgtagttatagctggttttcctgtccagttcaatctcattgagtttatctctcttgttagagatttttgggatcctgtgcccaataaataagaagagatgaaccttgagtctcattagatgacagatttttgagaagctcaaatgtatgggaaggctccacttcttcacttaaagggactgcagatggtgtgaagcaggtgggagagaccccagtgctaagagggttattacaacagggcttggcaagaatttttcagggaaaaatgaactttgggaggcgggtgctgttttttgccccattttgggttcccagggaaaggtaacaatttaaacacacaccacctgaacagagacatagcttcctctcaagagccttggaaggctgggagagtggtgttgggtggagagaatgagagcaggctcagatgttgaaacaaccctaggggattggagttggaattgctgaactgagctagtccagagccatctatcattctgagtcttcccaaaacactatttacacagatcaccaactttcacacttaaggagtgtctccccgtttctcttcttactaagcatggagctggtggagtctggttggagatagccttcaggtctgtgctctttttctcagtgaatttatgttgcactgatggagcccttgcatggcaggagagctagataaacttttaatttctgttaaaagtcaaataggaagctcttatctgaaaattctgcttaaatccttgtctgcatcactttatctctacttgccttcttcttttagtatttctctgaagtgcaatgcccattaatgtcacaaatgtacttcctagtccttgggcagcagagcctggccctttattttccttgcaaaggaggtgaaagtggtaacttgaacttagtccacctggactttgtctcatagaaagtgatcttcaggccggggccagtggctcacacctgtaatcccagcactttgggaggccaaggcgagtggatcacctgaggtcaggagttcgagaccagcctggccagcatggtgaaacccccatctctactaaaaatacaaaaaaattaactggccatggtggtgggcacctgtaatcccagctactcgggaggctgaggcaggagaatcgtttgaacccgggaagtggaggttgcagtgagacgagatcgtgccattgcactccagcctgggcaatagggcgagagtctgtctcaaaaaaaaaaaaaaaaaaaaaaaaaaagaaagtgatcttcagagggatgaatcccttcctatattcagcttctatccagaatagtactttttctcttgcataactgggtatagatttcagataagctccatttagttaaactccagttatttccaggaacatctggactccctgagacctcactagccttctttttgagcattaatagtttagattcaccataaagaagacagttacaaagaaccattttttgaatgttttcagcattccaagatattgccaagggccgtaaggttaaggaacagcggaaagaaatgctatttcttgtctggtattctccaatcagggaactcaaggaagctctctactcaggggatgaggctgtctcagccccgtgggtgggctaagtggactgtttccgagaaaagcactgggaacatggagtggcaggcagatattggcagaggcataaatataaccagggatgtagatgacaatttgatgacgtatcttgtgaatggtgtatattcacagaaggccttttaaagatggaggctgtgggagtaggaagacttatagggcttgtagtaatgaaagctttcagtgtatgtcaaagaacttgctgttagcgaggacgggaggagggccaaggaagaatggcggttagagagggaaagaattaatggttttgcggcaaacatggacttggccaggaaaacaattccttatttctagaaagaagaggagcttttaaattttttaaaatttttctcagtttatgacctggttaggaacactgaaacataaggagttggggaaaggatggttggaggctcactggaaatgagaggcggctatcagtgaatgagctctttatcagtgactcccagagactgctgctaattttgatttgaaagctgcaaattgctggtatgtggttacagttcctaagaacaacttagataagagattttcaaaagccgttttgaaaggggaagtgaaatttaagatttagttgtcattggtctacatctaagtgtttgtttctttagatgtgcacaccaaggagcatttaaaataaaaatctatttgcaaattaagatagtctttatttacatttttatatttttatttcaataaaaagtgtgttttatagagaaagctcccagagaagaaactaatctcaagactcccttttgtctttttttttttttttttctggtgccaggacaaaccgcacacataatacctgggaagaactaatcaaacgtgtgtgtgtgtgtgtgtgtgtgtgtgtgtgtgtatgtaccttgtgccttcggttctgattccataatagcaaatgacccaagcagcacatactcctctccaaccaggaagtgagaaatggaattttggttgactcctttctcttgttctaagaaatctcccaaggactgcaccatgtttgttttcatttccctggctcctttccattctggaaacttaaaatcggcttcatggcctcttgctttatagaatttgttcaaaaaggcttcgtcagaaatggatttgatgtgacatttttgctcttcacgtgaaagtacttcctattccctgaaagtggaagaggtggtggaaataaccctggccttggccgactgatcttgaacctgagaattagagactgggcctccgtccagtgactctgagccagtaatgaagtttaaagctatcggaagactggctgccgtccttggtagaggtgggggtgatttgatacacagaagagctttgtttcccagggctttgtggtctttccgggtcatttggggacttagggtggaggacgccagtcttgccttcctaatggagctgtgcttgtcctcgcccggcctgccccagagcgcatgctagcacagtcttgccttcctaatggagctgtgcttgtcctcgcccggcctgccccagagcgcatgctagcagatggcctttaccatcagccacttccagcgacattctaggatgaatgtgtgtataaagctcatgtttgtcactcgttagcgcttgacgctgggcaagttttctggcttctttaagcctcaacccacatctgtaaaatggtgatacttcgtagaattgtgagcattaaataagattacaaatgtagagcactcattttatttaatgtgaaatcacctatgggggaattcggggcttcccactgcctttgtttttcagcacctcccttcaccagcttttctgcacccccactcatttgtgagaaatagatagtgctggagacagctgagggatgtactcagctcagttcaggcttctcaatgccccagagtcctccagatccccctcattttttccctccatgctcttgtctctcacaaagatcatccttgtgacctcctatcccttgggctattctttgctgcattgggcattggacagtgctaagagggttgggcaccgtgcagcctagtgtttgcagctgccccggtgcgctctgctcagtccatattcttaccctgggtgtgccgagggacaggacaaagggcttattttatagaacatatttcttccccattcttctcgtttataattttggtttccaggaaagaatggaagaatgggcacctccaccctattagtgcacactctgtgtgtgtgtgtgtgtgtgtgtgtgtgtgtgtgtgtgtgtagcaggagcaaggggcagggtcagctgtgctgaggactaggaggtaaatggtctacgcatatccaaggtgggaagaccaagagaaataagagaagtaaatgaacagatcctctaaagtcatcttttccttattccagcacaccaaggcattgtgcatatggtcttggatccttattctctgttagccaatggaaaacatatatggaaagaaagcaagcaagcttgctgagattaacctagagagggcaggggccagcatcctgatgtctatgctaggccagcatggtaccagcagcagaatgtgggctgtggacatacacttaacatttctgatcagtttttactccctcaggcttaggggctacaaaggaagatagccaggtttctgggaaatttcgaagcacttggaaatatgatcgaagcagaaaattcctctgagtggaggagctgtgtaggctgtgtatagaatctgtggattgggaccatccaaggaatcagtgtctggaaagaagcacaaactggtgtgatgaaggttcccatgatgggtaagaactaccagggaaggttggagaagaaaggtttaaaactgacaaggaacctccaagccaccttagggacaatttgggttctttaaagttccatttgaatcccactccctcaacgagcactctaacttgcccctgtttatccaccccatctgccatgaccacatcaaacttacccacaagcgaggcccttcttagaacactatttgagttgtatattaaaatgttagggtgcctggtggtctagactctttccagcgggtcttgttctctgaacctctagaggagggaactttgccttcagaatattgctgagaggaagggtccagaatggcctggccagtatctagtgtgaccactctgcctctgagctatatttggctgagtcaggtggctggtgagtcccacacgtcctctggattgaatccacccacaggggagaggagtcagcctgtaggtttaattgccaccacaatcagagctatcaactgcctttattgtctaggaagattgaatcaaaggagggcagagaaccttgggttcccaacgcattctatgagctcttgggttcttcctgtggctttgtaggaacaaaagaacagaacaaacatgttggagtagtgtccctaacatttatttcaggtggtgactaggagggttgaggtgtagatatacttcctctcttctcgtggagccttactgaagacaggatcgccgttcttgtgtttatcagctgagaagggcagtctcgccatcttaaagacctgccctccagccccttcaaacgccacacttcccaggaagcactctctccataagtgttcagagaaccctgaccagagaagctcccgcacttcttatatgaactccgattgtgctgagggggaggggaggagtacacaaagcaggaggtgggtggggaggctggggtcacacagcccaggaggggcacacccggcgaggtgctccgtcagcacaggctccctcctccctccctccccccagtacaccaggctctgaccggaccggtcccaccgcagagttcagcggcatcaagtccaaggacagaactgcaagagtatggacacaaaacaccaaacaaattgggggtgggctcccggccagcctggtgagagagaggctcctttagccaaggccatttctggcttgtcagcctccagggtatgggctatgagcagcagtggggagccggggtttctggggcagctcagtgctgggaagacgtcatccccttctccccagggctgtatgggagcacaggcacaggggtaggtagagcttctggtcagcgaggggtagagcccacagagagaccagagagtggaccgcagtttcatgaaagcagagttatagctgccacttgtgcctgtgggcagagcaggtggtagaggggcctccaggaaagggccggggacacgggtgtccagcactaagcacagcgcactcagccgcagcctctgtctgtctccccacccgcccacctctggcacacagcacctggggacccagatttgtgcttgatcagagcttcgaaggaaggcagtggcagaggcgctgggaggctgtcctggaagtggccaattctggtgtcctctgcaaagtacccctcgtccctggacaaccagaacgtgccctgacctcttccctggcccgtccccacccgcggtgtgtgatccttagacgtgagtctgcatccgccgctgcaggggtcgactggggtcagagttctgggacgaggactgggagtggtgggaggaggaagcagaagccttgctggccttgtcgaactgcacatagccatcctgcttgccgctgctgctgacgctgctgtcacactgcgtgtccaggaaggagctgctgtcgctgagggagcctctctggaactcccgctcacaaagctcgatggacgagctgcccatgcccagcacaaaccgctgcccgtagtcgtagaggcggccctggccgctcagggtgctgtagatgttggtgaaggacatgcctgtgggcacacgctgcttgcccgcaggacgcaggtcgggctggcagctggagagggagatggtcggggttgagtggtgctctttgaaggtgttgacgctgtagtagccattggtggggtcctggatgggcgagaggaagaggagcgtcacctggtggagtctccactgagcgtggctggggtttccaggctgagcccgtccccttatgcggggagggaagagggaaaacaggaggaagggagcaacctggtagggagcaaactcaggggtgaacagctgcagggaaggtgcaggggaagaaggacactgaacaggagatggcagaagggggactgcggaccccaggaggggagggacggcaagggtgagggctgagggccgaaggagggaagcagaggctcttgactgggtttatgtcagggcaatgcagggtcatttgaaagtcaggctttttaattgtttttatccagaacatggatgcttcattttgaatctacatgtgaggaggctgtggaagagaactggggagtctcagccttagctctctcagcctcctcagcgttggggtagggagaggaggtgccttaggcagggacgggcacctgccaccaagctggcctctgaccttttcttctctgacttgctgtcatttgttgtatagatttggggtttgggccatcagagctaaagaccagattccatggctgtgtcttataacccggggcccttcttaccttcaggttctgaaactctttctcctcttctttgaggacctccagctgtttcaggactgagtcttgctggaattcaccccggtccatctgcaacccaaaaaaggctgctcagtagataggaggtggctaaacctccacttcccccaaggaaaagatgagatcagaaactcaaaagattgccctgtataacccccaccacccctcactgcctggaccatgtgaaagagtcaagatgagttcctggagccccatcctaggagacagggaagcagttgaggggggtgggtgagtaggtgaggtgaggggcagttaggggaggcgaggggcaggtatccgaggccatactttcctcgcttgggcgagggcatcaccagagatctcccatggctgattcaattccattgactgaacgtttattgtaaaatgccggccagttgctctgctaaggaccagagatccacagattaacgtacattaagatacagctctgctcatcagggagatggacttgtagataaataatttcagaatgtcagtcactgggcatggcaaggctccttagggcagtttcttttccagcgtgcaggcctagtgcaggccttagggagtcacaaggaataaccatctgtgagatgctggcgacatgggccacacctgttattctcatgaaaagttaacttccttagagatgccaaacagcctgagggcaaggatcacttcctgcttgtctctgggtcctcccacacctggttcagtgctttgcatgttgtggtcactgaccttgcctgcttttgggatggaatctcttaattatttgatttgccaatgcctagcacagtgcctgatatacaatagagctgcttcaaatggtatgtatatgttgaatgaataggcaaagtggcttagctctaaattactgaaaattaacaaaattattagacataagatgaaaaagcatactccacacacagtgggcatatgaattaatctgaataaccacagtgatgcttaacctgtgacacacgagaggcttgccatgtgtctctgctagttgcacggtataggtagtaggttccctcctactctctgggccgggatgtttcttctcccttgcaacctgctttcctcgtttctttttggagccctgtagaatcagccaaagtgcggccacccggctgcctcctcactaaggagaccatgcggttcatttttccagtaaatgctctggcactgtctggactggagaccttctttcccatcagattcaacttctaagtctgccccttcttgcagatggggctgtcttggggccaggaggtgaagggaatgcgagaatgacgatatcctcaaggggtggcttagcccagagccctcagcaagtcccttctgctcccacctgacactgagctgcccccactcttgcctgtggatttggactaagggatgtggagacagtctgaggcaaacagaatgtttgccgatgggagagaattcaaggtcccgtttgggatgaaggacacacatgattaagcttaagtatagagacgtcatcccttctcacatctaggctgtggtttcctccctcgtaaaactaaacactccactgtgttaattttaacagtgtcaggccctgtgttaggccccaggggaaatagatgagcgtagactcagaaacatgacctttgcccttgaggagctctgggataactggggaagctgacatggaattgggggaatgcactataaaggaggcacatacaaagtgttttgggagagcagaaggtgcacagctccgccaggggtggggaggacaagcccggaacatcttggagttgattgttatgggagaatgtgagattcaacagacaaaattagcaggcagagagaacagccggtgcacaggcctttgaagtccaaaagattcgaaggccaggaatcaagctctttggcatgtctggaaggccagatgtacttggccggaaaatggagctggagaggttggtggttgcctggcactgaggagccctgatggcacaccaggaagttgggctttgtccagcagatgtggggagccaccgagggattttaagtgggcaagtaacaggaccagatttgcattttagaaaggctgctttctcaaggctctcgagggtggattgagaaaagagacaaaagactacaaggctgagaccaactgggaggctgctgtaatcatccaggggagcaatgatgaggcctgaagtaaagaagtgatggtggaggacaggtggggcacacatttgagacactttttgaagtggaattgacaggacctgaaaatcaattggagagagaaagcgtagccgagggaaaagtcagtttgattcagtaaacgtctgtgagcctctaccagggcctgtgtaaggctccgaagaccccgggatgaacacagcagcagctgctcaccctctagcaacataaaccgctaatatttcttgagcacttattgtgttccatgggcttcaagcccttctgagttttgtccacttcaccctcaccacagccctgtatactgtggctttcagacccatctcatggatgaggacatggaggcaccagaaagcccatctactatattccttgctctgctgcctccactccaacatgttacgaccgaggcaaccagaaacttctagcatggttgtccaggtttctgcttggacaactaggtagatgatggcccataaatggggattcggaagaggaggagcaggcttgatgtgcctggagaagtgatgagttgactggcaatccagtccccaaggaggaacctgtgtttcttgcagactgttttggtggggtgcgggggatgagggagagggacatgtattgaatatctataatagctatgtgtgtgtgtgcgggggaggggaggggattatatgttatataacaacatattgtggcaatttatgcatatgtcttttctccttactgaagagccaggctctctgaagggtagactgcatttttgttgttgttgttgttttgagatggagtctcgctctcacccaggctggggtgcagtggcctgatctcagctcactgcaacctccacctcctgggttcaagcaattctcctgcctcagcttcccaagtagctgggattacaggcgcccgccaccacgcccagctaatttttgtatttttagtagagatgtagtttcaccatgttggccaggctggtctcgaactcctaatctcaagtgatccgcccaactcggtctcccaaagtgttgggattgcaagcgtgagccactgcacctggcctggactgcatcttagatgtctttgagtctgccagaacacaagcacagtacagcaggcacacactcacatttgttggctgagagtgtgtgcctcacctattgtggggtgggcagggggcatcttgaacgctgctctgctttttggaagcatctagttcattgagaagcctctagtcccaggaccttctgggaatggagtcacgggatgggatggggcgtaattgcattcttaccatcagctgcttgatggtggagtgctcctcaccctcccgaccagaggctggttccttgtggacaatttccactcggatatcatttttggctgacacaacacctttgagatctggagataaaatagtaaagtgtagatgatagatttagttcttacctttgagatgtcaagctcccttgcagtcccctgcccctgccctgccaccctctgcatttcccctccagcccctgaactcagcagcttcaccagccccccaccaatagaacctccatatggagatgctgtgggtgtttgggcctcagaggaggctgaccccatggccggcctgcctcctgtcacatgcccctcagccatgcacccttggcttgaaagatcgtcttcagccacttgtccgccttactgagctaggtccttttcatcctactgaattctcacttccttctagaagtcttctctgacctgctctaccaggcgggctccaatccctccattcatagaaccataaatctcagtgttggaaaggacctcaaagtgcccatggccaacccccatccaaagagaaacgcccctgaggcagtgggcagcttctctgtcgacgcctccgtgatggaagctttactgctacttctgcaggaggcaggctgtttctagttggagagctctgttagaaaattcttggctgggtgcggtggctcacgcctgtaatcccagcactttgggaggccgaggtgggcagatcacgaggtcaggagtttgacaccagcctggccaacatggtgaaaccccgtctctattaaaaatccaaaaattagctgggcgtggtggtgggtgcctgtaatgccagctactcgggaggctgagcatgagactcgcttgaatgaacccgggaggcagcggctgcggtaagccgagattgtgccactgcactccagcctgggcaacaggatgagactctgtctcaaaaaaaaaaaaggaaattcttgaggagctggtgcggtggctcacgcctgtaatcccagcacattgggaggccgaggaaggcggaccacttgaggccaggagttcgagaccagcctgggcaacatggtgaaatcctgtctctgcaaaaaattaaaaaaatagcaaggcatgatggcacacgcctgtaatcccagcgactcaggaggcttaggcacgagaatcgcttgaacctgggaggcggaggttgcagtgagctgagatcgtgtcactgcacttcagcctggccaaaagagagagaccctatataaaaaaaaaccgtatatatatgtgtatatatgcgtatgtgtatatatttgtatgcttccctataatttccactgagacggtggtgatggaggtcctgagaccacatcattgctggggtggtcttgagagccaaggctgcttagctcggagtgcagaaaatgcaaggggaacagctttcttcaaacatgtgcaggctgccgagtggcagaggagcagacccattctggtgattcattttttgcattacacttatataatgttagtgccagatggggccatcagagtcatatcctcattataaatgaggagacaggcctggaataactgtggctggcccagggtcatgtggcagaagaggtgggactggaacactgtgtctccattgtcttcacctgttctctgccatccaatctctcacacgttatctcctcggtgcacgcaattcttcaagcgtgcacaaacactagaattttattggtaatcactgaagacctttaaaagttttctcaaagcaattcctttattgcttccccacccactcccccacagctgtgtgagtgacctgcttttctggtgagactagcagctctttatttttattttgttgtagagatggggtctctctagactaacagctcttgtagagcaaggatcaaaccacaaaccgcttttccccctatctttctgtacagttcctgactgaaagagctatgtgttcaatccaaaatgctggctgccctgcagatgaagttcagtctagtccaggtcaacctcagcctagcgcccactctgccaggcgccatgttgcccaggctcacatacaccgatgcatcagacccactccctgccccaggagctcacagcactgttaggacccctgttcattgcactcctgcttacttgctctccggggcagcctaagcctggcctttttctctgtccccctccctgagatcccggatctccctcccgtacttctctgggaacgggcacagcagaacgccacgatggttgccataaggacgaggaaggccacaccagctcctacggccaccccaatgatgacggccatcggcacagactctgtgggagagaagcgggcacagctgatgacggatggggaatggcctactatccccccatgatctcaccccgttcctgcgggggcagcccctgccacatggggccctcctgggaaatgcctcagtggggcctgggcaggcacaggccgagtccaactggggtcagctctagctgggactgcaaagaccagggtggaggacacaggggcttggtgggtggaggagagggcaggggaactgaggtaaagggcagaggaaggagagcgaggcaggcagacacggagaagggagggccaggggacaggaagaccggagatgaggggtggggctggcacgatggagctctctctggcattaaacaggaatgctctatcacacagcggccagtgagtcataggccctggctttttttgaaaaatgactatggtcactgcccttgtttgttccgtatgttctctccttcccttccctttctcgggtgaatatagaggacatccggctcttagtgtttgcaggtctaagtagcttccccgcaggtctgctgggcatcagttgtggccctcaggtgtccaagtctcagggtccagggagcagggttacagcttctccactgccacctctctaaggagagaggcccctttccctccatctccaggtctgcagcttctccctcaaggctgcccctctgagcatccttgcacccctcctggcaagagaggcccacacactgggcaggcaagccctcacccctgctgagtctctgtggcctgtctcctgcccaagccgagtgggggtagggacagggagggtaaggatagagtcgggggtgatcttccacacagccttggcccttctacagctgcaagtggggtcggagcacatgatttagggccttgaggaatccatcaggaatagaactagagaatgctggggcagggagagcttggggctctcactgaggtccggagaagtcaagtgatttggccaaggacacacaggagctgcccagccagggtcaatccaggtctcctctcactgctcccacccctccactcaccccactcccaccccgtccagctccacccacagagtgacatgtgagatcccccacatctcatgtgctcggtaccgcccagactgctgctgctccgagtcctggctccatcccttctgctgagcaactgactttgcctctcttatatctgtaggatggggataatggtaccggcccctctgagggttgttatgggcttgagctgggtgaatgtgggcagaggccttggagcagagcctggcacccagccctgtttggtgtttgctgttgttgttacccaggaaggggtcaccagcagttcacggtcttttatttttgggatggagtctggctgtgacacccaggctggagggcagtggcacgatctcagttcactgcaacctccgcctcctgggttcaagcgattctcctgcctcagtctcccgaatagctgggattacaggcacatgccaccatgcctggctaatttttgtatttttagtagagatagggtttcaccatgttggccaggctggtctcaaactcctgacctcaggtgatccgcccgcctcagcctccgaaagtgctgggattacaggcgtgagccatcgttcccgatcagcagttcacagtcttaaaggccaggaaagttcctttgaaagactgagcccctccccagcctaccctgcgttcgtcagtgtgggcgagtggggacagctaggtatcagttctgggttgtaagcctcttgctgtctttttctttaaagggaggagaaagacctcaaaccctggcctctgaagatgctgctgggaggaggtatcaaggggtgggggtagggtggcagccatttgccctccggccagagggagctggcgcccctggctggcagtgttgctggttaagctggcacatccctttgccaccccaggacttgcacacgaagccattggttacctaccaattagtggccaggacagctgtaggggtgacagggaggggaccaagaggaggtggaatggtggacacttagggattgaaacgggaggtgctcgcattggttcaacagtcagactgagaaaaggggctgggcctcagcagagcttgccttgaccaatagacgacaacgtctctaggtttagttccatgaagaaagggaaactgctgtggcagctcattggttctctgcttttgaattggattgatttgggttggtttctcctcagattcctagtaagtttccttggaaaaacacagggcttgtctcagcggaactcagagccaaagcatgtccatggaaggctcttaacacctctgggcctcagtgccttgtctgcaccctggagagctgggcagcagcattgaaggtgccttccgatcctgggatccccagcccacgtttccacacgctgctgacggctgggggaggggtgccctcttagctggacaacggtcaccagggaggtgggcagggggagagcagggggtcctgtgggggcgagtgccccggggtgccatctcttcccagtccccagcctgcctgtgtgtgtttcctccttgcctggcttcctgaggtttggcctagggcgatgtgcaggcccctcctctctgcacagagccttccctgcatggctcctggagagggactggagggaggggctgtccccactcagcctcccctccatccaaggaggtgtgccaggcaccaggagccaccgaggggggaaggtgttggggagctctggatgagtgtcagcagacacaggagacacggagacaggagacaccaccctcagcactagcatggacccggggagaaggcagcgggaggctggcagctttctgggttgccccagtgtgggctgcaggggcctctgtgagcaacctgtgccctgggttggtgctctgataggggcatgtctgccaggaggggcagaggcaggggcatgaggatcccacgtggagcttgttgaggaggtaacagaggccaggggccagtgtggcaggaggcctgggatggaggaccactcaagtcttcagcatggccatagagcctggcttgctggtcctgattctcttttctggttttctgctcggggtggggttgagagcaactccgcccagggggcctgatgactgctttgctgcgtgtgcctggggagggaggcgctgccctgcagcctcagcttggggtgagatgacacttccatggggactgcaggagtagggaggggtggcaaacagcaagcatggattgcacaagccacagcaggggctgggggcccccggtgtcctgggaagcagtggccaagctggtgatgatgtggagaagcgggaagggtcggagagagcctggaagcagaaggcagtcaggacaggggccagctgaccccagaggccaggagtcagggctcctgaagagaaaggatggaaggaatggagcggggacgagcaagagccagtgtcccagagaggaaggagttgtgggttccggcggcaggcaggagacaggtctctggggtccctaggcccaagctggctgggacctcctctccccactgctttgtctacactaaaccctcaggacgggggagggcggagacactagcggccagcacaggcctccctaccccctgctgggttccctccccagctagccaggaagtcccttccccccttcccagggccattctcatcatctccttccgtacctgcttccagcccggctcccgacttcatttccgaacctgtttggaaataaagcaagcgtctacagccagggcctggctggccagggtggggtgggactgggaattagctgcttgagcggggctgggtgaggggctcctttcccagtcatgtctctgggaccccccaacagatccaggctagcccagctgaacttggagttcattcaggctgacttagagactctggaggggctagggaccggagagagatcacgtctcggaggggtctgggagggttggggtgagaacactcgggggagggcatggggatgggggcaccaaggggaagacacggagggtaggcaacaggggaccaggaaggtttgggatgatgtgtggatgatattatgcaaattatgtgcaaagcattatgcaaagcagcacctattagggaagaggtgttgggagatgctgtgtgatttgacccataggtgtgatcctggtgtggcccactgaggcctgggggcccagctgagaccacccacttggcctagaatctcttgctgggcctgacagcctgcgaatggacctttacctaagagggtgtcagagatcgtcaggactgaggcctcctgggcctcagaggcccaggcccagctgagcacgaatccctggtccaccatggcttagcccctgctggcaaaagggcaagatcaactgcccctctcagaacccggcttgctgctggctgtggtggggcttctggagccacccctccgtgcccctccaaggctccccatcctgttgtctgtgcctgagagctctgagcagacgctggagatctgagcctctttgaccaggagctgggacgtcagcgcacgggggcacagtggggtgaggcttgttcctcctgcctcctccctctcacccacccggctgctttgcccagcgctgcctttgaggtacaggggtccatgtgcctcctgggtctgcaggtcatctgagcccagcccccgaccctagggatctggacaagcaagcctaaccccttagctttagcctgggtgccctctgtgggacttgtgtctgagtaactggatgggcttgtcatcttaactgtgactgggccaggttcccagcacacccatgccagtgtatcccacgctccacccaggcatgacactttggtgtcagaccagggcccatggcagagggcagggcacagaagccagggcctctggaggctactgggcagcttgtcactgccaccagcctgctcactgttgtggtcacctcccactgaagcatcgccctcaagggctgcccctctgagctgtgttcttccctttcttggttcctggtggaggctcgtgccccttgcttcagcgagagcctggctgaggaggctgctggctggctaggctgtgtggtcagccaggaagagcactgtggcttgtccttgggccctggcccaccttgcagccacccgcgccctgacctaggtgaggagagggccctctggttccatcgttcgttgttccctcatggccctggcagctctcaccttgctccttgagccggatgatctcagtgtcggagccgaagctgttccaggccgtgcagttgtagatggtctggaagtcggcccgcacgatgttgctgatggtcagggtggagatgacgccctcctcggtgctgatggtctccaccgtatagcgccccgatgtgcccgactccagaacgttctccttccaggaccaggcctgcccgggggcgcagaatcaggaggagaccccaccagaggggcccaggacacgcccacaccagagtcacagtgccactgtcctgctcatgttcatgctcactgccacacactaacacatgtgcacacgggtatgtatgcaggcacacatgccacacaccacaaatatgcacacatgcaggtgcacacacaacacgcatcaccacacatgggcatgcacagcatcccacacggcacccacatgcaggtacacgtgtgcacacacaacacacaaacacatcacacgtctatacacagctccccacacatggccaacacgtttatatacatactacacacaccacaaatgtgtacacacagctctgcacacacacaagtgtgcacccactataacacacacatcaccacgtacacataccaatgtatatacacacaggtttgtacacacacaccacactacaaacatgcatatgcaagtacatgtaccacaacacacataaacatgcatcacaacacatgcacacaccaaagcacacaacacatcacagtgcacacatgcctgcacatatgtgcacatgtcacaacatgcatacacacatcacagtacatgcacatcacacttcacactaaaaacatgatacagacatgtacatacacatggcagacacgacaccacatctacacgcaacacacagccactccccgaaatacatgtacacatgcacacacacaccaagatgcacgcaccatatgccacaatacaacacacaatacaagcatgcttacacacatgtacataccacaacacacactgcaacacatacacacattcgccatacacaccatcatgtgtacttacaggtacacacactatgacatacacacacaccatgtgctcacacacacaagtacacacactaccaacagatacacatgttcacacatgccatgacacatgtacacggtaacacacccacaccacacatgtacacaatccacaaacacatgtacacacacatactctggggcatcctcagagggtctttccatcccagaaaggggcctggggagcatctttctgggcaaagtgggtgccctgttggcctgcgcactgcgcctccacacaaatgccccccgggactgtggctgcctgggtgggtgtgagttaggacagcagccccatgaacgcgtctacctgtgtgatgttgtatgtctgtgtgagaaatgtgtctacagagctgtgtttgcgatcaccttcgtctgccttagtttacagggctgctggttaacagttttcagagccggccacatacactgtctgcacctcatcgtgtaagcgcctcgtatatcctggttcggggctgatgagagggactgagtttctcaagcttgctgctattgtcacgctggactgacccattcctggccgtggggctctcccaggcattgcaggatgtcagcagcaccctggcctctacacacccggtgccaggagtatcctccaagtgatgacaaccaaaatgtctccaggcactgccaaatgtcccctggggccagtgagaaccgctggcctagaatcagatatttctggagagaaggtgtgaaaatgtccaagagtgaatggaatatttgacaatgagcatgtgttacatttataattaaaaacatcaaaaagcaaagtgaatggggaggcgtaggtattagttttattcatgagttcttgcaatttttttgtgaatctttcagacagtgaatgaactgaatgcttgagaaagcgtgtagcagcaataatactctaataatatcttagttaacaggatgacagtttcagttggtgcagcctgggtgtctcagcccccgcatgcacgggttaggggtgacctcagctgcttcacatctgggccagccccaccctccctgcacaactgccctgcccactccacccctggacagtcttctagcaggattttgccatacactgggaattactacaaataagttttccccgagtagtgctataaaatgctcacttttctttgttttcatgcctgagatccctccagttttagatggatttgagtacaagactctgcccctggatcacctgaggtcaggagtttgagaccagcttggccaacatggtgaaaccttatctactaaaaatacaaaaaaattagctgggtgtggtggcaggtgcctgtaatcccagttacttggaaggttgaggcaggagaattgcttgaacccaggaagtggaggttgcagtgagccaagattgcaccattgcacccagcctgggtgatagagagagactctgtctcaaaaaagaaagagggaaaaaaagactctgccctcaccttaatttttttgttgttgttgtagagacagggtctcactatgttgcccaggctggtctcaaactcctgggctcagtcgatcttcccacctcagccttccaaagtgctgggattacagacatgaggctcctgctcagtaagaccctccctttaaaaaaatgcagatactggctgggcatggtggctcacgcctgtaatcccagcactttgggaggctggggtaggaggatcgattgagcccaggagtttgagaccagcctgaccaacatggtgagaccccatctctactgaaaatacaaaaattagcgaggtgtggtggcagatgcctgtaatcccagctactcaagaggcgctgaggcatgagaattgcttgaactgggaggtggaggttgcagtgagccgagattgtgtcactgcactccagcctgggtgatagagcgagactccatctcaaaaaacaaacacaaacaaacaaacccaaaaaacacacaaacaaaaaaaccaagcagatagctggtaggaggcgctgagggtggactcctcagttgccttagctgcattgcagggataagttctttgaggaagggagagagaatggaatggtcactttagaggggacgattgataggcaacagggcaggctaccatggacagtaaaggccacagagacctggcaaggagggctccaggaggcacagaaaggggttgccaactattacctgcgctctaagattttgctaaagactggcctggagcccaggaagagaagaagtcacttgtcttttctctccactaccctcgtgtgcccctctgcccttaggatgcggaatttggtcagagccgttcatgtcagagctcagcagaatggcagctgaaccctgggagagcactgcctgttctgagaaaggcctgcaattgtgtcttcacgatgcttttccaagacagccaaggcaggtataattttcctcagcaagaaagaggaacctcggaggtgtgcaccgcctggctggccacccaggtattggcaaaagtgactgttgggctgctggcccggcccccgcccgccgtccctggagcactcacgatgcggtccggcggcggcgtgctccggatgaagcacttgatctggcccttctcgccgtggagggcgtgctgggtctgggtgctggagatgatggggggtcctgttgagaaacagcgtcccattaggcacccgggaagggcacgtccctgctggcgccctcttgggtgggttcagaagtgtattcattaatccaagcattcagcaaacatttgccgaaggcctgtatgtgcaaggtaaagtgcaaggtagaggactcagagataaattaggcattcagtcataaacctctcaagggatcatgagcgaatgcttctaagtcagaacccccagaagatacaaataactgtaataaaaggtggtgagtgttagtaccacaggagcggtgcagataaagtgctaaccgacttcagaggagagagaataattctatctggcggacggggaaagctttagggaggaggtggtaagcctgcagagggggtggggaggtgtctagatgaaggaagactcccccgcctcagccagcggcacccctgcgagccattcctcagatatccagtagagggcgcccttgcctaacaaatgggagctgctcggccagacgggccaacgggaagaaatggttgctgtccctctccttagggcgggaatcaccccggacagggggaatgcatgcgctggccgtgttcacagccctcctcccacctgtgtctcaggaggtcctgcagttcatcatcttgtctgcctccacgtccatacccagactgcccaagtgaggccatggctcccaaactgaccccaatattatcatatcacagagtgtggcacatgtttatgggtgtcaggttctgagagcgcctgtctcattcaccacattgcacagccaagagagttcacctggtggaggggagcctgttccccagcgcctcctgtccagttccgcctgttacctaacccaagtctttcccctgtgacgcctgcctggccgtgaaagacaaaagaaggagcagctagcttagcctgggctctgctggcttcctggctgggctgggtggttgaaggatgggagtagggacggaaactgtcatgctccctttccaatccctggggtcacagttgggacttagatggcagataccagaggaaagacagccgggagcaacgcatctggagaacacacagaattatgcaggaacaaaacaaaaattgctgcaaacataattgctgtttattagccaccttaattaaagcagatttgcatttctatgagtagctctcagccaagggagaaaaggtactgtagacactccagtgacttctgttgagtttgagaaggcaaaagggctcggggcagcgtgaggtgggcgtgggggaccctccatggctttaagaatgggctgagcgctgccctccttcctaaaaatccttcagctccaacaggtctaggacccaaagagatgaggagattgatgttttaggaaccggatggtgctttgttttattgctggactaaaacgtgatgataatataaaaccttttctggtcaggtgcggtggctcacacctagaaacctagcactttgggaggctgaggagggtggatcacaaggtcaggagttcaagaccagcctggccaatatggtgaaaccccgtctgtactaaaaatacaaaaatttttagtatttattatttagcctccctacttgggaggctgaggcaggagaattgcttgaacctgggaggtggaggttgcagtgagccgagattgcgccactgcactccagcctgggcgacagagcgagactccagctcaaaaaaaaaaaacaaaaaaaaaacaaaaaacccaacatgcacagacacacaaaacacacacacacacacacacacacacacacacacacacacaaaaccttttccttgtgcttcccaggagctaggaattccctgaggggttttcatgattctaaaagccatcatcaaatgcatctgcttcttaaaagaaaatgaaaaccaggataaagggaaatggggtgagggttagtaagatttctctccccttcctgcagatacctgatttgagccaaatcggttgaggtgtgtgccaatttctttcccaaaggactgctgcgctggccagcagttgtccaaggctgggatttgtcgcgataaaaacctgatctcatttgaatgctttcatatcaccagctccctccagcccatgcccaggtcccatccactgggcgtcccccctccctctgcctgctctgcagaagcaggggcagacagttcgccccctggcaggtctggtgcgctcccctccggggccactgaactcatccacctgcctccaggtgtgtgaggccaccctagtcaagaaataaacaagcagcttctttgcttccctccaatccctccagcttttctctgcctggaagcctcggggagcttgtgctggcaggggtggaggcagaggaggggagagaaagagacctggagagtgcagattcaaccttggtcagcgccagggcccgggtttcagtgccctccccgtccaagagaaatgtccctcccggcctgtgttccccagggggcattctctcctcaagaaatctctttaaatctcccttggaaatgtctgaacgtctaaagtgacagcagatgtcagctcctcctttatccacctgcttttccccagaaacgccaatgctcatttgatgctccaggcttgggggccctggagtgcatgagtgagtgtgagggtcccgggctggctggtcatagggccagcagagcagagccggctgcaggcacagacagcctgacttccgagtgccctggctggcgcgggctgtgtggagggccgctgatttcactggggcctggagctctgagccgagtgtcagacacctgcgctgaaaggaaaaggctgcagcctgtgttgccatggatatacggaggcgcgatcagatgctgttatttttagccctgcagtgccaatttattggtggcatcctggggacactcaggaaaggcaggagggctccgactcagggctctgccaggacaggtggctgtgaacgtgctggggtctgggtagactcagcctcccttgggggctgccacgactctggggtggggggagaggaatggaaatgcggggcagtgtggggggagctggtgaatggagacagtagagaggtatggctgaggagacaccaagctggttttggttttctagcgaaggggagaatagatgaggccatcagcaggtggctttctgggtagagaggaagctgaagcccacgagctaatttggagacctcaggagggccctgctctggggccaggacccagatgtcctgcaaatgttggtggttcagttcctgcagggtcccagagctttggggttttgatctgagtcaggctatggtgggaacaggggcctcccaaagggcagtgggcatgacagaggtgaggggggagcattcggaaacggcagaggaatcgaactggcagctttgctttttgcctgtggccaaagcaccagatagggcagggacgtccgcatttgcgtcctggtgccacaaccttcttgggtctggcctgagccaggtctcagcttctccatgactgtctacaccccatcattcaggcctggtgtgatgcccttgtccctacatatttcatgtaacagtcattcatctactaactcccaccgtgaaaatactcccctgctgcaattatttttattatatataataagacatgccccctgccctcaagggggcccctgaacacgtggcctcgtggagacggtgacagggctccctggctgggtgactcacacgcattgggaagaggctgatcaggagctgcagagatgctctcttaaattctcatggggccaggagaggtggctcacgcctataatcccagcactttgggaggccgaggcaggtggctcacttgaggttaggagttggagaccaacaatggtgaaaccctgtctctactaaaaatacaaaaattagctgggcgtagtggcacgtgcctgtagtcccagctactcaggaaggtgaggttgcagtgagctgagatcgtgccactgcattccagtctggacaacagagcgagactccatctcaaaaagcaaaaaaccaacaaaaaattctcacgggccaaggccatggtgagtggatgaaagggtggacacgttggccacctagtgacctctgatgctttttttcctggccaggataaaattcatcacccaccactctcagggctgagaccccttcaaagctaacaaacaaaaagagaggtgactagaaaactacccaggcccttcctccctcagcctgggtctgacggggaatccaggaggtggacctaattgttgtctacccatagttggaggtgacagcaaggcccagagccagcgacagctcctttggggctatgcctggtgccaagatgcctgaggtccttcttccctccctcaggcctggctcaccccagcgagggtcttaccattgacggtcagggtcacctctctctccccggctcccacacggggcaccacagcccggcacacgtacttgcccgcgtcctcctggcgcacggatttgagggtcagggtcttctcattgctcaggacctaggagaattggcaggctcagatgccaagagcaggcggaggggtgcactcttgtctctgggaacaaggcagctgagaggctggcctggggtaactgaggcagtctccggcatctcagtaggaagcaaggtggggaggaaagaggccaaaagtttcctggcccagacaatgcctgtgggctgtacagaggagactgtaccagcagagaggccaccccgtgtgactgaggatgttacatcccaggcgcagccctgtgggctgggggcatgtgggggcacatgtgccggaggagggggatgcctgcctggggacttccaggtttcctcctacaggaacctccctgtacctgcggtggcttctcctctcccaggctagccatgggtgacatgatcctacagctgaacttctctgggggctcctggacctgttttcagagtcattttcaggatccctttgggatatagcttggagtgatgaaaacaggctctggcatgagcttggtctgcgttcgaatcccggctccagcagtgaacacctgtgtctctttggtcagttacttatcttctcagacgctccctttctatgtatggaggctgctaggataatgcagcgtctgctacataacaggccacacaaaggtcggtttccttctggtccccctgcttccctacctggagctctccctgttccttcctatgtgaggacatctgacaatctcttatgcactgaagaatatatacgtcttaaaagaggaacacaagggctggacacggtggctcacgcctgtaatcccagcactttgggaggccgaggtgggcggatcacctgaggttgggagtttgagactagtgtgaccaacatggagaaaccctgtctctactaaaaatacaaaattagctgggcgtggtggcccatacccatagtcccagctactcaggaggctgaggcaggagaattacttgaacccgggaggcggagtttgtggtaagccaagatcacgccgctgcactccagcctgggcaacaagcgcaaaactccatctcaaaaaaaaaaaaaaaaaaaaaatggaacacaggaaagtgaagcccaagtccaaggctaacggtggctttatttgggggaagtttaaaaggctctttctttctctttcttttctttctctctctttcttttctttctcctttctttctttctttctctctctctcttcctttcttcctttctttctttcctttcttcttcttttttttccccaaggtcttgctacgttgcccaggctggacttaaactcttgagctcatgtgatccttccacctcagcctcctgagtagctgggactacaggtgtgtgccactgtgcccacttgaaaagcctttctagtgccttccctcccagcacattggtgaccacctacttttcttgtaaggtttaggacagggcaagagtgcaatggctgaatgtgctcagggtgggacaggcacatgggggtgcctgggttccccctcctctttctgggatctttctccctgtggcttacactggaggctgactcccccagtctaatagtgagaggggcctgggcagcagttccttcttgctccactgtccccgccccctgccagaggtgccccgaggtctgagctgcagcctcaccactccggagccccgcttcatccagacgatggtcagggatgggttgccggtccaggcgcagctgaagatggcatcagagcccagatccacgagcaaggattggggttctgtggtcatccggggcccaactgcgatgtgaggaagaagaagacaggttcaggtgggtggggagctctgggatcctccttgctgctgcctccttttccccctagaccttgactggggggaggcaggcagtggggtacttgtgccacctcagtcgcttccattttaagtcttatgtccgggcggggtctgggatctgggagtgggactcaggaagcaaggaggagaccactctccctgaggcttcgcctctcttgggcccatggaggtggtcggcagcgtggggcctgggaagaaggtgctggggaccaggttctgcctggatttacccccacggctctcatccccttccctctgtctggatcacgcccggtgctagaaagctgcggaagcccctccatcccagtggcgggcaggggccctcctcctgccctggaaatctgggctcttgggatcttcatgcctctgccttcaagctagctgccatctcctccagcctcagccttcatgacctggaatcgagtgactggtgcacctctggggtgggatgggggctctgagatgcagggtgatggaggcagggctctcgtgacccacgcctcctcccccagggtttcccacccggtgctctcaggccaccctcctattacagccgttccagcctctgtgtcacgcccattgcagtggagcagccctgggttccacttccgacccctctcctaagcattaaagagctgaatgcaggctcctctccaccttccctagcatgtctggagccttctgtagaccaagcttggtctacacagtgggggccgtgtggggattccaggctcagggtccgaccgtggccaggcaggcctcagagtgctccttccagggagcagacagagcctgaagcctggtgccaggagactgcgattagtcccctgatgtaaaaagggagtaacagcactttcttcggaggcttcaagggcaagggggagggccagattttttcaagtttgtaaaagcaagtttaaaactgtaaggggcggtgcatgagctaaggatgcttgttttgaacacatccagccagctagtccatggcagtgcgctgccttgctgcgggtccctgctggacctccagtgaataagaggggatgggcaggtgcggtggctcatgcctgtaatcccagcactttgggaggcagaggtgggtagatcacgaggtcaggagattgagaccatcctggccaacatggtgaaactgtctctactaaaaatacaaaaattatctgggtatggtggcaagtgcctgtagtcccagctactcgggaggctgaggcaggagaatctcttgaaccagggagttggaggttgcagtgagcagagatcttgccactgcattccagcctggtggcagagtgagactgtctcaaaaaaaaaaaaaaaaaaaaaagaaataaaaagaaaaagaaggtacgtccgtgagtcccctcagtggaaggcagcagaatgtgtgaatgggcaatggatttggtcattgcctgggttcagttctcatttggccacctactgtgtgacctcagacctccatctcctcattcagatgatgagaataaatatctacccatgatggcctgcgtgcttgtgtcccccgtcaaccctgcaattcgtaaattgaaatcctcacccctgtgggatggtagtaggaggaggagctttgcaggggcaggggttagatcatgagagtggagccctcgtgatgagattagtgcccttggaataaaggccccaagagcttgcttctctctttctctctgccatgggatgccacagcaagaaggcagctgcctgcaagccaggaagagagtccccaccaaaacccaccacgatggcaccctgatttcagccatttaagccaccgagtctatggtaacgtgtcatagcagccccagccaagaccctgactcatggggtcatgatagggattgaaataaacatgaaacaatgcacaaaccagctttcgtcgagtgcaaaccatcctacgctcatgacgcatgaagcttgtgttgtgtgcaatgaatctagccctggtttctccagctctaagcagaaaccagtggatgcctgctcgcctggggaagcctgcaccactgcactcacagtagacgtcaaccgtgcggctgaggttggtgctgcccagggcgttggtcacctcacaggagacgggctctgagaagtacgtgtagtccactgtggtcctgtacacctctccagatgcctccttgatgatctggccccgcttggcccacctgcaacaaaggccaggggctgatgtgggccttgagtggcaaggccaaccctccgggagctggacacatccatcccatggaaaaatgaggcctgggttgtgtggcaagtggggagtcctctggggtccgtcaaggggaatcttcacagaggggctacttcaagggctcagaaagagttggttttgctcccacccaggtggttgtgaaggcagtgggctttggtttgtggtcaccaggcagtcagtggcactcaacaagtgggttattctggagggggtgagttgattactcggctggtcagcccatctgctggctagacgatggaaaatccaactgtcagtgggcagacagctcgctgtcctgctctgagctggatcatgggcccctttggaaaagaaggaggccaagtccatgacctcagaggccagggtcaaacggagcatgcccatacatgcatgctcatacgtgtgcacgagcacacacacacacactgacaaggcgagaagctgtaggagaggtatgctgtaggggctccatctcccgtccaaacagtggaatactaatacccatcaggaggagtggcgtgagcgagtagccctggctgcccctctctttcctcttgacaagctctcagctctcctgtcctgttctgcctcctgcttccatggggttctgcatggtgtctcctcgccccagaaagtcctcctagtttccctggatggcacttgctcttcttcctgcctggcctctgcccttgcagcctggctttgctcctctgaagcaatggctccatcagcactggcttggtgaggggatgtgagtcggaagtctcttttgtcggccaatcggtaccacacaataggggaggacaggaggcctctggcttgctttggatctggctctggggcagtgacccctgtgttggaccagtgacccagcagcctgctgtgtgcagaaagcaacggagcctcacaggggtgtatgtgtatacacatgtatgtgggtgtatgtgtatacacatgtatgtgtgtgcatgtgtgttcatgtgaatgtgtgcatgtatgtgtgcacgtgtgcatatgaatatgcatgtgtgagtgtgcctgtgtgtgcatgtgtgagcatgtgcgtgtgtgcatgtgtgagtgtgcccatgtgcacgtgtgcatgtgtgagcgtgggcatgtgtgtccatgtgcatgtgtgcatgtgtgagtgtgcatgtgtgagtgtgggtatgtgtgagtgtgtgcatgtgtgagtgggcatgtatgtgtccatgtgtatgtgcgcatctgtgagtgtgtgaatgtgtgcatgtgtgtgggtgtgagtgtgtgcatgtgtgcatgtgtgtgtgtgcatctgcgtatgtgtgcatgtgtgtcaatgtgcatgtgtgcatgtgcgtgtgcatgtgtgcatgtgcatgtgtgcatgtgtgtgtccatcggcgtgtgcgagcatgtgcatgtgggagcatgtgcacgtgtgtgtgcatgagtgtgtgtgtgtccatgtgcatggtgcgtgtgtggtgcgtgcatgtgcgagtttgtgcatgtgtgaatgtgggcatgtgtgagtgtgggcatgtatgactgtgtgcatgtgtgagggtgtgcatctgtgcatgtgtgtgtctgcatgtgaaagtgtgggcatatgtgtgtatgcgtgtatagatgtgtgagcatgtgcacgtgtgtgtgcatgtgtgcatgtgtgcatgtgcgtgtgtgcatgtgcgtgtgtgtccacgtgcatgtgtgcatgtgtgtgggcgtgtgtgcatgtgtgagcgtgtgcatgcatgggtgtgtgcatgtgtcaatgtgcatgtgtgcacgtgagtgcatgtgtccatgtgcatgtgtacatgtgtgagcatgtgcatgtgtgcatgcatgtgcatgtgtgtgcgtgtgtgcatatgtgtccatgtgcatgtgtgcatgtgtgtgtgtgcatgtgcatgtgtgtgcatgtgtaaatgtgggcacgtgtgaatgtgtacatgtgtgaatgtggccgtgtgtgtgcatgtgtgtgcatgtgtgggtgtgtgtatgcatgtgtacatgtgtgagcatgtgtgcattgcttgtgtgtccgtgtgcatgtgtgcgtgtgtgcatgtgtgcatgtgtgtgcatgtggttgtgtgcattagtgagtgtgtgcatgtgtgtgcgtatgtgagtgtgactatgtgtgagcgtgtgcatgtgtgaacgtgtgcatgtgtgcatgtgtgtgcatgtgtgagcgtgtgcatgtgtgtgtccaagtgcatgcgcatgtgtgggcatgtgcatgtgtgtgtgcgcatgtgtgtgcatgtgtgagtgtgtccatttgtgagtgggtgcatgtgtgagagtgtgcatgtgtgcatgtgtgtgatcatgtgcatgtgtgtgtgcgtgtgtgtacatgtgtgagcatgtgcatgtgtgcatgtgtgtccatgtgcatgtgtgcatgtatgggcgtgtgcatgtgtgagtgtgtgcatatgtgcgtgtgtgtgcacgtgtgagtgtgtgcatgtgtgagcacgtgcatatgcatgtgaagttgggggcttccttacggatctccagggagagagagttctccgtttcccctggtttaatcctactctgatcccaacattcttttttttgaaaccacggaacttctcttcaggctgttacagttgaagtgtctatggggagtttgtctttccagagctgcagaggcttgttgcctccagaagcgtcaccccacagccactgctccctggaactgcagtgtctctgctcccctgctttgcctcccctttatcttattcctggagcctttcctggcaccacaaacgccgtctcctgcccttccctccattagcttcttgcctccgtctgacccatccagccccgagagacgactgtttcttggcatcagacagaacacctaggctggcaccaagcagttgttattgcaaattaatattgggtaattattaagaacacaattaataataacaactgtagtttaacaacagagcaaaccatatctcccttagagcttaaggagcttcccaacaaaccattatgagttattcatgtgtcgtttcaatctcttaactttgatttaatgaccagacttaaaagagtcaggccggcccctgcctgcggcaaatgaattcagttccaggcacagctagggaagtgtgtccagccccgcagttcctttcaccctgctgaggcgagggggccaggtggtggatgcagcgtgaggccaagcgggcagctggctgggctgggaaggcagggagccctggctgctcacagctgtgggtgccgggctggggctggagggtttgggcccaggtgatagggccaagcatgcgtcttcctcagggcttcctggagaagctctcgcctctcctctccttccagggcccctcaccaggagcatcacggagggtggaagccccacctgcttggccccaagtaatcagcagaactgctgctggctccgggagccaaggttccctgccctccctgtcctctcctctcatggtgagggagccagagacggaagaggaccggagccgctgtcggggctgggtccgcaggagcccaagccaggtcttttggggaggtgcctcaggacccgacagagcccgcagctcacatctcgcccagccggtctttcttcccctcctgcactgaaaaaccctctgagaggtccctgccaaaagcacagacactcaaaccactgcatccacgcagctggccaaggatccaggccaagagctaaagagtgagtctcgccccaccctcttcgtgcctctcctgattttggtgcagtttcttccctgtccttcctctttgtctcctcccctctccccacccacctcccccaactcactgttgcttccccacctcccccagcccctctgaaagtggagtcagcttaagcctctcccaatcaatgtctaatttggtctgaacaaatgtaagaggattaattatttatatcacagaatcaggggggctggcgtgtcacagccgccaggttgtcctcaaatagaccaaggtttcatctcgtgtgggggggccacatcccgctatctgctggggaacactgagagactctcagaggaaagggccccaaagcactttgggctcctggtccctaggagcatctgcagtgacatccccatgccacccaggcctcctttccaggcactgggatggaggagggcgttatctctagcttcagagatgacagcctcttagtgacagcagggaggaagctatcaagatgaatgaaagtaaagaaacaaagtttcctgtaatcttgtcagttaggaaaaatcaatgtacttatgtgatgagatttgcttacggcttttcttcttggatcccaacattgcttctaaacacctggctgcttggtgagaccttgctggagtgaaggggctgagcgagtgtgggtgggtgcaggcgcccaccacctcccctctccgtggcccctccgcctcctcccttcccaggccactctggctctctggcattaacctgggggccggaggggctccctgaaagcctctggagtcctggagggagatgacccctcagtgaggtgttttcagggcccttcactaatcagaaggccatgagggaaggtgaccaggaagaactagtgagtctctgcagggcaccctgccctccctgcccctcccagctcctgcttggtataggaggggccggctgtgatactgtgagctccaggggagtacgaaagggaggacccacaggccacctgtagcatggggaagcccgcatgttctctgcttgttcattaacttttcagcttgcaaaaaacaaacttcggaattacagaaaagttgtaagaatagtcccattaactgccaccctcccatcgcccggattcaccagctgttaacattttctcacgcgtgctttgcggagacctctcctctcctcccaccttcttctctttcctattattgctgttctgcttttttgaggttggtgaccctgggaatcaggcccagcacttcgtttcctgggtgtttgctgtccgggtcagtaggcaggtgtgggtgggggaggcaggcctgggggtggaggggtcaggtcccagggcgtgcagccctgctgtctgcccagcctacccatcactaggaccccaggtgaccagagcctggcagtgaggagaaacgaaagtcgaaagttgtgtgtcctggtctctggggcgcccaacaggcattctaagggtggctgtgagggtgaataggggtgcttgccgggtggtctgtgggtgtgaagggctgccctgggaagctagcatgacagatattttctgggcatgttgtacctggtgtttagggaccaggagcagagacctgggagcagacagaggagagaagctgaacttgtatggagaaacccaggcctggcaggtgcagcgtggaagcctagggccagggagtctcattgggcgcctctcttgtatcttcagtggcttctgaatagatgccagaccacagccaaaccagacttgccccctggacctggctggacccacatgattctggggagcctggagtccccggctcagaagggaccctggaggtcatctgttctttcttctgactctagtcaagcaaatggttaaactggacaggacaaatgggtttcatcctatttaaaaatatccttggggataggaactctgggctctgcctgggtttctgactccagtgctgcttaattacgcactctgcagggagcacctcctcatgtccaacctgaatccctggctgtccctgtggcccatttccttccattctgcccacgggggccacactggctcttgtcttccctgttctccattcccacaggccggcttatttcctaggctggcaccattaacatccttggcctttgcagatgctgcagcttaatggccgagatcaatggcagaggtgacacctgggctccaccactaagcctggtctggtggaaagagaccaggctgagtcagggccatggcaagttccacgtggcacccaaaaggaggtgagtctgcccttgagtgcctccaaggtcacttagtctcctagagtcttgtgcagtgacagtgcccaggcagaaaggcgcccagaggaagcgtgtgtttattggatcagtcagacacatctaaggagcatgtggtttatgccatgtgctgtgctgcatgctgagagccatcagtgactaaattgcagttcctgccttcaagaagctctgtcacaaggcagaaacaagtaaaacaaaaacagtgatgctttggccgggtgcggtggctcatgcctgtaatcccagcactttgggaggctgaggcaggtggatcacgaggtcaggagatcgagaccatcctggctaacacggtgaaacgctgtctctactaaaaatacaaaaaaaaaaaaaaattagctggcgtggtggcgggcgcctgtagtcccagctacttgggaggctgaggcgggagaatggcgtgaacccaggaggcagagcttgccagtgagctgagatcacgccactgcactccagcctgggtgacagagcgagactctgtctcaaaacaaacaaagaaacaaacaaacaaacaaaccaacaaaccaaacagtggtgcttttatccgtgttgtgagcaagagacacacaggggccatgagtaagtgtgatcccggatgctcactggactgggccggggcccagacatcctgatctacccaggtgaaccagtttgatgggcacaagactagaatggaggttctgatcttgctgcttctcctggttgttctggtttttttttgttttcgttttttttttttttttttcctgagccttttccccatgtttggagtgtggaataatcaggctattcaagcagaagccgtgagtcctgcttcctccagtggaagagggcgcgtgcacgcacagaggagaggaagggtccacacggctagcaggcaggcgggtttaagaggaagggaagaaggctactggacacgcggtgtggactaggcacacactgcagccatgctgaggaccctaagtgacatcccacgtgagaggcacgggggtgggggccagtggccaggccgggccccctcagcagtgactctcacctgtactgggtgacagctgggttggcctttgcagagcagtggaaagtgacgacgttgtcctccagcactggctgtggctccaccgagaggttgaccagtggagggtctgcagggagaggagagtcacttgtagaccggagaaagaatgggggcagggagatcctgggcgacatggaggatacagccagagactccaccacccagggaccctcagagcagcccccgccctggtggtcttcaggaagctgggggctccatgggaggtgcctgcttcagacagtcctggaggtgggaacagggcctccccgtggacttggggcctggtgtggacacgaaccccgagccaggaagcctcaggcttgggcccaggggtttcccatcctccaacttttgggcggaacaaaataatctaggaaggagaggtgggaagaggggtgcagggcagagaggggcgcgtggacactcagtctcgcttcagtgcagactgtctttgaaatgtctgtttattatctcttttccgtaaaggttctggggcatttgttaacttgaaagcggcatttacaccctttcatcagcctaatcatctccactcagtcctggctggtggcgcacggcctcagcttcccaggccggggctcgcttcctcatttgacgtgataagaagccaggctctgaagtgctaaatggtgggaaggggaggagacagaaagtcagggagagaaagaggcagggagacaagaaccagagacacacagagacacacagaagggaccggaggccgacagcgagacatgtacatagaggagagacatggagaccatagaggaagagagattatgtgtgtgtgtgtgtgtgtgtgtgtatgtgtatgtgtgtgtatgcatgtgtatatgtatgtgtgtgtatgtgtgtatgcatgtgtgtgtatgcatatgtgtatgtgtgtatgcgtgtgtatgtctctgtgtgtatgcatgtgtatgtgtatatgtgtgtgtgtatgtatgtctctgtgtgtatgcgtgtatgtgtgtatgcgtgtgtgtgtatgtgtgtatgcacgtgtgtatgtgtgtctatgcgtgtgtgtatgtgtatgtgtgtgtatacatgtgtatatgtgtgtatgcttatatgtatgtatgtatgcgtgtgtgtatgtgtgtgtgtatgtgtgtgtagagcgagagagagagagacaaagatgaggaagtgacagggacagggagagacatgggcagagagacagaaagacacacacatagaaattgagaagtgcagaaaaagggcgagaaaaagagaaatctagagaagcagagggcagagtgatggagagatggagagactgacctgtttgcagagactgtgaatcagacaagaatttcagaccaaaagcagaaaaggccacggagacccggcacatagggcccgacaatgacagggtgttagagagaaagaccaagtcaaacaacgaggaaaagagatatgaaggaggagcagacgctgcaagatggaaagatggaaacagctcgagggggctgcagcagagagacagagaggtgggaagggcttccatcagcctggccctgcccagctcaggggcagctggctctggatcctctccagaggctggtgtcacccctgctgctgggctcctggtggcccccaggcctcggcacccccggggcatccacacgccgagggatgggggataacgagccagttcccatcctttttccctgtcatggcccagagctctggctgagttgagtgggcagcccaggacctcatccccatggacaggctgggccctgggctgcatcttctgggtcagtccccaccaacaagcagagcaaattgctggaaagtcacgaggacttctaggggtccagcccatttccagaaaaagaagtaaagaaaccagtttctcagaggcaatgaggaaaaatgctggtctctttcggtccccatgggggcaccacaaagggagcaaggccccagctggcccagttggtctgggctctggttgggactacggtggggtcctgagaccctcagagagtcatacagtcatgcactcagcctctaagctgcagaccgagccggccttactctggagttcggatcacataactgctcagctgccctcttcctgctggtgcccaagaggaccctgcctccctgcctagtgccaggcacgggagctggcctgagagatggccccagggctgtgctggtgtctgcaggcactggggagagaactctgttttctgagtagcaggtggctgactgtgctggggagcctgttctcccacattttccctagttccagacgggggaccacaaatccaggaaacctctgctcctggtgcggtcagcctgcctgcctttcgtggggaattacaagggaagtgccctcacttgtgatctcaatcccagttgtaaggcataattcaagtggtcacaaagatggggttacaaggaatagccacgagaacgctcctcccacccccagaaccccgtgacctctcctcgaagctgcaccctagcttccagggcaaggctgaatcaggagttccagccctctttccatgcagggctggctggctgatctgggcgtccgtgggaccctacctagagaacatggacactcagggaggagcctgcatctcgccgtgggttggagaagtggaggtggggcagaggagcttgggaatcgccaccggatccaaacgcattgctggcccgtgccctcgcattataaaggccaacgctgggacgtgagtacccaccccaagtctggtttgaggaggtgagtgccagtcccataggctcaagggacccgccacagaacttggggggctgttccaggaggcccttccctcacctgggggtcttttctaaagtgatgaggtctgagaggcagggaggtggggcacacacctgttgtaggaccttcctgctgcccgatgcctcatcacgcccctgccatgatcagctcactcgtaaggctgctctcctgcactttcccttcctcttagcatcgtctttggtgatcacctgccccgaagcgattcacaagggttccacactcactggccatatctgcacctccaccccaagaccagaggtgcccaagcttctttctccacttctgctggtgtacagaatatacattttcaggagtctgccaagctccagaggtataaatagtttatgtcatatccaactattaaacatgattttaatctcacttgtgatgtcggcagcataacttgcaggagggcagctttgatgtagctggtggaactgagatcacattgaacagatgttacagctgagagtctgttagtgtttccatccgcccgtgtgtgcgtgtgtccatgtgtgtgtgttttcaggggaagtattacatggaggagagggtgggaaaagagagaatcttcatgactcagtgattttgtagcacattcatttgaaacttggcagctggacacagagtccagatgtggtgaggctttgggggtgttaagctttctctcccattactcaatctgagggctttgtcttccgttgggtaacatatgaagaccaagagaaacaaacaacaaatgtgcttttgctgagtttggatgcttcttggttgactgagaaaatgagcaggttcacaaaggcagctctgatgcagcccatggtgtccttagtaaacagttggatgctgactgaatgaacaaatgaataaatggaggaggagcgggagcaggaggagggggaaggggggagggagcgggtggagaacgtgtgctttgcttggcaagcacatacaagcaccttcaggctaggggcggtgagcgcggggacaaatggatgaagatcccttgcctgttagggctgtggggacacctgatgaggggcaccactcacctatggctctgcgtcctgacagcagctggtaggtgtggggcactcacaacgtgtcagacactgcgctagggggcttgacaggaaggatttcatttaatcctcactgcaaccttaggaggtaagcatgattacttccatgtacagaggaggaaatcggggcacaaggaggttaactaaccgggtcagtgccactcagtaagtggcagagagttcaaagcaggaagaatgctgtggccttcaccactacccagtactgccttggacgaggctggtctgggaaactgggctgctgggccccaagtgtcactctgacctcattctgacgcctcctaaggtggctgagatgtccttggaaaggaagccagaaagggcccagaggcctggcaagacccagtgtcctctggatgcagactgtcacctgcaccctgttgaacgatcttctgtgggcatgagtgcagaaggccgggtgggctgtggttaggagggcgagtttcccgttgcctggagaggttctcctggggtaatgcctggagcaggaaactgcttcttcccacctctccctgccaggacctacgctgctgtcgcagggggccagctagattgtcacttttgtccaggagtctgtaacattttgtacaggcctcctgatcaggttggggacaggctggggaagaagcgagggtggtggtggtggcagtgaatcgaatggcagcctggaagtaggaagcttggatgctctgtgtctcccgccctctccccttcctgatttggattgcatctggacagagagctctgatccgtggccagtcctcgggcaagaaggggccttggatgtcatttggccaaatcagacaaggaaccagagtcccctagggtgatgtgacaggcgtaggcccagcccacccatgggttgtggagccgtcgtggatgctggactgcatggctttgcggcatctcaccttttccagtggggcttactgctccatgtggctgctcaccacacaggaggaggcggtgctcagacccaggacccaggccagggccagggccagtgagggggaagagccgagggtcggagattaaggaggcctggcctcactttcagggccagccctgcttgcactgtgtgccccgggacctccttcagtcaccctagctctaggcttggccagagctccgcggccctggctgcttgtgaatgaggatgccagaaggctccttggtacaggggtatgtcgggggttgtaggggggacagagatgtttgttaatagctggtggcaagacagtgaagataaagtcccccccgccccaagaactcagcctttgtgtgtgggtatcttgagcctacctgaggttttcaaccatttcttctgccctctggaatctaaatggtgtctgtcaggattctagacactggctgggaacttctgctctcagctgccaagatgagctctcagaaccttaagacctggaccccatctctggactccaggtccctggagagacactcggagcccagaatccacaaggcttagagaaatcagggctgttaggaagtgtttttaaatgcacttgctttaaaatgagtaaaaggctaaggaggacacgaatgccagcctgcagctccagccttgaaattcagagcccaggacagaagcagccacctgcttgcagtagcgttatgtttggcggcagggaggggatctcagaggagagaagtccacttttgagtcctgactctttaaactgaactaatccagtcttgagaggaaggcccctggaacaccttgctgagctcttcttggttctggggctgacaggcaccttagggagacttttaggagactttcaggggtctctgttaggtggttgtgggatgcgatgctggtggagccctgaagcatcataactgtcaacatgaatcctaacacgggccaccgagggctggctgggcaggagtgtggagaggatgttaccagggtggactctggaaatctatgctacctaagtggtcttgggcaagttaatcaccctttcggtgcctcagtttcccacggtagggaccacagttgcaccttctccaaacagttgttgtaaagattaaataaggccaggcgaagtggctcacatctgtaatcccagcactttaggaggccaaggcgggcggaacacttgaggtcaggagtttgagaccagcttggccaatatggtgaaaccccatatctactaaagatacagaaattagctgggtgtagtgatggatgcctgtcatcccagctactcaggcaggctaagacaggagaatcgcttgaacctgggcagcagaggttgcagtgagccgagattgcgtcattacactccagcctgggcaacagagtgagactctgtctcgaaagaataaaaaaaagattaaatgagataatacatgtagatttccttcttcttgtccccttgatcaacccttccatgagagtggctggtgcaccctctccagagcacagcgctgcttgccaattctgaagcctggggacccttcaaataccagcatctccactcagacttcccctccaacagaggggccaccggctaggccagcagaggcagcagctgaccgtatttattggtgtgaaagtcccaccttgtacaggtgttgaaatgtggcctgaagatgtcctttgcgaaagaccctcatctgtgaggttgcatctcatgacagtaaggaagacaagatggtccttcctgtccgtatctacaagctggccaatccacagagctgcctgacccatttcctgctatcagatgggccaggctatggtcagggttgctgggtgtttcaccctgggcctggcagggctgggttgggggagggggtgggtactcacgctggatgtcaatggtgaccgacgtctcctttcctccggggatggctttgttggtggcacgacacacgatgctctggccattctccacgtcaccaggggagatgaagagggtgctgacgatgctctcccgcttgccgtcccgaagcagggtcttgggagaaagggaaaggggagagaaagctccatgtcgcttggctggggtggccagcctgggttgggggtaaacgagcaccagcttagacagaagggggagctgtggatggaggggttcagcttaggagacctgggctgcccatgtctacgcagagctcgggggttaccccctggctccctggcctggctaagtgctgggctgtggaaggaaaaaggaactagacagttttccaccatgtgaaaattagcctggattcacatgctaaaagcacaaaagaaagcaggatgggtttcatggaaaccaggcttcagggaggtcccatgttgaaatgaactcacatctttttgcctctggtgcttgagtgacagtctcaggctctgtaggaagcaacgagatggtttgcaaccagcagggactgtggcccctgagcggggacagtctgcagaggaggcacagtttggggaatgggagtcagagtgggtggggatatgggcagaatcagtgcacatcaacctttcgattatttgcctatataaatcctttcaactttccaaagcgtttcactccctgatctcattagagtctcaatcaaaccataggtgggacagataccattatctcccattggataggggaggaaataggtgggctagacagaggctatggagcttgaccaaactcacatttcaagttggtcctgaaataagtactagtctcctacagcaggttgaatggtgtcctctccaaattcttgtctaccaggaacctcagaatatgaccttatttgggaatagggtctttgcagtttagttaagcaattagtaattagttaaggctcttgagatgaggtcatactggattcagagtgagccttaaacccaatgactggtgtccttggaagaagagaagagagtctgctgggtgtggaggctcatgtctgtaatcccagcactttgggaggctgaggtgggaggattgcttgagcctaggacttggtgaccagcctgggcaacataggaagatcctgtcactaccaaaaaaaaaaaaaaaaagaaaaaaattaaaaaaaaattagccaggcatggtggcttgtgcctgtagtcccagctacttgggaggctaaggtgagaggatcacttgatcccggaaggttgaggctgcagtgagctgaggttgtgccactgtactccagccagggccacagagtgagaccctgcctcagaagaagaagaaaaagaaaaagaaaaagaagaaggagaaggataaagagaaagtgaaagagaagaggaggaggaggagaagaggaggatgaggagaagacagagagaaacagagaaggccaggtgaaggtggaggcagagattggagggatgctgccacaagccaaggaatgccaggagctgccaggagctggaagaggcaaggaaggattttcccctggagcctttggaggggcacagccctgctgacaccttgattccagacttgttggcttctacagctgtgagataattgatttctgttgtgtcatgcaccgaattgtggtgctttgtaatggcagccctaggaagcaaacccatcttaactgctggtctcccaccttcccaggtcattgcttttctctactgggccacaatgtcattccgaagctagttccccattgtggctgctacctccttccctctcctgttcctctttgcagctacttccccatcactttggggcgcactaagtcaggtgcaccccggggagggtgtgctgagtgtgtgtgggggtgcacttccaggttgggattggggtctggtcagtatgcaaaggcttctgctactaggaggtactaggaaggaacctcactatgggtgcagtcctgtttcccccgactggagccagggagtagatgaacagaccactcctccctcaaaacctcccataaagtgacaatggcaatgtctctaattcttatgagggccccggaagacagcagcattatctttgattagccaaagagaaacctgtgttccaagtgagccgggaacttgctgggtggagctaggatttgcacttaagaatgggtgaaccctgagccacagcctctgctgcagccccgggggtgctggacggtgggtaccgtgctcttggcaggacagatgggaacagttagggccacagggagaaacctgtaagctcctagaaccccacattctgggtccttaattcagtgaggtttttctcaacttggggcaaacctcgtggcgtcaggagaacagggccagagcctctatatagaacagcacatcttgctggaggcaaagccggactgtgacattctagagagccacgcggtgcagctgcaggcctgggactcagggtgccagccacggccctgggcagaggggctggaggagagtgacgtggccagatgcagcaagccgggggcaggaccactgcagaggagtgaagttgaaccccaagccaaagcccgggcagggagggagcagcagctggcaccgctttaccaccctgccttgggctcttcagcagacctcatcgagtctataaatagccaagtgataataagaacaatttcctggatgaaactaagacttcgggtagggcgcgcaggggcggggaggtggtgaggagcaggttggtattcttcttctcttctttacatttccgttgtgctaacaagggacatttacataagcttgactctgccaggagcccttccaacggatgggctctgggcggtgggtgccagtggcaggggagggaggggacccagctctaattaggccctctgactgctccccctcctccctgcacccagcgtgctcctccgcctcggaatgatgattaatgacatatttactgggtccaggcgtgtgcttttctgggaaataaaaattctggttcaagttgtttgttccacctaattagagaaaaagggagatgtgttcattaaacaaaaggagggtgaggggaaggcacgtgccccagcaccaacaccctctctgtccccgtggaaggtcccagcacctcctgggcccctagctcgcgggggaccccaggccccgtgcagcgggtatcccagggaggaaggctgggtctgccagctctgctgcaggacgactgaggggaggaaggtgggacagagctggggggcccagggggaaggctggagggagccctgcacctgcaggacagggcgggatgtggaggggcacgggggatctgcacccccgggtttctcttcccccattcctttctgatctcgcctctcttgtttcttttgcttcactccttttcagaaatgaatctcccctaattgtcacttttctcatatgcaaatggagcctctggactttgcagccttgaaggtactgtccaggagaacattctatcatctgcaggttctagtcgcagctccactccgcccctcccttccctgcttcccttcactgagcttggctctggggacacaccatgggcattgaacctcccacctcctgcttcagaaagcttcatgccttgcaggtgagctccagaaggaagtgagttattcatggtgggccactcactgtgggagccaccgcctccaaggcctccctccagtgtggtgagcactaacgtgctgccagcccccggctcgcccaggttgcccatgtgactgccatggtggctcccaagagtccccgaggacccagctcctgtgtgtgcagatatgggccaggggcaggcatatagatggcgtgtgtgcagcatgtgtccgggaacgagcgtgccagggcatacacccccgtgggtatgtgcgcgtacctgtttttgtctttgggtgttcatgggcctctgtccactgactgccgtgactctgcggggccccaggttctctctggacgctgcctgctcaggtgccgcctcagggctgtgcacccacccccactgcccctccctaagggcagggatttggcactcacttctctagttccccagcaccggcctgggaggccggtcttcccaggtatggttgtacacagtgtaccccaccccatggttttcctgcttgggtggcagtggctggccactctgctctttccaaagcccccagggcctcctctgggcagtggagagccaggctgagctctcggaaatgggtgggctggagggcagacaaggggtgggggcccaagcactggtgctaaatatggggtgcccgatgacaggcaaaccgtctggaaaggccgagagtagcctgattgcctggcagcaaggccgcctcgcttctccccgctactcaccttccccacctgctgggtccctttttttttttttttaaaaaatcatggctctgcttccccttttgatagctgcttggggctccccatgggctggttgccacctggcttgaataagggtgtgtgggccaggtggaggatgcgcagtgctttttgccccagtccctgcatccagccttgaggccagaggccagaggggtgcccttcacagagaaggccaggatgagcctcggccacacccagtggagactctaggcccctaagctgggcagataggtgcagggtgatgggtgagtgaccagggagggggtgcccagtggagggtgagggccctatgcatgtgggcacttatccctttcctgagtggggtctccagagctcctcttagcaaaggtggtaaaaggcgaggccagtggtcctggtggtaggggtagagggcaaggggctccaagcagacacagacacgactgtgcgtgctaagaccttgcaaccctcctgcctggcaggaagctgcacttaggaagggttctttctgggctcagcctgtcctctcgcccctcctcttccgtaacccatccttcctcccctgctgtgtggacttgggggctttccagaagaaagaatgtggtctccactctggcgccaggccctcagaagtatgaggaacagggaaggaacccactgtccccagacagcccagggttgagtctccaggaagaagcttggaggggccttttcctgctctgtgcctctgcagccgacacccgctgggagcctgcagtgggcactgcccaaggccccatccggcagtgtggctcgccctgcaccctggaggctgtgacagtggcctgttaaggagaagcatggccagcctgtgctgggggagggactgggtgcttcctctcctgcccttcctcctggggaaggggcctggtgccctccagggctgaggctcatccctcccctactggtcccatggtggagtcacagagagaatggtcggtgagcaacccagaaactttgagaacaggcctggtgttttatgaaatagctgtatgacccctggggcagggaactggggttccccctgtgggacaggagccaataatagtagctcacatttatccagtccttactcctgcccttgacagggtgcttctgatgcataatttcttgtaagtcactctgcaaccctaacagacatccgtgatcattatcactgcattttgcagctggggaaactgaggcagagggtgacatcaccatgttatgttacggatcccaggtttgagctaggccttcagaaccatgtggccagcctaactatgacaccgatgtctgcatatgggaaacgcgaggtccatagtggggtggaccttgcagccgtgtggatccagtgagggggtgacaatcccaacagcagtgcttgttgcaagctcgctatgtgccaggcgtgtttctcattcaactcctcacaagcaccccttaaagtgggtgctgctgtcgttcccattgtatggcaaggacagggaggcacggcaaggtgaggtcacgcagctggaaggtggcagagcccggatccaaattcaggctgccagctcctgagcccacggggataatcatccaccatgtgacagccactgagggcgtcagacccgacagcagccagggctgccctgaggggtcttttctggggtccttggaggctgcctgattttgtgtgtgctcccagcttctcttcctctctgcggctgatgctctggcccctcctcatatgtagcctctctggggaagtcaggagtgctgttggcctatggcagggctccttgcagccctgggggaggagggggtgggctgggtccctgggaggggaagcagaggggttggctcggacagcccccagagcctgctccataggagccctggattgtgtaacctactgggtatactccacatcacaggcttgtagcttctccctgcccggcacacagccccgtgcctggggaagctccactgacgtgtgcgggctctgctggtcacccctttggtctccatgagaaccactggccgtggggtggacagttaggatggtggatgaccatggtttggaggagaggcccagagaaatgaagtgccttgccttgggacacagggcctcttcccatgctcatgtccagggacacattgagggtctcaggcctctgctgctccctggacaagccacagaggggcaggagaccatctgaggtgactgtcccctgaggaatctgtttctcttccggagcgtctgatccaacaccttcattttgcagacgaggaaacagatgcccagggagtgagttgcctgaggttatgcagtggaagctggaacccaggcctgcgactgcctggcgctgccgttcccgtcacaggcccaggagcatggatcgggtcccccgccctgctgtgcagtagtatggtaccaggctctccgaggggccttcacaatgtagacaaggatgacatgttgagctcaaggtgatcctgggacaggtccagcagagtgaccctgacctctctctccacctgatggcatgtgtcctctgcaggacattgactctgctagggtccaggctggcccaagttcagggagggacaggacaggtgctcagactggaaggaaagcccctatccttccttttcattctcctctggacaactctctctctgtgttatatccttgtattacataacaggacagggtggcttcagcccaggacataagggagaggcttgtcttccaagaggcagccatccctccctccccctggacttgtgtctgagggaaggagtttgccctgggttctggcaccaggtgctgggttctttgatcggcagccctggagtgacctcttggcaggtggtcagtttgggacaggaaagacacaccctcagagtggggacgggcctgcctcacatcctcggatgaccaaggccctgcttatctttccaggattgcttagaggactggtgggtagggggaaccaggccgtgtatttccccagtctctgaggacaaggaaaaccctcagacctgaggcgagcgggcgttctggaggctgggcccccagctgcggagcttgggggaccggcttgccctaggaggagcatgggcaagggcagaggccagggtgtcaggaattgtggttccaggcctggcactgcccactccaccactgagaaggacagtcacttccccaccaggcctcaattttctagctgcagacaaaagaggttggcccaggtatactgtaaggcctcattcatcttagaggctctgtggtacattaaccccatctgggactctatgcacagttttgttgagtggagtttggtgggggctgtttaaaaatgtacccagaattttgtttttattcaggtagagggaggccaacagatcaggagacaactgccgttgaaaagacagtttgcggccgggcgcagtggctcagtcctgtaatcccagcactttgggaggctgaggcaggtggatcacctgaggtcgggagtttgagaccagcctgaccaacatggagtaaccccgtctcttttaaaaatacaaaaaaagaaaaaaaaattagctgggcatgatggcacacgcctgcaatcccagctattctggaggctgaggcaggagaatcacttgagcccaggaggtggaggttgcggtgagctgagatcacgccattgcactccagtctgggcaacaagagtgaaactctgtctcaaaataaataaataaataaataaaataaataaaaaataaaaaaagaaagaaaaaaagaaaagacagtttgctactcatagttcccagaggaaggggaggccccagggtcagttggggctggggtgggaggtgtggggagagtgtgggcacagcctctgttgtggcttgctttcataggaaggaatggtgaggtagggttggtggctcagcaggtttaggattggatagcttgaataatttccctgggccctgagctgtaggggtggtctgatgtgtggccctggggagatttagggtaggggtataatgtcctggactatggagcctgatgaaaaaaggctgtgggggcctgggctctggattggttggtctgctttgatataaagcctgcttgctatctccaggaattagcttaccctggtccttccctgggtctgcaaggccccagatgtcaaagcatcataaaatacacaacattttaaagacacaattaatacgggggccagttcagggtgcttccagcccttggtatcgtgtgtgaattagagaccagaacccctgttggtagacacagcagggcaagggctgttgggtaagggatcatgggctggatttcagccctccctggcccctgagccaggcaccttggagatggtggagcctaaacggcttcacctggcagccctggaaagtggccagatttagcaaataaaatacaggatactcagttaaatgtgaatttcagatatataatgactgtcttctttagtataagtatggcttgtgagtatgtccaatgcagtatttggaagatacttacattaaaaagttattatttttctgaaactcaaatttaactgggcatctgtcttagcccagctgggctgctataacaagatatataaactgggcggcttataaaccacagacatttatttctcactgttctggaggccgggaagtccaagatcaacgcagatttgttgtctgttgagggacagacacctggttcatagatgccctcttctcactgtgtcctcacaatgtggaagggacaaggggtctccctcaggcctcttttttgtaagggcactgatcccatttatgaagctccacccccatgacctgatcatctcctaaaggccccacctcctcatacttgggggttaggatcttgacatagaaatgttgggagccacaaacattcagaccgtgattgcatcctgcattttatctgcacccctagaacctggccactactgtccctgagtctcctcgtctgaccatggcctattgttagggtcttccccagcagttaccctaggacatagaggagagagagagagagagagagagagagagcacaagtcagataaaaggatggacacacatacaaatgagtaggagaaccacagcatgaatgagaaaaagtgacacagagtgagagagcaaaaaaagatacaaggagacaaagagtgagagaaaccaaaaggggcaggagagagggacagctgcagagagacagggcagctggttccctccccatccagcccccattatcccccctctacctaagcccagcccctccccagcagccccccaccatcctcctctctacctaacccccagcccctgccaaccagccccccactatcctcccctctacctaacccccccagcccctctccccagcccccaccatcctcttctctacctaaccccccagcccctctcctcttaggcccccatctagccccccgcctaaccccctctctacttaacctccacccctcctagtcccctcctaatccagcccccgctcctttagccccctccttacctagcctcctccccatcaactccctgtccacctagccccctccccacccactccccttgaagcccgtccacacccaccccctcccctccaggcctcaccttggagtaggtggccccattgatgacctctccctttcgcaaccagatgatggaggctgcaggcttggcattgtctgcgtggcaggtgaggttgagagggtcccccgcacgcaggctgatcacagggccccccaggatgacggggtcatcaggcggcactgcggggagagaagcagtgaggtcaggccgaggctcccacctcgggcaggacggcaggcaggctgggaggattttgtggagatggcaacaaacaataattatcacacattaataaaacgcatcgtccgcttgtatcgtaatgatgagagcagcacccacagtgatccctgacatgtgcactgcgtgcttacagtggaggatattcctgccagtcatcgcatccctgctcaggacctgccaggaggggacagggccagcagcctcagcctgcactcccagacccagaagcagagctctgtggcccaggcgatgtctgtggctgctttttaacttctttttccttttttcgagatgaagtctctgtcacccaggctggagtgcagtagcatgatctcggctcactgcaacctctgcctcccaggttcaagtgattctcctgccttagcctcccaagtagctgggactacaagcacgtggtaccatgcccggctaatttttttttttttttgtattttaagtagagttggggtttcaacatgttggccaggctggtcttgaactcctgacctcaggtgatctgcttgccttgcctcccaaagtgctaggattacaggcctgagccaccatgcccggccaacacctggttaatttttgtatttttagtagagatggggtttcaccatgttggccaggctggtctcgaactcctgacctcaggtaatccacccgcctcaggctcccaaagtgctgggattacaggcgtgagccacggcacctggcttttcttttttctttaaatgaagcactgtcacacctgctgtctgagttagtcctcacaacagtctggtgaggtcaacattaccaccccaatgacacagatccggaagccgagttccagcaagattagtgactggctcaaggtcacatggtggcagagccagggctggaggccaggcccagggaacctgggagcaccaggccggccccttccctggcagggagcagggtacagggcagcccttcacagtggagccagcgcttcggagggctgtgtaagcgctggcatctcctgagctcctcactcctccagagcggctccagccccttcatccccagaggcagcctgattctctcctgtcccagccttccactgcattttgtagtagggtcagagacgggtggctcccatcaagggatcctgagtgccaggaagagggccatccgcgtcggagcacggtctccgcagtgcccagcacagagccctgtgctggggaaactccactgacatttgctggccccactggggtcaccctttgattccgatgaggaccatgggctgaaggatggtggatgatcatggtttggaggagaggcccagaaatctgaagtaccttgcctaggacacagggcctttcccatgcttgtgcttggggacacgttgagagtctcaggcctctgctgctccctggacaagccacagaagggacaggaggtgaggcgactgtcctctgaggaatccctgtttcccttaccccaggaggagctgggcccaccagctctggaggctgagagaggcccagggcctctggacacatcaagacgtgagctgtctgtgtacacagcaaacacagaaggggtagttggataacgggggcgtgggaacctagcacaaagggtcctctctgcctggtggccagagaagcccgcccttctatgcaggctctgtgctcggggctctgggctggagaagttcagagctgaacagtcacagctccgggcccgtcctgactccactggctcagccttccagcctcagcctgcatgggaacttccctccccttctcaggggatcgccccgtcagcccttctcctagtccactccggcttctgtgaaagctccaggagggacaggaagccccagtgggggccggtaagaagccaagaagcaaaccttcagaacagctgccttgccctccctgcccggccttggaggcctgctcccacactaacagcacagcagtgccatttcctgaggaacaagcaacctcccagggcttccgagaagccatcactgaccccaggggcagcgagccccggactccaccgagatcctggctcaggaacagagtctgcctcaggcaaccctgcctggccctgggctcttgagccgggaggaagcaggcatgaatgggatggatggagaagacgaccccccagccgcccaccccacaccctttcattagtgcccatgggcctccttggggtgggcctggccacagggcaaaacggaggcggctcagggctttccaccaagtgggggtgggtgcaaccacttgtggaggaggggaattgcatctccacgcggtgagtgggggacttgcagcaggaagagcagggctcagaggtggccagccttcacccttctttcttcaaggcagcctccccgaccaggatggaggagctcgggctccatgagctagctgagggcctggaaaaagagccacgtggagccctggggacagcctggatacctggggcctcagccttcccagtgactgtggaaagtgcctgagagcagagggtggagcaggaagccccttctctcagggtggcttcaggtgcaaacgtgagagctcggaggatctgggaactgaccgctctccagcacggacatttactgggccttggacaggggtttgaagccttgactgcatgctcctctgcagaggttttaaaacctcactgcgggccacaccctgagcagccaagtcccagtctctggaggggaccccaggcatcaggactttggggagctccccagggggtcccatggcaggaccagctttctgggctctggactctgggctgaggggcaggagcctctgcttgctctgagcacagtgcagccaccaaggccttcccgagaatccaagacccagaggacgggcccttcctccttgtggctggagtgttgtgttactggaatatcggattagaggcagcgaggacgagggaggagggagtggggcgtgttgtgggagtgctcaggcacacgcacagccacgcacatacatccaccctcagaatggggcctgattacatcttcccaaataagtggttatcatgctgggtattcatgtagccaggcattattgattggtcttcgcttcactgcacaccagatgggggtgggggctgggggggggtgggggttggtgaggatggaggatgtttgggggccagcaggctgaagagaaatcagcagtcgctcttggcagctgtgtctggcgtggaagggggctcctcattacctccccattcagactcggccaggctgggccaggcagtggcgaggggaggaagtttcagagtggtccccgcttggagatgtattattcatcaccccctcgcaggattggttattatcctcaaccactatagagtttgggcttctaatttttaatcacaaggaaggtggaggcgttagccttttcgtgattaatccggagataaaaatagttgactgttttggtgttgtgcttgttgtcagtcaggaaaaaaatggcattaactgttggggcactgaagcctggggaggactgagcggatcccaggcagagtgggtccccagagctggaagccagcctaagaggccacagcgcggccttagccgggggtggctgagcgacactcctgcacccagctggctcctggggcattgattatgaaagaaacacatcatcgcgggatgctgagctctttacagtttactctcccattggccaggactggagcaggcagcttcagtctccctccctgctctgcccctacctgcccagctctgcagactttgccttgtttgggtgggcggtgggggtacccgtccctttccctgtgtgtgggagggagcccccaaaagctttccccaagttctgctgccaaagacaatggggtctcgggtggacaggtggcatggggagagggaaattgaggccagagagcacaagaggctgacccaaagttaccagtgacgagagcaaagaagggtgagggtgggcttgggacgcacatcctggctgtaactggagaggtaaagctttcatctatttcacgcactaaggttctctctaacctctatactcccctttttttagagacagtttgccaggttggccagcctcgtctgagcaggctggaaaaactctcttggtgccaggacaaggacagcactgagggaatttcctccagtgtccacttggtcacccaactgagacctggctgggcttccaggaattcctcgatgctccatcagcctgggatggttggtctctgagcatggctgatcggtggcagctggaggggtgggggaccagcagcaccaccctcctgcccccatactgcatggtggagaacctcatagacacccagccctttggagagcaagactggttctcatttgactcaatgagcagcgagttccccacaatgctggcagagtgggtctatcaccaacaccaaaccctccaggggcttcccgctgaaggagagtaggtgttgcctgcaagcaccagcacttacggccctcgctgcccctggggcctcggtctgttccaaccactccttacacagcagaccctggccccactgcgtctctgctgctcagcaaacccagctccttccggggccgggcttgccctgctcctctctgtctgtaacgctctttcctgttcctcactctgctggctcttcccgtcaatgaaggtgcagcttcaagagcccttcagtgactctccactacccacccctgcactttctggatcactgggttcatttattatctgtcaccgttctagaaaggacaacaaagaccttatctatcttggtcattgtgatattgctgtatcacacagtaggcgctaaagaaatatttgttgaatatattatttgttaaataaaagaatctcagaaggggagtggggatggggccggggggacggttatcatgggctttggcttctgaggtcagcgttttaaatcttgtgtgtgtgtatgtgtgtgtgtatatatgtgtgtacatgtgtgtatatgtgtgtatgtgtatatatgtgtgtacacgtgtgtatgtgtatatgtatatgcatgtatatgtgtgtatgtgtgtatgcgtgtgtatgtgtgtatgtatgtgtatatgtatatatgtatgtgtatgtatgtgcatgtagatgtacatgtgtgtatacatgtgtatgggtgtgtgtatacatgtgtatgtaagtgtgtgtgtgtatatgtgtgtgtatatgtgtgtttgtgtgtgtgcatgcatgtgtgtgtgcattgggtacagttgggaacgggctgcgtgagtagtgggagggaggagggcaaagcaggagcccttctgaggccagctgggacagcgctgtaggaactctgcgctgctgtggcatcagggttggtgctccctgtctctcctcgagagagggaagcctggctgaggggggcttggtgctgggagctgattctcagcctgtttctccgtggctgctgtcctctgatttgtctggaacataggatgggagagggcggcaggccgagcatggtgacagatcagagacacttggctgagtggggagaaggacgtttgtgggttctttgattttgttctgccgcagacccaggggctctgggagagtcagtgctaggagttccagcactgactacagtggagggaggatgccgaagcctcggggtgcatctcccacaccttcagcatcttctccatccccaggttccccgctgcagccctgcagtcagcctgccatgtgtcctgccctcctgcctccctccctcccaacctttctctcaccagcctcctccatgtcacaagctgaggctatgatagctgagtgaagccatacacggcctgccatcttagagctgatggggaggcccttgccactccaggccagtgcccaagacggacatgtgtgcagccttggcacctcctgggagcttgttagaaaagcagactcttgtgctccacctcagacctcctaagtcaaaatctgcctttgaaaagaccccagacaattcacatacattttcaagctggaggagcgctgctctaagggttccgaggtagaaatcatgacaaactgacaagtgctatgaagggaaggctcactggacaaagagcacgtgtggggacccttgatcccttcacaggctgcctgctcccttcgctcccccggggccggccagagaaaggggcagactgctccctgcttactagctttggagttacacgatcttgtttcagaacagcttcctttgtgtatgccgtttctttagcttggaatgctggcgttctcctggaccactggtcttctcctgggtcactcttacacaccctttgagacttagttcagagggcaccctctctgagcggcctttctagaatctgccagttgggccaagtgtatagggcttctgtctatgatcccacagcatcctgggcatcccctgactcactagctaccacatcctatggaaatctctctgtgtgtgtctcttccctgaaccatgatctccatccggatccccatctcccagcagagtgcctgcctgctgcacagggcacagggtggcatatgcatttgctgagctgaacttgacttgagtcgatcactttatgagccatatgattgtagacaagttatataatccgacaaccttaatcctcttatctgggaagtgagataataaaaatacctatcttgcagggttatcatgaggattaccttacaatatgaaagatacacagagaacattgtaaaaggctatacaaatgtaggttattatgtctaatttttaggaataatatttaggtttgtggctgtgtgaaaagtgctgagccaaggtcctctcattttattctcaatatcttttgaggcagggactattagggtcttcattttataggttaagaagctgagactcagagagggcaaattacttggcaaagaccacacagccataagtggtgaagttggaatttagactcgagattttgaccctacaacatgttctgttggagttagagcagctcccagactatccctgcagctgcagcagcccttccactaacccctgcctttgtcctggccctagagctctgcgaagcgggctctctgcctgtcccagggggcattcagacctggcaggtactctcctcccttccctccccgcagtctgaatttcagagggccccaggaagcatgagcctggctcgcagttggtgctttggcgatgtctgctaagggaacggacgaatgttgtttgtagtccgcccagctctttgctgccttttgtggttttgcccggttctctggttctgggccgcgtgtaatcccagcttccggtttcctcacgtatacagatgcgccacctaatggccacaatggagaactgcaggatgtagagacaagagggagctgacctggttttaagagtcagcttcccagtggtagccgaacaatgtttggagaaattcgtattgagcacctactatacgccaggccctttctaaacactagggacaagaagcttctgccctagtggagtttaccttctagtgggagagacagacaataaatgaatacacaaatacatacataatacaaggttaggtgttgataagtactagaaggaaagtaacactgggcagggaatagatacatcctaaattggcctccgggattccctcctggcttttctccttcctctctggttgttactttttgttttcttcccaccccttaaatgctggtcttccctagttagctcttgctggccatatctcatttgacacactatctaatggaaaaccttcacttttctgtgaactcaactcacatctttaagctgacgaattccaaagaagcatctcaggccagacctctctcttgagctccagagtcatgacccaactgtccacgggccttcgaagctcagcaggtgtgacaccacacccaccgcctctcccagacacccatccatccccatattctgtattttggagaatggccccactgtttggggaccaagtcagaaatctgggggtctttctggattccactctcagtcaccctgtcttgccaactagcctggttaaccctctgaagtatcgctcagatttgtctctttccattcccacaggcttcctggatcagccatcatccttttgtgcttggattacaatagtgcttctcccctccatctcctagtcctctgtgcttttccagagtgactgttacagaagtctgaatattcacctatccagtcaaccagtaattcacccaccatgtgctgaatgtctagcattcctctgtttcaaatcctctgaaagtccctcattgccatctaaatagtctgaacttcttggccactgctgactcttcggccttgcttttcatcacttcttacctcaattcctccttgtggataagagccacctgcatttgttggagtaaatcgcttttccccaattgcccctttccattttttatttatttatcttttttgagacagagtttcactcttgttgcccaggctggagtgcaatggcatgatctcggctcactgcaacctctgcctcctgggttcaagtgattctcctgcctcagcctcctgagtagctgggattacaagtgcccaccatcatgcctggctaatttttgtatttttagtagagatggagtttcaccatgttggctaggctggtctcgaactcctgacctcaggtgatccacctgccttggtctcccaaaatgctgggattacaggcatgaaccaccgtgccgggcctgcccctttccttttgctttgctaacttgaaggtcgggcagcttgggtttgaatcctgggtgctatgtttactggcttgtggccatgggaaaactgcttagcttctctgtgcctcagtgtccttatttgtaaaatatgaattaaaataacaaaaccagattcactgtatagttgccagggtcaaggaagatgtaacatgagaaaatgctttgtaaagggtctgatggatgatgtggcatgttattggttctctaagcagactgggctcattcctttgaaaggcgatagacgggcaggggagctgggacttagaagtcccagattgcccccttggtaaagcagaggtctatgtccttttccctgctttgccctgctgggagctgggtgaagaccctgctgctcccatgggtgattccacgctgccctgcctggcttggcatcccctccctctgggcccccccacattctgtgccaactgaggcacacactgcttatgggctgcaaaggcacatgtgagccccatgtggagcagagagatgagccatctcagctgagctcagcccagattgctgactcacagttttggagtggtttattatgcagtatctgcattcagaacacaatactccaagatatcgcatcttagaagttgagaaaacagcagaagcaaaaagtttactctccaatcccctgccttcctgggcgagagctagctgtaaaaaattctttgacccatctcccctgaaactaggtcatgagatcctcattccagagggatcctgccctatactcagaggaaagaaacggtgtacaggaactcaaagaggaatgcaggcaaggccttgctaagttcttctggtttgttaccatgaggtcatacccccttttttgtccaatcacatttctgcacaactgcccattctttgttgaacataagcctacaaatacacaattttcccatggcatttgggccttcatttctgaaagctcacataaaactttggttaaatacatctgttgcacttttctcttcttaatctatcgtttgttacacgggtgtcagctgcaaaccttgtaatggatgaggaaaatatattactttttctcccctgcagcagcaaaagctaactgatgtaacccagtagtcccctgctgtttgattcagaactgggcccacggcatcaactgtctctccacttccctccgatccattctccctccactatggccaggtgactgttctggaagctcggtctgctgctcacaatgttcaatggttcccactgctccagcacaaaaatcaattcctcatcatgggggccttccccggttctctccagtgaggtctcatctctgcagctttctcctgtgtgaccattaactcttctgtgaggatagcctgcccttttacaaatacacgctttggcttgtgaagttccctttgctgggaatctccttgcctgagtcttaactggctggaatcccagcctcttttcaatcagctcaaaggcctatcatgccttgttaactcttggttattctttaagactcaggctattgtcacctcctccacaaagtcttctctcaatctcaacccctgactctcccacctgcagcctctgcactgccataagaccatgtgcccgcctcagcaggtacatgtggtgcctggcgccattaccacctgttgttcccctgaggctgtgagctccttgagggctggtccttgccaaattctctctctagtacttagtacagtgcctggcatagtgagcacttaataaatacttgttgcctggtgccttgcctgatcccactgaattagaagccccctccccacctgagcacctcttacactggtcctcaccacatctctattgcattgacttgtggacctgtttcaggttccctacagttgcagggtaggagtcctggcgcctctttgcctgtctcccattgcctagtatgttaccttggatgcagtcataaaaaaacagcaccaataatatgaataatagctaacattgatatagggcttaccacacagcaagaactcttctgtgtactttacaaatatcctttaatcctcacagctctatataaggtagatacaatgacgatgcatattttggaggtgaggaaacagccacaaagtagtcaagttacttgcccaacatcacatagctagtaagcagcagagctgggatatgggtagggtttccagacttaacaaatcaaagaacagtaggccctgttaaatgtaaatttcagataaattaaaaaatggtagtgtaagtatgtttatctgaaattcacatttaacagggaatcctgtattttatctggcaatcctgtagatgtgttaattacatatatgtgatttaattaatgtaggtgtgctttccccctcttcagaccctccccgcctccacttaggtctatattaagaagatgtggggcaagatgcaaatgggatttttttttttttttttctgagacggagtctcgctcttgtcacccaggctggagtgcaatggcacaatgtaggctcactgcagcctccgcctcccaggttcaagcgattctcctgcctcagccttttaaatagctgggattacaggcacctgccaccacgcctggctgatattttttggtacttttggtggagacggggtttcgtcatgttggccaggctggtctcaaacgcctgacctcaggtgatccgcccaccttagcctccaaagtgctgggattacagctgtgagccactgcgcccggccacaagtgggattgttaaaggatgtggcatccgatatatttggcagcacaatcgcacagacgtgtctccaaggaggttggggacagagagaaaagaggaacaaggagcaagacgcaggtttaggatgatggcatgtagctcagaggaaggtgtgctggaggctgtttcagttctgctcctaacctgggggtggggggaaccctgaactagctgacttcagaggtcccctgcaaaggtttgggacactgggaagcccacttctcagctggagctcatattgtttaggggataagaagggaggccctgaagtcagagtgcctggctgggcttctggctccgtcattcactggccacgtgaccatgtgcaaattctctgtgctggatgatgttaatgtcatagatattatagtagctgttgtacagggctggtgtgctgtttaaatgagttcatgtaagagttatgcagtgtcttgtcccagagcttggcactgtagtaagaacccactaaattttagctcttagtattattgttgtttatttaataagtaactccacatgggggcagagtagcatattgcatgtgaaatgggcttgtttccacctcttgttctgctattaccttgttccatgcccagccctggactcctgagatggaatggtcagtaccttgcctcaaagcacctttaaaccactagagcgatgacaaggaggtcacagacccaaagatcccacagctgtacaggtctgatgggcagccctgctgcctttaggcaggagaccccaagggagggagggctagtccagtgggccagggaaagggagccaggtgctgtcagggtcaaagtcagcagtggcttggttcgctccttaaattaggaagggtgaatgtcctgtttatatttggttaaaccctgaaagagggtctgagcatctcagggcagagctacttgtgaggagacagacgtttcattaataatgagtagggatgtaagtctcaggctgtatgcagagtggaggaagggaggtgggtagagaagggagctgcagtgatttgcactcaagcagaccagtgtgcctgtgccggctccagatgacagagggtgctacgtggccgccgtctgcacagcaagggtgagagggcttgggagaggccagcagagaagggacagtggggtgggggagtgcatcaaactggagagaggaaggggtgagtagggctggggcaggaaggccagtgtgtggtgctgggtggcttacactcaccctcccagtcctgcggagcgagagactttctcctttctccagcccagctcctatgctgatggctgcaggatgggtgagagcgcttcttaggtgtgtttgcaggaataaccggcacatgcccccttgcagccgctcacaaagctctccagctggtttcgaccttaacctgatttggggtctcttttgctcaacacagctgggttggtgggaaaagcccatcatggtggctgccgtggacttgtataatccatgcttcatggtatggtgggcccttgcagtagccttatttcataggtgggtaaactgaggcataggctggccaaaacatttggggcaagtcacgcaactggcaaggactctggctcagatcctgctgccccaaccactcagtcctaactgcggtaccataggctgtgctagcaggaggatctgcattggttcacttcggtagctttaatagcatcaaggcagccatcctgacccagcaaagggccaggcagggacttggagtgtccccgctggtcccataaatagaagcagaactgatatagttggttttgctatgggctccccatccggtaaatccacctcctcaacgagcctcatagtttcagtaaggacgaaaatgaggccaggtagaaatcctgcctaccgataccctggagcctcagaagtcttagcagaaatggaggggcgcaggaagatggtcattacattaaggggtttaaaaaataagcacaagacattccagtagctttcttttgagatgacagattaggaatactgtgttttgcaggataaaagcatgcatttgttccatatcttggttggttacaggccagcagggcaggcaggaggagggaatagagaggtgaccatgagacagaagggcaaaaattaaaaagacaggcaaagaggcaaagacacagggcggggcgtggggtgcaagtcacctgctcaggaagaagatggatgtggggagacacacacagtcctttgggatggagcaccataaaaccaaatggcagtgttccaaggaaggaaacaagcaaaacactttctctaggcctcttgctacaaacactcatttcagggaatcccagaaaatcactaaaatatacctttcaactttatgcaaatttaccagatccactgtttgccagaatcctaagaggaaaaagtcaaaatccttttccgacctgagccttcttctttttttgttttttctcaaaaagtacaagcttctacatttgaaaaagggcaatatttttagaactcattagatgaaagtgttttaattctcatctacagtctggccttatagttattttttgaaatctcctctgttcctcatttttcacatttgccccattctggggagggaggcctggcctttttaccctgtggggacagtcactggaagtgagcttcctgtctttagccacagacaactccagagtggaactcagcagggagttggccgccccgcactccagcatgagtccttctgtcctgtcctgaaaggggtaaagagaaacttggtagcaccgcagcttccactacggggtgccgctcacagaaggcggaggtggagggagggaatggcctcttcccccagggtgtcttctttcgctccatcactgttgaggtgggatggggctggttttggcactagagtgcttacgatcagaataagccccttattcagaataagaagagcttggttactgggtaaggaggggactgtgggcctcctatgttcatctgagacctattcaccggggcagggagggactcctcatctggctctgattatccctacaattaagtttgctggtgttggtggggatggctttggggccacccaggcccctgcatctccagcccttggtgggtgatgtcaggcaggtgaagaaagggcacagcctttgctctcagacagagctgggaatgatcccacagggtgaccctgaacaagtttatcaaccttcctgagcctcagtttcctcacctgtaaagtggagctaatatgtgcctcgagtaatgcaggattaaaggagaagatgtagtaggtccgcagtcgtggaggcagcctgctggtcagcatgaagacaaaggctgctgctgaagacccactgccttctcttgtgtgaagatgagctgctcccctggttaaggcagagtggcaaggaagctcagaccaaatgcatttgtgcagtggaagagaagcaacatggaaggagccgcggcttccagtgacctggcctgtggcccagggagctgcagatggaggctccgtgagctggagcccacaccctcccaccacccatgagccacacagggaaagcctgctaggtgactgctctcctctggcctctccctgctcctacctgttccccacaggggatccccccaaaatgacgatctaatcaagttgtccctctgcttatggtgtccaaagccccacagcacccaggcctggccacctttgcagccttaccccgtgcccgtctccagccaggaagacgggatccttgccgcaggccacagccacatagccacgggcctcggaccctggatctgtggctctctcctccgagactgcgcttcctttcctttcctgacttgtggacacctacacgatgttcagtgtttgctcaaatgtgccctctgacctccactagactgcgcttaggcatctggagcgcagcagtcagtctcatcctggggtgcatcccagggctcagcctgggacctcagcatggggctgagcaggacggaagctgtagatggatgcgctgcgtttgcggtggagagccggctgcatgggaatcactgctggctggacccgggtgcctggctcgatgggagcttcctaagggaagcagccctgtcatgttcctctttgtctctctctcctgccccagctcagcctgcacggagcaggtgctcaacagatgagcaccccatcaatgatggaagggtaagaagagacgcctgcatcaggtgggagttaggtggggaaaacaaagcttccagaggggatactttgggaggcgcagatctaggacacattgataagcatggagtgtcaactatgttccaaaagcttcctgatggccctattgttactccatcttggattcctgggtcaattttgggagatgctgagatctgtagtccataagggcattgctggatgcagatgtgtgaatcaccataagtttggacccaggacagctggtgtcccctggctttcctgagaccttggacgtgccccttcccctctgcattccccactctccaccttccaccacccctttctcaggggcccatcagctaggcctagcagcccttggatccttaatcacctctgttcttttgctggctctctctgaggcttccctttcagctttgatgagcaactcacttgccatggaaagtgtgttgttcatggcggatcctctatcaaaaaacaggatggtgtcgagttgcagtgggtgcgctgggatcagtccgggttaaaatacgtgggtctcagctcagatctccatccctggcactgtgcaggaatctgggcgtgttagtgctgcatacgttggggaaaatgagacgtgttgcttggaagcagcccatgagctgcttcgaggagtgaacggggtgaggtgtccagtgttgctttgaagtgaaatgttttggatgtgccttaaagtcacagttagctcccatgatgggcattcgtgtttgtggccagaggcatacataatccaaatctggtgtataattgagaatattatttgcatttggctttggaatgcattgtgtgtgtgtgtgtgtgtgtgtgtgtgtggcgggggcgggggaggcaaggcagctttactttctgtgtatgtttattttagactcccattagcattaatttgcattcactggacacagccgctagggagaggtgagcagagctttctccccatgaagtattcttcagcctggccctgtccgtgagccaggttattggaaatagaccatgtaggcctgtgttccacgggtgctcagaaaagaccatgtaggcctgtgttccacgggtgctcagaaatcctgggggctgagatacaacctcagtgaacaagccactgggccagggatgcagagctgtgtttgtggtgagacctgggagcgactcctggactcccggttccaggctgcatggccttggatacgttaattagttatttgagcctgtgtcttcgtcataaaataagagggataataattctgtgaaggttaggagaagttccatgggatggcatttgtgacgtccccagaacagggctcagtgaatgctcattccttttcttgtctctcctccctcctcgtctcccaaagaatgggtctgccttcttcatctcttgcgagtctgggactccaagggccgagcagagccggcagtagcatttggagtcaaataggaagacgccactgcttccttctggagtgcaaggtcaggcagggatgctcatttgctcttaagggtgcagggggtccacaaatgcctgaggatccacagcccacctgcacgaggagggggcgtttggagggtggaggagagcctgttgtctctttggagaatggggcagggctctgtctggattttgggtccatcccgtagtggaaaggggtcctatgtgaacagaagggagggcttcagataatcctgaaaccggaatcccaaagacaagccctgagtctccaggccaccactttctacctgcgtggactctggcgagttgcacctccccgggcgtcagcgtctgcatctgaaagtgggcatggcggtgaaaccacctgagggtcaggaaggctgagtgaaggccagaagcctgtgagcctgaaactctgctcaggtgtccgaatgtaatgtgagcccaaggagggcgggcgcgtgctggctctgagcgggtgctttattgtgtgatgggtggggacacttgctctcagggggaaagaaagcgccctctcttcctgcagggctggctgagaactaattcaaggccatgtgactctggctaaagcctgcatcctggttctctgctcccatctgggccagactgttggactccagtgttgtctgtcccccgagtcgaggtctggggcaggtaaggaggccatatcaggaacacctgcccatgtctgtccccagagagaagacccaggagttcaagcatggtgcagagaagttgagcaacatgcccaaagcagccaagattaccgtttctttgtgctccccacacacagatttggatgtttttctttttttcttttttctttttttttatatttatacggagtcttgctctgtcacccaagctggagttcagtggcatgatctcggctcactgcaacctccacctcccaggttcaagcgattctcctgcctcagctgcctgagtagctgggactacaggcgcgcaccaccatgcctggctaatttttgtatttttagtagagatggggtttcaccatgttggccaggctggtctcgaactccagacctcaagtgatcctcccgcatcagcttcccaaagtgctaggattacaggtgtgagccaccacgcctgggagatttggagtattgatagagggatttcagaatctggacttttattgtctcacttcccttcagtgagccaaagggccccatccttgcttacctcagtttcctccgggcttataaaatggacaaaaggataagttgcagagggccaccgaggaactgggaggatgatctatagacagtctcctcttcactgaaaggggaagatgggctcaggctgcagcgtgagggagtgaggttagacatctggaagaactgttgttggagacacagctggggaagggaggtcaggcctctttttcccaagcctgttcccctacccccgatgagggatgaggtggatgtgacaaggtgacatgaccctaaggcagggggatggacctggtggctctgcaaagcccctctcagcccctgtccactcaagtacttcctcattagttttgctgaagttacttccctgctcccagttagcccctgtccgtccagttctgagaggtgtttctatctgtaggggccgaggggctaggggagcatggggctggagtgggaaggaggaggaggagggatgaggctgccaattgccaccgccacacagcaagcgtcacctcagctgttggaggggaacagccaccaggccatttttatgacttcctatcaaactttgataaattgactctgaaagggccttttcttccaagcagttcatgcctcagtgactgttaatggtgaaatatcaagatgctgagggggctctgagctggaccgtgcagggaggactggcttcttacctgccccgagacccagctctttcctcctcttggatgctctggagagggagggggcaggactagatagagacctccaggcagatggcaaggttggtctccagaaaagacagaccaggggatgagggtggaggaattaagttagacatgccgcagaacttcctggccgtgggctgagtgacccaaaaggccgtagaacagcctcggtgctgcggctaactgacagggggcaggaattggcactgcttgttgcacagcaatttccctgcagggattgacgtggagcgtcacaaagacagtgaggtaggcagtgaggtaggcagagtagcaacctgcctctatctcatggcctctcagggcaggcagcagccctcctggactcaggaggaaagggctcagtggggaccacaggcattgagcccaatgcctctcaggcatcatgcaatgagaattggagctgggctgggcgcggtggctcatgcctgtaatcctagcactttgggaggccgagacgggtggatcacgaggccaggagattgagaccatcctggctaacacggtgaaaccccatctctactaaagatacaaaaaattagccgggcacagtggctcacgcctgtaatcctagcactttgggaggctgaggcggatggatcacgaggtcaggagatcgagaccaccctggctaacacggtgaaaccccacctctactaaaaatacaaaaaactagccgggtgtggtggtgggtgcctgtagtcccagctacttgggaggctgaggcaggagaatggcgtgaacccaggaggcggagcttgcagtgagctgagatcgcgccaccgcactccagcctgggcgacagagcaagactctgtctcaaaaaaaaaaaaaaaaaaaaagagagaattggagctgaacctgaacttcaagtccagagaggtttccctacagcccccctcacccacagcagcctgcatcttctactctgcccccagctggccccgcctgggcaaacacatggtgacagggcagtcgctggcccagagctgcttcattcctacttctcccttccttcaaggctggttctgggtcccggaaccatcctttcctggttcaggctgggtgcaggccgtccagcaccacctctctgactcaaggctggaattagtggggaggtgagtgaggctcttgtctcgggcacaaactttaagggtgtactcaaaaccccagtaatggaaataaataatatcttaatgcaaattaaacaaatcagaatgaatgtaaaaatatccacgatgaggaaaatatcacaattttaagtaaagacaggattagggagctgcagttaattaagaattgtttaagatggtcacttggtcaagagaaatggtcaaaatgccaattctctcagtcgaaaatgagataagcaaagaagtagatgattactattactggtgagttattttccattacagccaggaaagtaaaatgaaatacattctgtttttgctgtaaataaaatatttaagtgtaacataatgttggggattttaatacacctgcttttaaatgtttcaatatttttccaactacttcaatgttctggaaaaaatttaccacttaaagaatactttaaaaatataaatgaggtgcacgttttccctcttgctgcagggtctattgtgacttggcttggtgctgttgctgatcctatctttgtctaatattttgatattttgcttatcatggattttttcacattcatttggatttttaaaaatattgctttaaaatattatttgtctagattattgattctttgggtaccctttacattttgtgcctgagaatgatgcctcactctgaacttagttttattctgttcccagagagggaagctgcctctctatcctgtccttggtggggataaaatggaaaaggatccctcctcgggccctgggacccacctggggcatgttcaggcctgaaactgttttggggcggtgagcgctaggacaggcgcaggctgccaaggaaagatggatgggctcccgaggcccacagacagagacgggcagccactaccgagctcatccatcgggacccctgtgggatgacactcaccttaatcaggccacaagggccccgggcctgagggatgcgggtggcgtgggacggggagaagcgggtgagcagacgctcctgtaggctctaagttggtgtctggagaggagtgagaggttcaaccagggtggctaggctgtgcactggccaattccagtgggcactgagcacttagctggcccctcttaggccctgacctccaggcaagtcccaaggtctgttgctcggaccctgggctgtgctgtgtgtggggaaggactagcaggaagggaggagacagatggaggaggacacttagggcagggcctgcaaactggctcttccttgcctttcaggaactcccagtggctttcccttgtttgcagagtgcagtgtgacccatcagcttgacttccgggccctctgtaccctggcccaagcctctcttgccctctgagccccagagatcctctacatgaacctccctctctgcgccctacctccagcaccctctgacctccctgcctgaccccaggtggttctgctttctccccaaagcctccctcgactgtctgtgttcctcgtctccgctcatccttgctggccgggtttctggttgtggctgttgtgtgtgtggacgtgttgctaggaatgagggcctgagttattgtttatacctggccttcctcctccgggtctagcgccaccccagcagcagatgcctcaggaaggaagcgaccctgttgtgtcctccctgctgtgacaccaggtataagcagaaacttatggtcacagtcaggaccatggaggaggaggggcactcagagattcacctgccctctctgagcccatgtgggcactccctgcccttctcaccgctctccttgtaaaaggcagtgctgtgcagcagcctgaggatcaggacactgggactctagtcctgacactcagcaaatggcaactgcatgctaccaggagctcaggccaaacaccttgggattgtccttgacttgccctttctctcgtatcctaattgctgtgggctccacctttgaaacatgcacagatcatcctttctcagtatctgcactgctactaccccagcgctccagcccctagctgtttgcatctgcatagcccaggcaacagacatgtgaccccagcccctcctatgtctgattgcagagatccagaaccattcagctaagccaggctcagtttcttgacctgcagaaactgtgagagctaagaaatgattcctgtaattttaagccactgagcttggaggtgatttgttatgcagaaattgacaaccagacagattttgcagaactagccagtcaactttcaaaggtactttgtgctcggaacattgagaggcactgtgctgtttgcaaaatgctttctatacacgttcatctttctctttaccagaaccctgaacactggtaaggcaggcattcttagtcctcactttatagatgaagaaactgagggtcagagaggctaagtgatttggacaagggtacacagctgaaaaatgaaagggccagtcttagggcctaggaattcccatgataagttcagtgccttccctgccaccccatggctgccatttcttctcactcccttcacaaatgagaacccaaggtgttggccaagtttggagggaggggtgggtgtgatggaggcaaagggaaggaagaccacatccacagggtcttgggaggtggggtggagggacattcctggagaaggaggctaagtctggggtaggtgtcaagagactgagggctactcttggcttcttgtatctgccaaaacccaaacagaagcgctcagaaatgttggagggcctgcgtgcgaactcaaggcctgaggctgtaggcagggagtcagggctggggaagctgggctcagccaggggactgagacataggtcacaaatctaggagacttctctctggggcctctggaagctggggccagttctccagtgcctcaatgtcccggaattgcttcttggaggccaatgagagtgggcagaactgagcaatggaggaggaggcccacccttgctgtagggaaatggccaaggaaatgcaccccagcctgggaatcctgtcagggagtggggtccagtgcttagccagagcagctgcatacaggaccacacgtgacacagaggcatgtgaggctctgcatgtgcctgggcttaaagcctgcttggctgtgtgtgtgtgtgtgtgtgtgacagagagagagcgagagagtgtgagagtgtgcatgtgtaagagagtgtgtgagagtgtgagtgtgtgtgagtgtgagtgtgtgagagtgagtgtgtgtgagacagtgtgagtgtgtgcgtgacagtgtgagtgtctgtgtgacagggtgtgtgtgtgagagagagagagagcgagagagagtaagacagagagagagagactcccttttccccaaaatgtcaccaaggggggtcattttctgtgtgcctgccatctctgttcccagtcaccagcatattgcaagtcaaagggaggcctttccggtaatttgagcatttccaacaaataactctggtctcccagtgcaccagcctacagtggccgcagggccacaacgcactcttcccagagctgctagagctcacctctgctcttcagctcagattctagttggcatctgttatcacagggaactctctctggatggagatgctcaagctcagagaagtgagcaaactctcttctggttgcacagcgggctctcagccttcccacttctggtaagctgcttgaactgagaagtcactgatttttctcaccagatgaagaagccacgccagtgcacatggatgcatgcctactaatgttcagccccacctccaggtgctctcttggggagggaggggcccctataccggtcctgggtgggagtttagtgtagctcctccttcagtcaccaagcactttctctgtgccaagcctgggcctgagcctggagattccaagaggattaagccatggtctctgatccccagagagtttgtgggcccccgtggaatacacacagccccttcctaaccttcctaggccctgcagataagtgagtcaggcatctggctcagtaaaaagtgtcttctccattttatggacaaggaagcagaggctcagagagggtaaatgacttgccccaaatcacacagccagtaagcctgcttagtagctctactgcatcacactggtctggaccaagctgattgagtgaaagggggcagagttggggtggccatcaaacccctaaaacccgaggaggggaagagaggggtagcacaaaagaggatttactttcttcccccaaaatgatgtcatcagctaagacaaaaagaaaaagaaaacgcccattttctcactccaagtttccccctcattaattttaatctaatttgctcataacattcctcagtaaacagcagcctctctttaataagccaggctcttccccccgaccctgcgattgtgttcctaatcagccagtgtatcaggaaagacctgctgctaattgtcgctaggcatcacactatcctgtctgtcaggtaaggggtggcagcgagagataattataatcagatctaattagtaattataaaagatcccgactagaaattgttttcagttaaatattcccagagaggtgctaatggtctccggggcatgccaagtgtcacagccaggaggggaaggggcccgtgacctggcaccctgtgacgacaagcagaggagactcagtgatgagaggaatggtgtgtccatggggacagagctggcctggcgtcccagtatcctgcttcctgggaggagcaccttcccttctgcacctaaggttgagtccccctcccacaggagcacctgcgtgggccctcagtaaatgccagttcttcacaggctcaggacctcgacgcacggaaacttctggatcattaaagaagctgtgtgggccaggtgcagtgggtccgcctgtaatcccagcactttgggaggtggaggcgggtggatcacctgaggtcatgagtttgagaccagcttgggcaacatggccagcatttaatgcaaaaattagccaggtgtggtggcacatgcctgtaatcccagctactcggaggcagaggcatgagaatcacctgaacctgggagacggaagttgcagtgagccgagattgtgccactgcaccccagcctggacaacagagcaagactccgtttcaaaaaaaaaaaaaaaagctgtgcgttgctcaggcagcatgggatatttctgctggaatcgtcattgcattgaatgggattaaaggctttacctaggagtcccctggctaacgaaaatccattgggtgactctccgccccactttagtgcctcctgcctcgggacttcccctttctttttcatcgttagtaagcatctgcaaactcccggttgccctacttactttctgttaacaggacctaactacccaacacttccctgccttcagattcacgccccataccctgcatggttctgttcctgggaccctcggatcaggcgatgagctctcttaaacacctaggacggctccacactgcccacagccaaattcagatgctccagcgtggctcaaagccctttccactgagccccaacctgttgactgggctgacatccgactacacttgctcaagcattgcacgccaaacatcccaaacgctcacgttagggagtgggggcagggtgggcgtctatctttctgtgcctttgattttgttgctatgattacgttttcattttccagctgctaaaatcctacccattctaccaagggagagttcggtagttactgaagtcttgttactgaagtcttgtgaagtcatcccagattttctgagttgaaatgaacacttcctcagtattgtgcttatatattcgagggcttcttttatcctgcctgggatggtagtgagttgtttatgtcttctccctcctttggcagtaaactccttgagggcacagagggcattttgctatttctgcatcttcccattgggtctgatacaatgcttttgcacatcgtaagcatttaataaagatgtgaaggataaacgagtgaatgtattaatgggaagcttctacccactgactgcactatgatttcaatgtaaatgcttctgggaagccgacctctagttccccaggtccagatccttgaacctgtctttattattagatgctgttgggttgtcggagtacgattaggtggaatttggccagtagttgcaggaatctcagcctccccaaagccacctgatgtgaggctagcgtgactgactgaggagctgtatttttagtcttatttaacttgaattaatttaaatttaaatagccactgtggctagtggcttggtgcatctcagctgagagaccttggagccaccactatgtagggcagcctggagagtccagactcaaagcctgcttggtgtctggtgagcctggctacaagcgactcacattaatttagttgaaaaacaggatgtggctggacacagtggctcatgcctgtaatcccagcacttcgggaggccgaggcgagtggatcacttgagatcaggaattcgagaccagcctgaccaacatggtgaaaccccgtctctacaaaaagtacaaaaattagctgggcgtggtggcgggcacctgtaatcccagctacttgggaggctgaggtaagataattgcttgaacccaggaggcagaggttgcagtgagctgagatcgcaccactgcactatagcctgggcaacagagtgagactttaactcaaaaaaaaaaaaaaagaaaaagaaaagaaaaacagtatatattttcactgcattcttatttttttcagtgctgataccagatcagcatactcataactctgttaaccagaatgggagactaagtggggaaatgccacgctctgaccatgtgaggagttcaagtataatttacttcattcacagcttcttgaatggctgctgctggtctgttgcatttgtccacctgtttgcatctgcatgcggatcccaaatgtcagcctttccccttctgacgccctccacccgctgccgagacatctccgtgtagctttcctggctctgcctctcccagcctcctcctctgggtttcatttccttgctgtgagccttgtgcgaggcaggatatctccagtgcaaggacactactggtggacagctggtccgtcccacacttttctctgcacgtctgaggagtccaggaggactggctgaggctgcaggcaggaagctcagttgggtgaacccaggcaaacccaggagtcagcctggctctggccctagcttgaacgcctcggttgtagttctaaagcctattcatttcctccatgttcacatctttaagaggggaagacggggctgcagagggagaggagccagcttggggcctggggtgcagtcttagagactaaggaggctcctctggggagcgagggtgcccaggtggggaaggcagagcgcaggtcgagcagattctaccgcagcccgtcctgggtcctgttgatgtgctacacattgcagggagcattttcatcccaggcggtgcgtgacaaagctaggatttgaacccaggctgttcaactccaagttctgggctctttaaaatagggcagttattagcagggaaggaacacactgcccactcatctatgacaaatcaattaatttgtccaaattccactcatgctttcaaactcacttaaaccctccttaaagcctacacttgccaactcgcctggccctgggcactgcttgcctctgcctgcctttgcctccttttcccgcttctgttcctagttcaacccccacccacattgtgagctccctgaaggcaggtccatgtctggggtgggccaggtgaggggtggaaaacatcgataccagtgacttacatgcacccaggtgccaaggtaagcacggacgagtggggactggtgggccacatcccgcccaagggagcagccattacataattgtttgcaagcaggcaaacaggcataaactgaccaggtctttgtaagagaagccagaaatcagaatttttttttaatataaaaccccccagaatcttaaacatggataatgaatgtaaaaaactctacagatactccggaagctaaccggatccatccatgtgcctgccctggcctccccttaattgtcagctgctgcatatgaatccaggttcagccattcaaaagttctctgcccacttgaaaagggtctcaccttgggcagatctcatgctgcctagcacaggggatgcatccactcaccgcactggaccagcacaccagctagggaagcacagtttgagagctcctgggacctgtcctggctgtgctgcccacagcccctcctccactcctcctggcaagaggaaacaggacagctcctcctgcccaggcacagtcagaagaagctgtcccttctgggcaggcacacctcagagggaaagcaattcaattaagccctggttcacagcgagtgctaaaaacctccctctggagaaccattttctgctatagatttttaagaccagcagctggagaatcactcttcctttttctcttttggtgctgtgtctctctagtcaataaataagtgggaaataaagtatttgcaagaaaatagaatgcagtcgaaaggtaaattgtggacttaaaagcccctaagagactggcgcagacttggaaatgtttcctagtttgacacctcttgcttctctaagcccagcttctggctctccgatttgcatctccaaaaggtgatctttaaaactgatttccttcagttgcatttcattggtgtagaaactaagcaggctgttgcattacagtaataacatcaacatttcacctgccttcgccttaattatttttctctcttgcgatggaatccatttaataagatttacaggtggcaaggaggtggggtgagctggtgtgcggctcagataatcggccaagctgatttctccctcattgggtgtcaccagtataaaaacatgaactaaaagctttgcagcgcttaagtaataataatgtcagcatttcacctgcctccccttgattatttttcctccctcgttcttgccacctgaacctgtttagataagattgccacacagatagaaaccaagggctctcattctcttagataagctgctgtttttctatggtttggtgtgaaaagggagtgttgctggcagaaaggctctgtctcagatcttcctggtggggggcgtccgagcctgtggatcctgggtggaccaaaggcagcaatggagtagggggcaggtggctgttaaggtggatgtgggcactcgggtaggtaccctggcctgggagcagaggaggaaccatctctaaacatctgctctctcccctagatgcccctaggggatccaggcagggacgaatgggtttcatttgttgagggggaggggttctgattatgcagcactaggcaagtctccagtgtggtataaaaaacatttgggtagccctagctttacaactagttagctgggtggccatggggaaggaacccaacccttctgagccatagtttcctaaaaacaaagaggtggtttgctgtggactgaatgtttgtgatggcctccggctgcagttaatatattgcaactctaacctccattgtgatgatgtgggaggtaattagggttagatactgggaggtaattaagctcatcagggtggaaccctcctgatggaattagtgcccttgaaagaggaagagagagaatctccctctccctctttccctccctctccttctctctctgtctctctctctccttccttccttccctctctctctttctccctttatctccctcttcctctttctccctctccctctttctcccatgctggaacccttaactcaaacttccaggctccagacacagtctggagaaataaatgcttgttgtttaagccacccagtctatagtatttgttatagcagcctgagctaagacattggtctggattatcttaaattttaaactttaaacttttggggacttactgaatgactcctttgagaatgtgaaaccactccccagaaatgtgcacatatattctgaatattgcgtccaagctttgtagggataaaaggccccacaccaaaaaccttggcatcatctgtgacccctctctttctctcatagtaactgtccactatctctgctgctgctattccagcctgagtccctcatctcttctctgtattactgcaagagcctcttaacagaggctcttgtcttcccttgtcctcttatggtctcttctcaacctagcagccagggtgagtcttttaaaatatcactcagatcccatcgatcctctattgagaacccttccatgagtgattttctcttcaaatagaaatttggctctaagatccacagctgacttcgtcacttctatgagtctttgtttacacaaagtcagcttctagaggaaaaatatgaattgacctatatcaagtaaagagattggactaataaaaatcttcccataaagaaagccctagacccagatggcatcattggtgaattctatcaaataatatcaatcctttgtgaaatcttctagaaaatagaggaggaataaacacttccctactcatcctacaaaaccagtgttacctgatactaaagccagacagacataataagaaaagagaactatagactattgtccatcatgaatttagataaaaaccctttaagatattagcaaactgaatccagcaacatataaaaaaagattatatgccatgaccacatgggatttttatcccaggaattcaaggttggcttaacatctgaaaatcaattactgtaatacactatattaatagagtaataaataaaactatattatcatctcaatagatgcagaaaaaaacatttcacaaaacccaacacgatgtgtagtaaaaactctcaacaaagtaggaacagatgaaaacttcctcaacctgatataggtcaccagtgaaacattttctgctaacattatactttaaaatagtgaaagattggatgctttcccctaagattggaaacaaagccagaatgtctgctctcaccatttctattcagcattgtactgtaagttctagccagtgcaataagacaaaaatgcattaggttggaaaagacaaagtaaaactatctttcttcacagacaaaatgctcctgtatgcagaaaatcttaaatttacaaataactattaggtttaaaaaatgtgtttatcagccaggcacagtggctcacacttgtaattccagcactctgggaggctgaggccggtggatcacttgaggccaggagttcgagaccagcctggccaacatggtgaaaccccatttctactaaaaatatgaaaaattagccaggcgtggtggtggatgcctgtaatcccagctactcaggaggctgaggcagaagaattgcttgaacccaggaggcagaagttgcagtgagctgagattgtgccattgcacttcagcctgggcaacaagagtgtaactccatctctttaaaaaaaaatgagtttagcaagatccaacagtcatacacaaaaattaattgtgtgtatatatagatacaccatctatatataatcttagcaatgaacaatccaaaaatgaaattaagaaaatttcattcacagtagcatcaaaaataataaaatgcttagggataaatttatcaaaggaagtacaagatgtacactgagaactagaaaacactgctgagaaaaattgaagacgtaaaaaaataaagaggcattccatgttcatggatgggaatactcaatattgttaaggtggcaattaattctaaattgatctatagctttcacgcaattcctatcaaaattccagcaaccatttttttgcagatgttgacagactagtcctaaaattcatatgaaaatgcaaaggacctaaaatagctggaaccattttgaaattcactgtgggaaaggatagtctttttaaacaaatgatgtcggaacaattggatatctgtatgcaaaaatgaatttagggccttcacaaatcactaaaacttaaaatgcaccaagattaaatataaaaactaaacttgtaaaacttatgggagaaaatacagtagtaaatctttgtgacctttgattaggcagagttcttagagacaatatcaaaaacacaatctataagaaaaaattatcaaactgaacttgattaaaattaaaagtttttgtgcttcataagacaccattaagtaaacgaaaaggcaaactacaaactgagagaaaatatttgcaagtcgtatatctggtaaaggacttgtatcctggctataaagaactcctataacatagtaagacaaatgattctatttaaaaataggcaaaatatttgaatagacattttaccaaagaagatacacaaatggataattatcacatcaaaacatgctcaacatccttattcattaggggaatgcaaattaaaaccataatggataccacttgaaacctgtaacagtgttggcaaggatgtagagaaactggaatgctcatttattgctggtgggaatggatacagccactttggaaaacagcatggcagtttcttaacaagttgagcataaactttccatattatgtagccattccactactaggaatctactcatgaaaagtgaaaacatatagccacacacagacttgtttgtgaatgttcatagcaacaattttttttttttgtttttggtatttttagtagagattggattttgccatgttggccaaactggtcttgaactcctggcctcaagtgatccacgtgtctcagcctcccagagtgctgggattacaggtgtaaaccaccacacctggccagcagcattctttataatagccccaaactggaaacaatccgactgtctgccgactggcgaatggataaacagaatgtggtatatccatataatggaatactattcagcaataaaaagaagtgaactacagatacatgctacaatacagacaaatctcaaacacatttttccaagagaaaggggctagacacacaaggccacatatgatatgattctactcataccatatatccagaaaagccaaatccaagaagcactgcattggttgcctgagactgggtgggagtgaggattgacaagggatcgttttagggtgatgaaaatgttctaatactggattgtgggggtggttgcacaactctataaatttattaaaaataattgagttgtacacttaaaatggatgaatttaatgataatgtagagtttacccaaataaagctgttaaaaaataaggggaaagaaaaaggccacttccccatgaggtctattccaacctctcaacacctcctttccctaggaaacccaacccctcacactctgctctactttttttgaatagcattgatcaccttctaatacactataaagttttcttgttatgtttttcgtctaactccctccgctacaatatggttcgcggaggtaggagtttcaagtctgttttcatcgctaatgtatattctcagggtctagaacagtacctggcatgtggaaggcacatatacagatgctgaaagatgaaatgaatgaagaattctggattaaagggctccttcatctctaaaattatctaatcaaaggtttttgagggtctttctggcatcttcttgtgtttcttagcagacctgttgcccaggccatgttggcattttgggctgaacctggacgtgagacggggaagtcccgggggaccctggctagggctcagcgttgtctggaagagtaagaggaccagctctcccttgcccatgcctcgtgctgcctctagctatttcctttgttgaccttagttgacgcatctttaaaatgagttctctccagcagcctagtgacttcgtttgtgtgcgacaaaggggaagggagcagtgggattgggggtagggcagagatagtccttcctggggggtggctgtgtggccatcagccttctcctccctttcttgcctgcaccactgaagctgctgggtgatctctcagctgctaacattgtttctgacatattttcacatgaaaacctcttcctttatataaacatttataaacacctggatcgacttgtgaaagtgtgacacattttttggaagccagttttttcgggttgtgggactcagctatttatttttgtgagatggaggcttctgggtgcctatgaacctcccccttggaaaaacctccttcacacggacagaacaatttagaggctcagagtgatggagaaagacgcggcaggtggccgcccagaggatgatactgaatgggatggcaaatgaatgctgcgggtctcggggctccccaggtccatctgaggaggaggggctgccaggaagggtttttggaagccttgggtttgctcttcgagccgactccccgattccatgagccctgggatggtggaagggttcaagcagggctcctggagttcccaggggctaggaagaaacctgtttcatagtgatgattttagggggagtcaggcagcagagagagtggagtttggaaaagaggaggggcataattgagcataaagggccagggtttcagagccagaagcgactgcattcagattctcgttctttacctttcttgtgtgtgaccttgggcaaggtaatgagcctctatgtctcagcttcctcgtccgtaaaaggggacacgggacctgcctggcagagctggtcagagggcagatgaaggcatgcgagtgggttcctcagcacagtgcctgtcatagagtggcagctcaccagcgtcacccttgcccttctctcttctctccactcgagcaactcacaagctgccctttctgtgcatagaaggtgtggctgaacttagatctcctcatccctgcctagtggggcacatgcagggtgcagctcccggagtctgggaccatcaggacctctgaatgggggctttgaagctgtgtccagtccctgtctttcctagtacctatcagaacttctcatgagtgaaagccagtctcctaggcatgagcatcttatctctgatgaaccccccagctttttgctctgacatcatgccaccgtttctcatcatttcatgggatataccttctgctcctgctggggaccctcactcacaagccctgttctgcctggactgattctcaccttgctctttcacccaggtgaactctcagtcttggaatgccctcacccctccttcatactcaatcacgtctctgccaccctccaagcttggcttcaggtggagttcctccaggaaggtagctgtgttgaacactcactgcctgaccttttcacgttctgtccaaactctgagacattattttagctggtatgtaggtcatgaggttgacattaggaagaacatatcaggttctccatcctcttttttcctttttttccccagccattctgtgtgtgttcataaatgtgacattcccatgatggacccagattttgccagcagtttgcagaatggtaaagttttgaattaaagtcaacagcttccaactatctgtcactttcctgccttgtggcatcctgccaccacagaggcaccaacatatctcagcactcaaattgggcccagcgtggtagctcacacttgtaatcccagcactttgggaggccaaggcgggggaatcacctgaggtcaggagttcaagaccagcctggccagcatggtgaaaccctgtctctactaaaaatacagaaaattagctgggcgtggtggtgcacatctgtaatcccaggagattcgcaggagaatcacttgaacctgggaggcagaggttgcagtgagccgagattgtgccactgcactccagcctggactggacaacagagcaagactccgtctcaaaaaaaaaaaaaaaaaaaaaaaaaaagaaaaaagaaaaaaagaaaaaaaagaaaacacacactgctcaaattgagaactttggatctgggctaatatttcacctggggctgaaattgtctgggcagagcctgcaacaaactgctctggggacagctggataggaaaggaacatccttaaatggttctggctctcttctctctgaatcttcccctctcttgggccagcccatgacttcactcagctccagaactggcagatttgctgccatcatctcatctctggagatgaatctatttccttcctatagaaacagcatgcaagaaaactcagcttctgcttgaatactcccagagacaggaagcttactacttaactgaactctgttagttttaattgttgagataagaaatgtcctccctgacgttgtttccttccttccttccttccttccttccttccttccttccttccttccttttttttgagataggggtctcactgttgaccagacactgcaccctttgcctcttgggtttaggcaatccacctgcctcagcctctcaaagtgctgggattacaggtgtgagccactgtgcccagctaccctggctctgtttccatcctccggagctccagagtaaatctattgtgcttctttagatatttgggagggaccctattcccctacatcttctctctagtgagctgaacctcctcatttttaaaaattgtgtacacagtatctctcttatgtcttttacaggcactgcgtccctgttagacttcagggactttgcactggccatggtgctgaccaatcacaggctgcccaggccaaggattgggtctggtgctgctggagatactgactgctcaactctctctctgctgttgctcctcttcatctactcccatctcccatggcctgagttaaatcatgacagttgtcctggtgcctccagggctagtgcacatagggaagtaaatggctgaaattgggaggagaggaacacacaagggccagtggctgggctccctggagatctgcagtgctgtgtgtgtgtgtgtgtgtgtgtgtgtgttggagcagaacagagagttgttggttgtgcctccatctctagagtctgcagggatgtcaccaggtatgccatgatgaggagtggtttcaagagctacacaggccaggcgcagtggctcacgcctgtagtcccagctacttgggaggctgaggcaagataattgcttgaacctgggaggcagaggttgcagtgagctgagatcacgccactgcactccaggttgggcgacagagggagactccatctcaaagaaaaaaaaaaaagagctatacaaagagtggaccccccaggctgcctggagaggcagtcggtcatgggtccccaaacacctctctccactggacctacaacacaggtcccctcacagcagcaagataacaaagctgtggccattcccactccaaaggcagcaatgcatctttcctctgcaggacactgaccatagctgttagtcttggctcccggctcatgggcattgcgtcttctgcttctgtggtgtcctatcctgccccgaaacagtgggggctcccttaggctctggcccctgccaatcttccaggacctctctttctctccaggcttggcctccgcgagtctgccttgggttgtgtgactttgtccctaaactccctctgaggatgacacccctccgtcaccccactggctgccggggggaaggcttccatttagtggcattttcctttctcatttcatgctgtaatggagattcattgccagttttaaatccataatttgctgtgaaacccttgttttgggcctgggctgaggtcggaacggagaagcggcgggttatttttagccctcagagggctccctgtgcagctgcagctcccctgggcttcccccagggcgggcctcagacagcgtcctgggtttgacacccaggatgcccaggaagctggagctgggacaggggtaaacacacacgtgggactggctggcctgcccctccctcagttggctctggctctgttcctcctccatttcatgagatgagggggaatcagtagagaaacagggcctcatgccgatgagtctgtgcttccattacccccctctttcctgggcctgacaaggagtgagggtcagtacttcaggcctccaagaatgtgtccatttcctaacagtgactgatcccctgaccggatgttcttgtgtctttctatcagggcgacactgatgatttggctctgaggtgtgtgtgttaagtacctgcgtgcaccagcgcatttgtccttgaggcgaagctgtccatgtgtgtatccttatgattggcacataaatggggaatcctgtcaatggccagtggccagcggggcttccagactgaggatcccagtagggcaccaggacagaggtgggctcttgctgtgcttttgcaggcttgtggggatgctgaaagagatacccaggcctgaggagcagccgtatgaggggtaagtgggtgaggggcctcctccaggcagctgccccccgcatgttataggaaggggcttagatttcacttgcagccctggagctgatgattccatgtcaaatggcagacacccgaggatcgaggtcctgacttttgcaaatctccacagtctgagctcactttttgctgagcagttgagcctgctcagcatctcccagggtcacgcttggttccagcagctgaagggtatattatccttgctctcaggaggaagggaagaggaactcagggaacaatgcctctcatgccccaaccccaaaccatgagcaaatgagagagaatcacagtcaacccgtgaagtgggtttaacacttcatctctcctgctactggctccaccatggagagggcgggccctgagagattaagcatcatcagcccctgtctcacagctggatggtggcaggactggggcaggagtgaatgcgtcccagctccccagtgagggccgtttgtcctgcttgggtctggagagtttccaatgccctggggatggtggtgacacactccagaacttcccagggctgccctgaagagcctgtctcttggtgatgggggtgcagccactggggccaggcaacagcaggaggctgaacccctaccataagcagtagaccatgagtgggctcctaagaacctccccagcttcccttgtcctggtgttgggagcaaaagatgctggggggtatgggggctggccctgggcatggtcatttgggaagctacccccagatttcagtggcgagtgggcacttggataggcagtgtcgagcttctgggcccctccagaaatcgctcatggtggcactggctggggtagggtggggctgtgcattccttgcatcaggtcttctccttcttggagaggctcctgcctgcccttctccacactcaggcagggaagggaaaagatgcgctgagtttgcctccatccctgagggatcctctcttcctccgggccttggaagtcgtttaatgcttgagtgtcctgcccccacctcatttcccaacatgagggacgaccccaggctgggggagagttttgacatccagccaggctgtgatgaggatgggagatggagtgggtaaagagacagaggccatgcctgcccatggtaacatgcagattatgggggcagggagattgtggggggcgaccttggagtgcagcaggagggcagggctggggcgacccgcacacctcaactcaatggctgcaagacctccagggagaccttctatctcatctggcccccaacagcaactactcagcgtggcattatggcattgaacccacagggtggacctcagggagctataatataacttagaggtgagagactatatgtcagcctcagatacccttcatggcccccagctctgctcactttatcacctgcccagcaggtgagctccgagttagatgggaggctaaggtggtgtcagtggccaaagggagaaagaggaggggaatctgcttctggcccaggggacatgggggtagtctgggctaccaggaagggagctgggagcgagctggtggcaggggtggggtgtgtgtagggggagcgagatgtacaatagctccgacacagctcccatgtggaacctcaggagataaggatgttttctgctcctgtcttccgtctctggctcgtttgctaccgctatttgggggtgattgcagggtaatgaatgttgcaggaaacagccacatagcacaaatgagatacggcactaagaccaggccagggcccaggcaaaacacgcttaataagcagataaggaaatcaattctgcctttcttcccaggtgtgcagcctgctgggaggggcctgcaggaatcatatcttcctgccttgcttgatacatgggaaagcttctctaggaagcaaagtctgatcccccgggatgcaggggttgcttgttggtgtctcataacattgtgcaataatagcaatgatgaaaacagttataatactagcagccaatgctgctatgccttgctgcataacaggcgctattctgagacatgttttacatatattatttcattaaatcctctcttcaaccccatgaaagcagttatgattatttccctcattttacacagaaagaaacaggcacagagtggttaaataacttgctcacggtcacaccagtggcaaaatgatacagctaggtttcaagtgcgggcaatctggcttccagaggccaggcgcttagccacattgcctctccaacacaacacaacacaacacaacacaacacaacacaacacaacacaacacaacaaaacacaattgtcatccgtgtttggggcttactatctgccagactctgttctctgtcgtcagattcagtgtaaactccccctaaattttccctaagccttgttatttcaattgccatgaggaacatttactgaacacccagtatgtgattctaggctgtgctaggcatgaaggatgaaagatgctcccaggagacccggtgggggaaacagacatgaaaacagttactctcaacatagcgtgtcgagacctgtaatcaaggtgcataaggaggctgggcgcgatggctcacgcctgtaatctcagcattttaggaggctgagttgggtggatcccttgagcccagaagttcaagacaagcattagcaacatggcaaaacccggtctctacaaaaacaaaacagaacaaaacaaaaaaacaaacaaacaaaaattagctgggtgaggtggtgcatgcctgtggtctcagctactcgggaggctgaggtgggaggatcgcttgagccagggaggtcgaggctgcagtgagccataatagtgccactgcacttcagtctggatgacagagcaagaccctgactcaaaaaaaagatgcctaaggaagtgaaaaggaccacagggggacagtcaggccatgtgggctccagagaaggcttcctggaggaggagttgtctgaggtgaatcttgacagctgaacacaagttagccaagggaagaaaggtaggaagggcactccaggaagaaacacagtgtgaatgagggcccagaggcttggtgagcggaaggagatgccagctgcttgttagtgcgggagcaggttggcggtgggtctgaggctggggacacagctgggggctggcctcggggggccttgtgtggcctggcagggagcttgggttttgttctgtggggacactttctcgcccctgaagaacccctcagactgtcacctactgatttgcctttttatgtcagggtgactatggatgggtttcttgcaaccagtttctggaagaatggtttagaagccagcaccctcgaggtctgttccagctctgccttcctttgctggcagactctgagttattcaccactgttctctggacccatctccccagaagattcatggatgggagattgggggaggctgccaacgcggtgggctgaggaggccctgcagctctgctggtagagctgtggcaaagggagcttgtggttttgaaaaacaaactagttaaggacacgtcacagattggaccttatctgttttcctctctcagtatttggggcttgacatcatttaaaaagatgccctctttatttgaattgacttagtctccctcttaaataattcatgttgatttaggaagctttatttctaacgggagccacaagacagcagagttaatattagaacgggccaggaagaagagggaaatgaggagggagactgggaaaaatgcccctcttaataattaatctgatgccaacatcccctcctcccacttctgatccccccatcctgctctactttttcctttccgtagcatttattaccacctcacatcctgtacagcaatgcaatttatggtttaatccgtgcatcacttatcgaccgccttctctctgccagaatgcaagctccaccagggcaaggatggttttctctttcgtttcctgatgaatcccacgtgtctagactagtgcttggcatataacaggtgctcagtaaacatttgttgatcaaatccttggtaccatttcctccctgccctggatgtcccaacaccttgcttcccaagtttccaggaagttgaagagatcaagtgtaatgccacccttacaactctgaccctgggacagtttcaatatttttcaaccctgggattcctgtaggtggaagaaggagcagtctgcatgtatatgtgtacacaactttaaaatacaggcggggtggctcacgcttgtaatcccagcactttgggaggccaagatgggtggatcacttgaggtcaagtgttcgagaccagcctgggcagcatggctaaaaatacaaaaattagccaggcgtggtggcacgtgcctgtaatcccagctactcaggaggctggagcaggaggacccagaaggcggaggttgcggtgagctgagatcgtgcctctgctctccagcctgggcgacagagccaggctccatctcaaaaaacaaaaaacaaaccaaaaaagtgtatgacacttcactgttagagattgagagagagagagagaaagagagagagagagagagagagagagagagagagacagagtgtttaatgtttacaacaattctatgacattggtatttttaaccctctattttatagatgaagaaccagaaacgtcattcattcattcattcacgctggttatagaggcttgagccaaagaggcccagttccagccttaaggaccttgcccaaggtcacccagttagtgagcagcaagagcatattctacttcctggcccagggctcttcctaccccatgacagctctctctgcacatgtgcatgggggtcctctgaagcccaaccaaactgagtcttcggagagggctaggtctatgtggaagctggctacagaggggtggttgggggggatcctttgcagggaggaccagggtttgaggtccacagccaaggccaggaccccagggctgaacaggacttggagaggtcctatctcccagcctcaaagtgggatgctgtttaagccaccctaatcagttttcttctaagcctcggtcactgcgccaatcttggttccagggagggatggcccaatttcctaaaatagttggtacagcatgttggactccttacagtggaagtcatggccttttgggagcgagacagttctcagcgatcatcttatttatcaccacctctcattttacagatgaggaaactgagacccaggttgagaaacagggccactgtcacacagctggacactggtaaaaccaagaccactgcctctaagtctaatgctgtttccgtgacgctgtgattctccagatgttctgcaggtgaaaagacgcctgtcttgaccctgggctgagtcaagccatagtccttggcagctggctgggccacagagggcacgcagcctgaccactgattgacctgacctaaaatccccagtctttgcctctctcagctttgcaaactcaggccttcccccgtctttccctcctcatttcctggctccctccttctgcctcccgaggtacaaatgctcagctccgaagttgctccttgcctgattgcatctgagagctggaaacacaacgctaattaatgtgtctgtgactctaggcttggctgccaggccgagtccccatgccttccctagggcccagcggctctgcgagctggccctctggcttcatctgagcacgctgccggcagatgcatattttaacaatgcacatctgttggctatataatctctcgtatttgccctcctcacttggtacttcgatggaagacccccgggggcctccctctgttctagccaaagtgtttgctttgcaattttgccggaataccatctgattctgctttcgcgtcttccgcaggttctaatcaggctcttactttatttaattaaaaatctatctcaggcaaatacagactaaattaggaagctctctcattcctggaacacagggaaggcagccccccttggggaactggctgggacattttcccgggctgagatgtcacagcaaagcagatggggtcttggtagggaaggcggctgggccaaggagcagaaatacctctctcccatctgtgggaacagccactctctccattccccttccccagaccaggggtccccttccagctggctgggtcagctgctgcactgggggcctccttgcagagcagtaggtggggtgctataccccaggacactcagccaggcggagccctgcaagaccagctgggttggggacctgggagtgtcccagggagtcagcgaggactgcaggcagagtgctgggaagcactgtcttgcctggggttttagtttgctcaggatgaatggttttggtggagctgcctgaaaggctgatggacaagatgctggctgaggctccctttctggctctcaggaatttcacggaggggaccctgctggggatcatggaaacttcctctgccctccttccgctgatctccagacttgaataaaacatctcccccatacaaacccagctctgtgcccagagggcggtgtcaggccatgccaccggagaggaagggggagcgaatgccttttagacatgacctaagacaaaatcgggtctgttcaggttggatcctgaggccctgctctgagaagcctggcccctcaccagccagacagatgagatgctgctggcatctgggaacaggagactaggcaaagagcttggagctgaaaaatctggagttgattttgaaggttaattaagctgtgtcacctcctgtgagtgcctttgcctctctgagtttccattctctcatctgtaaaacattcgaaataatctggacttttaatacgttggacttttttacgtaacgtagagttgagaggaaaggaagtgtaatgatcatgtcaggactggggaagtcaatacagccttaaggatgagatgtggctccacctatttttggttcctgtgaagtcagaggagtggacaatgctcaggttcctgtggttccagcatcctctggcccctctagaaggtgtatgagtcggtagaggcagattcttctgaggatggaggggctgagccatctctgaagatgaggagcctacaacttagcaaatctgttctggcattttgcaatcctcaaaatcagaaacaatatgaggccctaattcctcctcctctcctcccacaacccccacaccacatggcagactcattctcattttagtcaccgtcttgggagaaatgagaacggcgctgctgcctttaataccccaattactcctcggaaggcccgcttcccggccatggaatcccaacttatttacccccgctggaacaggtttattttctcattcctttcatcgcaggcctggggagactcaaaggttgcaggaggtttctgaggctggccccaagtccctcccccgcatctcaagaagtcaagctccgagcttggtaagtggtcctccggggcctgtctgctgcactgcttggaataatctgccctggtgtctttggccatgtagatctgaagataacctgacatgcttttaaatatttcatctctgagcagctgtgtgctttagctgccaggagaggaggcagcaccccagctgctgaccctgttgtcgaaccttcacaacagctgctaaggggtgggcctgggctttcccacttccctcctgcacgcgtgcctggcacagactcacgtgtaagggggcagcgaggtggggcaggtagccctggagccctggccaggagcccatgggccaagctctttgcatctgtgggccttagtatctcatctggggtaacagtccctgtcccaccgagcagcgtcaggaacagcggaggtcatgtgcctgaaagagcctagagagctacggtgaactgcttggcaaatgtgagctctcatgacttatgtgcaaggcctggttctcagcagccttgatcctcggtaacatttggccagaggagggagactcccgggactgaactctaaatcagaactaggcggtttaagaggtcaccgagcccattcccctgtcttcaggcaagatgatccaggaacgctgggctcctgggaacataagatgaagaaagatcaaggggaaaagtatgatttggaataaggacctgaaatgaattttcctaggagggacctgtcagccaggattcccagggagcaatgaggggtggagaagtcacgggggtcactggtgtccacatggatactagaatcatggggagaatcgggctgattctacagagaaggtggaaagatagggctttgttagcaccggagtgggggtcagttcagaaagaagggacccacagcctgtgccacattcttcctggcacggagcctagcctagataacgtgtgcagagcatgctttctgatggaataaataagcatgtaggagccctcattagctgcctaaggcaccatcaaacacgccggggttggactgagtccgctggcattggctgtctggtttactagggaaagagccttcgcttgtcccgtttgggtgggaaggtgggcatggatattgtggaagcagcagtgtctggagccctgtgggatgatccccagaggggagtctccccatgtctgaccaaaaaaataccctcttggagctgagcccttggtgcttcacgcagtgtcccagccccgtgtgcagatggttcttacccaggactgtgaggcgtgcggggcgggagcggatggcggcctggatggcctggcactcgtacaccgcatcgtcttgcagctctgccctcaggatcttcaggtggtgctcccctgacaggtggttccctaccaccaggtactgtgggtaacctgtggagacaacaggcaggtcagggagctggggtggggtggaggggacacccatgacaaagaggcacagaatggaggacccaagcaggggccattctacaaggctggcagagcgggtgattgctcagggctctgatctcagtgcaaggagcacaaatgcaagagctttcccaaggcattgaaggtgttggttctctctctctctctctgtatgtgtgtgtgtgtgtgtgtgtgtgtgtgtgtgtgtgtgtgtgtgtgtgtgtgtgtataagggcatttggtctgtttgttagtttttgagacagggtcttgctctgtcactcagattggagtgtagtggcaggatcatagctcactgcaggctccacttcccagactcaaacgatcctcccacctcagcctcccaagtagctgggactacagacatgcaccaccacgtcggctaatttttttatcttttgtagagatgggatctcactatgtcaccctgactggtcttgaactcctggacttaggcggttctccctcctcaacctcccaaagttctgggattataggcatgagccaccatgcccggccatgtaagggtcttgttggtttcaagtttaggaaaatcggaggagccactgttagaaaggaaagagggagaagagatggaaatgctaagcgtggacagacaccgctggcttattattctggaaagtggtgtgctcagcactgtggtctaccaagcagacatgcattttgataagatagagaggagagagagagagacagacagacagagagacccaggctgagaattacagagagaagacagtcagagagagaaggaaggaaaaagagaaatgtttggaaaaggatcaagagtgactttgcaaaaattttgtttcaggatggacaggaagtagaaatctaggcccgcccttccagtgtctaggaaccttgggtcactttgagtcacagtggaccctgtctagtcattcctcctgtcccgccagaagccccaggtcctggtgacgcacttatgaagtgctcaggacgcttaagaattgggggccccttgtaccatgggcaatgaataatagataaataaaagtttgagaatataaatcattaatcagcgttcctgctgctgtgtagggttgaatataaatgccaactgaagttgtggctggccaccttaggcagatcctctctttcctgggtctcgggccctacacctccctatttctctttccatccatctcctcactgaggtctgccctcccccgagtccctcagtgtgtggatttacaactggactccaatccccgctgtctttcatctctgtcccggttcccttctctcctcagaggctgccctcggcttccactcccctctggcagccccaggctgctcctccttttgaaggaccctcaccacacagggagtgttctcagacgggtgctgtaggaggatgagacgggacacattcagccttttaaagagaagatgagggcttaagcaagtgagagagacagaacaaagacaggcagggagacctgcaagagctcgcctcaagtatttcaaagaatctctcagtgtgggttgggcatgttcctgagctcccaagggcagcaccagcaccaacaggcagaattcacatggggaggttctttagaatattctcaactgtttgaggtatccaacaaggatctgggatgccagagagtgtagtgaggtccccatcactggctgtattcaagcagaggttggatgatcgcctctcagggatgttgcagaggtgatttctacaccgggtgaaagatcagactagaggagcttgaaggcccctctcaccaccataagtgaaggttcttctggaggtggggcaggcctccctgggggtgggctgtacaacgggccaccagcacttgttcctggtcaggcgaggtagctgtgatgatcctctgccagccttcctggcatgctctggagtgcttcctgtgcagctgggcccttcagactcatgtcttcatggctaccatcctcatcatgcaataaaatggccctgtcctccccagctgtgcaggcctggccagaaaagctcacaaggccatcagctgcacccctgagagcactgcctctcctcctgcccacacttcccgccttctgctgggctttgggaatgagcccaggtaagttaagctgtctccccccagggccaggagaggggctggaaatgggttctagcccaatcctctccctgctgccgctgccttccttgtagctggctggctacccccagcccctccagcccagcctctggatcccactatcctgtgattagtccctggtctcctgcaggcatcttggctggagcttctgtttctgttgtcttgcaagctatcagcagcaggattttgctctcacgagctgctgaaaacatcagtgatgggtttgtttgtatttgcctaattaggcagtgagctgtgatgctatcccaaggactggcagcatctttgaaaatcagactcagaagcatggattctgagaaagttctagctccttccacattatcattactctctcttgctactcccaaaggaggcaaaattacttagagtctgggttctatagtcgaattgcctgggttccaatgccagctggatcacttcctagctctgctgtcttgggtgagttactttaacttctttgtgcctcatagactacttactatgtgccagtccccattttatggggacaataccagtacctcataaggttatggtgaaggttaaataggataatctatgtaaagtgcctggcacattgtaagtagtctataaatgccaatttaaatgaagagaaaggtatgtcataaggtcaggtggccaaagaggtctttatctttagaagggagagaagacagagtatctggaccctttggggttaacaggcaggtctcatgtgctgggattggttatatagttgagtcaatttctttctcagttgtgactttgtttacctgtcaaacaaaggggaaaatccttcttttctccctccggatcgctgtagatttatgagataatgtctgcgaagtacctgagcttcttagaagaaaaatgtgctatcaatatgaagaagtgcatttataaatcattttctttgactggttattccagctttggtgactagaaaaacatttaggtcttcaaggagcgtatcatttctgggagattcgggggggccacatgggtacagtaggagaggacagagatgtagcaggctgaaatcccacaaccctgggcctcagtttccctgtaggagagctttcgcggtgttaagggctctacaagtacttgctgaattgagttgagggctgtcctgcctgtttccacatcaggcaagcgagcagagttaattgagcatgtaagtatctatcatgattgccatgatgctatttttgggacaagtgacaaaatacagggcaagtattttatcaggagtttgaggtcattggctctgtatggagaggcaaaccgagtcaagctggagaggacacaggccccagtttgtcagaggccattgttctgcagccctaagcaggtaccagtcctggatcccagaaagccattcatggcactggatgctagagggtcagttatccatgctgagatgaccaccgtatgcactatccctgctgacctgagcctccttttggccactgacccagcaagaccccagtccctgacggaagttggaaacccactgaccgggaccccagacagcctccttaactagcggcagcgctcatcccagctcggagccattcagtgcatgaactattctagtttgggaaggttgtatcattcctggagtttctctagggtaaaggcgttcggagtctctgaaattggctggttcccataacagttaaactttatggcagcacagtatattttggagatgtttttgtgtattttttccatgctcagctgggctgcagcgttcaaacctcgtgcctgctattgaccattgctataatgtttcaatatacatttttggcaagacataactcacatttaaaaatattaatttcccaaccatcatgttcctgagtgcacttcgatttttattttcctgcagctgtacaccatgcgagaggcaaagttacttctcagctgaataatatttttctctcctcctccacccttagctattcccaaatcacaggggaatgacacccagaggtccctgcttgtgaattttactgtgtacgccaagcctagcaaacaaccactgcctacctgtaggacagaataatgatagctgaagggtgtgtgaccagggggatgagccattctttttttttctccagggaagaggatggattggaaaagcgtctgtatggtcttatgggatcactattcacaatagttaacaaatgatctgttgtcagcactggccagtgagttcacgtgtcagccatcaacaaccatgggaactctcactgcctgtcccagggtagctttgctgaataccagcctgcccaagccgaacatagttggaaatttatttttaatacttcctgtcttttcttcccatctcatgatggctcctaagatcaactaggtgtctttgtgagttttcagtttacttggttccctttaatgggtgagaagcctggaagaaccaggttgtgacttgtatttccttaataattgtgccttaataaatgggggatacatcttgggccaagacacaggaacacttgatttctggaaactggaatttacatgaatcatgtttgactttggagtaggtgcttgagggcaatgtcgagttaggttaggacccaccgctagaaggagggtttgcttatggttcattatgcacatcaggggccctcagagtctagggatgctgggtgcagtgcttgcctagcctgactctgcctgaggagttgcagtgaaagctagagattcgatactcagacacctgtgaagatgggtgctccctaggaaggtggatgggtgagtaaggaagtgatggccccaggcccaccccaggaggtctggaggtactcacttgagaggtccctgcccacacccagagccaagccgtccttgatccacagaacgaagccatcgtattcggggatggcgcaaagtagcgtcactggctgtcccgacaccaccacctggtcctggggctgctggctgaaggaatagacttggcctgggaaggagacaaacacaatggtcagttatctgccggctacaggggcgagaaggctcccctccagctatggaagcagagcagggctggcgcaggagactgagcctcctgaagcacctggctttcctgctgagggtctggtagagcttcctaactggtctcagccccagctctattccctcctatgggggcctggctcccagctccagcccctctgcccatcagtccctaacacatggactggtctagccacaccccagctccctatgggccatctccctccacctttgggacgtgccacttcccatgcattggtgagctcctacttaatgccatgtgctgggcatgcagtcccacaccagggcagaaacaggagagagagagagagacctctagctagaaacattctgtggtggctgtgtgttaagaagggggtcgatggagagtggtgcggctttggttaaacctgagaattcaggaaatcattttgttgtttcagtggctcctggggtgggctgagggccaagttcagaggggtgggtggtggtgcagtatggcaggaggtgtgctgaggaggcgtgccatcctaccgtgtcctccctgtccctttcttttctgcagcagaccttactccagcctcacaatcacttgggaaaaaatcattatggacaccatgcctcctcaaaacgagatggccagaatcatcgaagagagtcagttgacattattttattaaacaaacccatccacaatgcttacaagatgccatgctctgttttgaggctttaaaatattagttcattaatattttcatcgtcataacaacctaaaaatagtaggcactatttttatccccattttccagatgggaaaatgaggcacagggaggtgaaaaatagtaatgggagctgtgcttgtgaattgctcaccaagtacggcgcatgccctgactctagttatcaccgtggcaacactcgaatggggcattgtcaaccccatttgacaggactttgggaaacggaggctcagggttaactgaattgcccagggaactgtctagtgggagttggggtgggtggtgcggtgaatccaagtctttctggctctgaagaccatgctctcccctactgagctatgctgtgtgcagatccccaagcctggccttggagggagttgctgatgaagaggtgtgatgtgatctgtgtctcctgggagtccacagttgagtggacaatggaacattgacattcgctgagcatctggcccacagtacaaccagtacttcatacaacccctcctgtaatccacttaattatacttcagggcagaaaaagccccactttacaacaaagaaaccaggatcagagaggcacagtaacctgcccaaggtcacgcagctaatgagtgttagagcaggggtttgagcaggggcccatctgcattccaagccctccctttttcctacctcctgctctacagacccagacctaaccgaggcaaaactggacctggcgctccagctgctgatgctgtggcctctcctccccaacccgggagagtcaggggcagccacagacgtcctggacactggctgctgcccatcttggggacaaaaagccccaggcttgggccacacctaggactgagctctcagcaacagatgaccccaagagggagacacttggtgtgtatcaacccaggggagcttggatggcagcagagcttggggtggaggctccccagaaggaggggtgcagattcacagtggagagctggggacaggcaggaaggtggccgagttcacaacctgacaagatcttggcagggtctccgaggagtctcattaaaaatcaaattggccttgaattgtgggagtaacactttttattctgatttgagctttacaaattagatttcataggacattttaatcagctatgtatggtaggttttttttttcctctctgtctcttcaagttctctgttgtaattagactgtttctggcaccaaaacagggtagaaaaggagggaagagatgagagaggagaaggggagaggagggagggactggagagagagcaaaggagtgaagtgaggacgtgggagagaagaggagagggagaggaagaggaggaagcaggggaggagggtgaggggcagcatggagagggagggggtgggtggaaaggactccttctctggctccttttactctaatgatgatttcacagctcatccttttatctcaaaatctttcttacaagaaggacagagtcaaggcagctgcagtaactgccaaagattgtgctatcagagagaattatcaggttgtcaggtggacgtggagggggttataatgagagccccttaaatgaagcagtgcccgagccctctgagatgtccattattaggaagcacccacagtgggtaaccgtcccggtctctccccgtcctgtgtcctcttggaggaaggcgcgggaggtactgggtgagggcccccggggaagtggggtgcaagaagcatccgagggccaagggtaagttgtggaccggctggagcccccagggagaggagggggctatcaccatggaaaccaggctctggaggaaggcaacgctgggaagggggatcagttgaagcaggccatggaggtggactctgagtggccacagacccttttggtgggtgtctcagagccaggggtggcagcaggcacaagatgcctggaataagacctggggtctgtaggaaaggagcctgatgggatggggctgagcgggagagggccttttgagggggagcatctcccgatgccatctgagcaggcttggaggtgtaggatcccacaggttgcagtgagccaagatcgccccactgcactacagactaggtgacagagtgagactcggtctcaaaaaaaaaaaaaaaagaccttcctagagcctctcgcattctgtctgcttgatccacttggcttttctatggaaagactgtttctggggaagatgagtacacaggaaaaatccacccaaaggacatgatttacaaattattatttttggggatgggagacagtactctaattgacaatgtcccttttcagtccaattttaatttttgcacattacatttgagtcactataattacttttctcttttaaaccaatgagttttttttttttttttcaaatgaatcttaaactgttactgagtatctagagtggataaaagttgaggtgctttggatgaaggtggagatggagggatggaacccacttttttttttcatccatctgacagaccttagggcctctcctttgggctcaagagcccctcagagcacagcttttgagccatggatgtaagttattgccagaagaatgctcctcacccacccactctttcttttcttttgagactgagtctcactctgtcgcccaggctggagttcagtggggcaatcttggctcactgcaacctttgcctcccggttcaagtgattctcctgcctcagcctcctgagcagctgggattacaggtatgcaccagcatgtccggctgattttcatatttttaatagagacagggtttcaccatgttggccaggctggtcttgaactcttgacctcaagtgatcctcccacctcagcctcctgaagtgctgggattacaggcatgagccaccatgcctggcctctacttgctttattttccccattttcttttctactccaaagaagtgaaatgcaagtgagcccaaggtcattttctgcagcctcctggatagtgccttaagtagacagtgagctcctgagaacctgtttcttccacacacacactgaccggaccctgctgtgaggcaggcactgtgctgtctggtgaggagcaggggaacaggcctggccacccctccaggagctcgcagctgtgccccctccccatcacacctgggcgtctcagatggagcacagagtaggtgcctcacaggctcaggtcctgctctcagtggagatgtgacacacccagcaccttccaccggcccagggtttccatcttctccgcttcgcattttccctgatgatgttcccctggtgtgaagccttggcggccggtgcaatctccccttcccatactttatttttatttttcttttttttttgagacggagtctgactttgttgcccaggctggagtgcagtggtgcgatctccgctcattgcaacctttgcctcccgggttcaagcgattcttctgcctcagcctcttgagtagctgggattacaggcactcaccaccatgtctggtaatttttgtatttttagtagagacagggtttcaccatattggccaggctggtctcgaactcctgacctcatgatccacctgcctcgacctcccaaagtgttgggattacgagcgtgagccaccatgcccggccccatgctttgttttgagtctgtcaccatcactgagcctagcccagcaggctgtacatctctcagacttcccctttcctctctattcccactgctagcacccaagttcaagctctcgttgcctcaacctgggctcttgccacagactctgaatgttctctttgcctgatccattaatgtgctgaacctggattttccgtcttaattcaccacttgcttcagggttcccctcttttaaggggtgggacctctcatggctctccactctctgcgggacaacgcccaacttcccatgctggattctaatctccaaaatccagctccttttcttcctgggagctccacagcacccccgtgctggctagtcactaaggtcacctgcctcgagttctcctcgatgtttcattgtcctgggatgcactgcatccccccacccaaggctcccccacccaaggccccccctaagcaaccccacctatcattgaaggcccagttctctccccaggcagctcctgtgacccagatggaatcttcttttttctcgtcttctctctatattctcatcttgcctctttttcatcaatttctccaaacctttattgagcacctactatatgtcagatgctgatgaaacagaaataaggaagaaacagtgtacacttcttgagggcaggggccacagctatcttttctgtcttgtgttcccagctgtgggtgagcaccggttacacgtctgtcacatgtgcctttgtacttagagtttgcctgctctggttggtctgctgagatcggtggtcactacaggaaaattgcttttgcattatgaactactaacccggcagatactgttcagagcacaccacacaggagaaaggtgagaaatcacagggtgggctggagtctctaggaatcaggcttgacaggagaaaaaaataactgctgttcatggaagatttacttgatgccacatctttggctgtatacgttgtttctggcatgcagattagctgtaattaaccacattttatagatgaaccaaggctcacagaaatgcagggacttgcacaagttcacttgattagctcaggtgtcactcaaaccccaatggtctgggtacagccctattttctcaccactatccgatgtaggttgttgaatcaagggtctcaagcccagattttgattcttaagcaagtactcactccaccaacaaggcagcctactcagattatttatctatttttatatttatttatttatttattttgagacggagtcttgctcttgtcgcccaggatggagtgcaatggtgtgttctcggctcactgcaacctccccctcctgggttcaagggattctcctgcctctgcctcctgagtagctgagattacaggcacctgccaccatgcctggctaatttttgtatttttagtagagacggggtttcaccatgttggccagactggtgtcgaactcctgacctcaagtgatctgcccacctcggcttcccaaagtgctaggattataagcgtgagccactacacctggcccagatgatctaaagggaggtagaagatctttagaatgaaaagtgatttcttggtttttccctcagtttctgtgtgtaggctcctcttcacctattggtcagtaacactgaaacggttgagggtaaagtttagtactggccaccataggaagattaaaagaaaggaggtgtactagttaccattacttataattattacttaaaatggctatttaatataattatattataatatagcttataattatgtatcataaatatttttattgctataaaattagtaattgctaacttttctattttttaactttttgtagggacagggtcttgctatgttgcccaggctggtctcaaactcctggcctgaagcaatcctcgtgcctcagccttccaaagtgctgagattacaggtgtgagctaccatgcccagctagtaataggtaacttttacagaatgtcaagcatataataaaagctttacctggattattttattgactcactaaagagtcctatgagataggtaccgtatcacacctacgtgaagatgaggttgtctggggcccacagcactggcagtgagaagggatatgagcccagcagtctggttccagagcagcctctttgcgtccttatttggacttcgcccactgtgcctctagtcctcgcccccaggaactcatagaacccaccttagacctccctctcccactgcccttggccagtactgaaaagtctcaaggaaactcaggaagaataatgtacactagctcacttcatcagttctgtgtataatgtcctcatgaacacagttctctgggtggatcagagttgaccagctatccaagagtgactgaagcctatgttcaccttctttagctccctgagaaggtgagcgcagacctgcaggtcctccagtcacccttgaccctcacaaccacatcactcactccaaagaacccctctctcccttcaccatttggactggacaagccccttgggatgaaggcagatagtgcagtggtaatgaatggggctcaggaatcagactgacctgggtttgaatcctggcacttccatgaacttgctgagcctccattttcctatctgtgaaatggggacaataataccaccaccttgtggagatagagaggatgcatctgggccacttgactccggggctggctcacaacaaatgctcaggggaaaccgaccttcttctctcaaagccaccctctgtcctgaacaccaggccgcaggctgagctccatagggctgggcgacgggaagcgtgacctggaatggcaggtggctctctattggtgtgaaagggggaggcaagggtggacttttaattactatccaatgacttattgaagagacagttttcactaaagacaaggatgtactctctttgcaggaggacctcagtgtagcatccatgggttctcaggtgggtctcaaggctggtgtttgtggtaggtgagctcaggtgttggaagccttggccagctgctgtgagccatgccctgtgggggagaagaggtgggagaatgttcccccagggctgcaagggggctactggggtggaaggggtagggggcgtctcccgggccaatgagggctggcttggctccgcatctgactggcgctgaactagcttccgttagtagaaaaaggctgcgtgtgcatgaacctgcctgggcatggcagaggagcaggcctgggaaacacagcggtctctctcccacattcgcttggttaggtggctgcagaagcaccttcctgctcgccgcctggaaggtaggtcatgttcctgaaagcgggaggctctgcggggcagggtcccagggttctgagacaaagccctttgtctctgagtgagagtccctgtctgggatgcttgcccccagcctgtgcgtctcccctgcacacccaggctgttgtgacctgcaggggccgagagagcactgcgccatctgtcccgggggccctttagaccactgggtaaggcagctgcttttccctttgaggagagtggcagaatcagaggagagcctgggtctgccaccccctcgtgccaagttctctgccctacctgagaaggtagaagcttcaggagtgggagcaggaggtcgaggtgctgagcaggcagggccttttgcagccttgtctccaaattgcaggaagcagtggctgtttctggctgggaacaataaaggggaggggggcttggatgaaccctgtcctgatgggccacgtggcgtccctgagtcaggacagctggcactgttgccagtgctggtgagtggctggtgggaggaagtgtggaggtggcagcagcagtgacaggtgtggcctggcctagggaggtgggcaggaggtggagcatttggtggccttttgggggctctggttatggggcagagctgggagcaggcagatggcatcctcagatcagtggtggggctggatgtcttccccagttgtttccccaccctcctccatcgggactcctcctgactgctcttcccaaaagccccctctagatttccctcctgcgcttactcctgcctcctgtcagcccacccggcttccaacctggatgcagcgccctcatcttaatctcttttctgggactcgcagcacacattatcacggaatgaaccatcaccatctggctcccaaagtccccaccaacttccagtgaaacattgaaatgcagaagaccccatgtttctctatgacttgcacacctgtggccccattctgaggttgcccctcaatccctaattatttcctgagggggaagagtcattttgccatggaaggcgcagattacaagggccacgtcactcggtgtgatggtcttagggcagcactgcagggtgctgggtcgggtgtgtgtgtgtgtgtgtgcacgtgggtgtgtttgtcagattaactgaattggcctcaaccccaccttttctccagccagacatttgctgcttctattccttatcaagcacttaagattttggttgagggctgggcccggtggctcacgcctgtaatcccagcactttgggaagctgaggcgggtggatcacctgaggtcaggggttcgagaccagcctgaccaacatggtgaaaccccgtctctactaaaaatacaaaaattagcgggacatggtggtgcgtgcctgtaatcccagctactcaggaggctgagccaggagaatccatagaacctgggaggcggaggttgcagtgagccaagatcgcaccattgcactccagcctaggggacagagtgagactccatcacaaaaaaaaagattttggttgaatgaatttttctaggagaatccatagaacctgggaggcggaggttgcagtgagccaagatcgcaccattgcactccagcctaggggacagagtgagactccatctcaaaaaaaaagatcttggttgaatgaatttttcttagttttacagaatgttggaaagcataggccctggcagggccatcttggggaactttggaaggaacagtgatctggttcgtctttggggtccaaaggccttggtactatggtgtgtgtgtctgtgtgtgtgtgtgtgtgtatcggataggaaggtggcccagtatcctggtgcccatagaggctgggatctgactcagaggagccgttgcttactcctccctgccacccacaactgccaaccctaaatcttctagggatgcattctggaactccactgtcccaagtctattgctaccccataggcacatgtctctgcactgtggttccacagtggtggtgagaggcacagatctacagggcagcatggactagtacaaagagtgtgggatttgggatggttgtgtaacaggggagataaagctttgatgcagactctgccctggagcctgatgtgggatcgggggtgctgagtatcccctcatggccctgggcaatgctttttttttttttttttttttttttgagtctcgttctgtcgcccaggctaaagtgcagtggtgcgatctcggcttcagcgcaacctccgcctcttggattcaagtgattttcctgctttagcctccaaagtagccgagactacaggcatgtgccactatgcctggctaatttttgtatttttagtagagacagggtttcaccaagttgaccaggccagtctcgaactcctgacctcaagtgatcttcccactctcagcatcccaaaaggttgggattacaggcatgagccattgcacccaacccctgtgcagttctctttccatccatgcttggaggcggctcagaggcaggcaggaggtggctcaagggtgggctcaatccctgcctcccctttctccactggttatttggcctggcctttgttccagcagcagattgaggggacatgaccactccccttaggattaaacccagtcagacctggacaggaagtgagggtcactaatataaggatggaaatgcttgtccttgcttctaaggagcctggtgctgacacatgcacacacccgcctgcatgcctgtgagtgtgggcagcccagctgaaaccctgcctgcacccctcaactctcaggacattctgtgaaactcgctgagagtcttggatggtcacatttgaccacaggttactggattacaagggataaagtggtctcatagagaagtcatataaagcttttcaggggtttaagagaatcttgcttcaagcaagggagttgtggggaggaagcagagaaggcatcctggaggaggaatcataatatggggaaagtaatggaggagaaatgtcattctggggtaggaaaaaaaatataagcaaaaacatgagtgatgggtcaccctctgtcacctgcctggagtacctaaccgatgggtcacctgtcggagcctgggtcctggacagtaggaagaacacagggtcagtcagccctaggaaggaactctggccctgtacctagcagtgtgatctgaggccagtgactcaccctttctgagcttcagtttccctatctgaaaaatggggatgacacgcctccctggcaaagctgctgtgagcatgagaggttttatatgtaaatgatcttggtagacaggtgtttcacaaagggtcattcttactttcgtcactatccacaagtctttcctgagcttgggactgttaaaacaggagccagaggagcacctgtcttgcggagtcccagagctgagaacggaggctttgcaaatctgaagttgcacccattagaatgctgcatgggtggtgcaggagacagtgggtgagccctcccattggctctgcctctttcttgagcttgggactgttaaaacaggggccagagcagcacctgtcttgcagagtcccaaggctgagaatggaggctttgcaaatttgaagttgcacccattagaaacctgcatgggtggtgcgggagacagtgggtgagccctcccattggctttgcctcttctgctcatccgggttggcttcacagcctcctggagtgttgtgtcagccatgcaaaaagggctcaaatgtcaccatctgccttttattagtgaccaattggagaaggcttaagaatacttatactggggttatttattgccggctttctcccagcctggagcttgtaaattgcctcttatgagattaagggaagctgcccctccagagaagcaagcaaataggaagaagggaaggagagaagaagtcagctcagtggctcctggtgacatcagaacaatatcgggtagggtgggaaagacaagggcagcgtgactcagttcatacctcgaaacccaagtcttgaattctgctgtgttcctgctgctcagcacagggccagcatctaacacaggaggatcagctttgagaaatttccagaatgcccagttggtgacctgctcggggaacaggattgggggtgatagagtatgttctgacccactgactgacggataaaaatggatttttatggaggttctagggggtttcagtcactgtttcagctctcaggatgccatggtgcctcaggcatgagcaggagccacctcagcaatctccaagtccccaggttgggtgtggggtgtgcaggaggggctgatatgtcttccgctgagtaggctctggagctgcggggaggcaaatatgtgcagaagaaactagaataaaaagctctacaccataagcgtcagagtgaggcacaaagtcccaaagaaggagtcacagaagggttggcttctgaaatggccaggatgaagacaaggtgggaatgttccctggaatggggaacagcttacgtcaagtgtggagaacagatgtgttcatggaataaaagcagcagtgccacatggtctaggcttgatctctgaccctgccattatggctgtgggtccctgggcaaattgcttagtccctctgagcctcagtttccccattggtttagcaatcaatacttgttgagttgtttgtgagaatgaaataggtcattctctgtgatgtgcacagagccctgcctgccttccataatggcagctggcagtatcattacaagcctagcaggctgggtgcacggagcatgtgtgtgcagactctcttagtacagcgcaaatctagaaagtcctggtgggtcagaccgtgtgggcccttgaacgtgtgccaagaagtttgtacttcatgagaagtcatcaaaggtttttgacccacatgctcagatctgagttttagaaatatcacggtgatgacagggaggaggatgaatgaaggaggataatctgaagacagggagactgatcagcaaggttttgctgtcatgaggactcaggctaacgctgcatcaatggaaagaagaaatggatttaggagccatttgggggtagaactgatagtacttgaccagggatgaggaagatgaaagtgtgaatggatgatggaggagccatttgctgctcaggaggagaagcgcgcttgaggtgaggcagtgagttcagttttaaatgtgttgatggagaggggtccagaatcccccaggtgatgctgtcccagatgtagttgggtcaatggttctggagctgggaaggaggtgtgaagaactcacactgactgagcactacctatgggtcaggcagtaggagaagtattttcaggtgtcctctcacttggtgttgacctgataattcaactccaaatatggaaagttatagatgttgttgtgactatctaagagggacaaggttactccagtctgggagtgttgggagtagctgccttgggtgaaacatctaaatcttgttgaggtttgcacaggttttgaaccatatcgggatggcaagagatcatctaacctaatcttctccctttagactgggattggaaatataaacagagaagccagaagaaccaggcaggggtagaagacagggccttttctctattgtctgtttctccttgatttctactgggagagagacaaagaaacactttccatcccagcatcgccacctgcagccattggtagcttgattctgatacacacgtaaggagaagcttgccagtctcatgaacattacagaaattgcactagaattttacttggacttacaaaaaagaggctgactgctcttcccagggctggatgagggggtggaaagtctgagggcacattcccctatgcttgttcctcacccgggctgagccagtgtgggcagcctgtgattctcccagcctcgcacttctctcccaggacacaaaatccaccaaggttgtcctggacagtgtgggtctttaacgaagagcaatcgggctggccgaggcagggtgagtccaaagtcactataaatcctttgcctactgatgatcaggctcgcggcccctgccaaagcctgcactgtactcattagtggcagggagagggattcttccatcgatccagccaaggcctggatgccacgaagacactgataagtgctgctggaaatatgggctcttcagtgcccatggcagagcccatccatccctgcccgaggtcacctggaggtctaaatgagacaggacgggcatagcagagtgggtttatggtgggggagtggagatgggagatgctcgacagcgcatgaagcagagaccctggctgtggtctcaggcctgttgctggccagccatgggaccctggctaagccccctttcttctctgagtctcaggctcttgtgtcttctgactggaatgtgccctcactgagccggcaccttgggatgtgttggagcagcatggaaggaagagagtggcactaaggggcagggatggaactatgccattagctcaagagggagctgcaggctcggctatgggcaggctcggctacagcagacagagtgcccatcaacccctctcagagggcgtcagcgtgggcaccaccaggagaggctggaggctaggtcatggattggctgactccaagatgcccagcacctcttgctcccatgtctaaggggtactgtatggacacatgaagctttgtccttgtcctgggcccagaaggtaccagttgatgctgcctctgccacctcttagctgtgtgcccttgggcctgactctttaactaagactcagatgccttatctgtaaaatgcaaggtttaagcgccttcctcccaaccctaatgcttgatgttctaacttatccaaaatcctatttcgggggtggggggtggtcctaaggttgaaaataataaaatcaaggtgcaaagaagtgaaagcaagtctctcaaggacacttggccttttgggggctcagatctatatcctaaacattaaaaaaagtaaacaaaataatcatttatgctgctatagccttgtcagtcagagacggttctaaaacttccatgtgcatgaggatcacctgggggactggctaaaaataacagtttcctgggctccaactcagagattctgggatagtggctctgagctgggtcaaggaatctgcattttaatagcttctgggtcatccttctgcaggcggtttctgggccacatcctaagggcactgttgtgtgcccacagcacgggcttgtgggcctgggttatttctagttcaggctctgtcactgggtggccttgattaagtggctgtctctctctcggggtgcgcattgatgttcccactgcacagtgaaggcattttcacaccttttgaaagttcatgcaaccctttttgtcagtgaagtctcacagggaatcccagtgtataaaacggtggaggcagagctgaggcagcgcgggaaggaccgagtcctgccctcggcagccctgcagcgggccctcaggaccctctgtgcaatgctcaaggattccaaaggccctgtgcagttttgatgctcttcaggtgtcctgtgaaggaccacgtggctatatcccactgacggtgtgaaagcaggcccacccggcgtgcactgagtgactcaggcaggctggtctgaagcacgaggtgccttggtcttgctctctgagcctgcatggagaatcacagctcagacctggtgcttatagaggagtcttctcatggttcctggagttgttcccaactggacacagaccatcttggggcaacgtcctgggtttctcccctcttggagaccaaatacaatcaactcttaattatctttgttagtggagaagagcagggtgtgtataatctagaatgatggacaatccaaaacagtgaataatcctaagtaacattcattttcgactttggaatgcattttgatattcacatttgaatatggatatgtttgatgttctaggaatttttcatacttaaaaaaaacactcaacccaagggtggggctccctctctgcctcctactcagctgaggggagaacatcacctctgggactggcccaaagctacagtcaggtgcaccccaccttccccatctcctgtctttatggctcacaccttatctaggaagggagggggatattaacagattttgcctttaaaggacttttattccctttggaccttatgcaaataagagtaaaataagaagctgtgaaatgttaacagaggacttcattaagcaaacttggtgatagcatttgccaggaatggggacaatttgccaacagatacttgagtgctgactatatatgtgtcctaattaaaaaagtgatacttctcactgccctgggattgtgggccgtcttctggtgggtttgggatattaaccacaactaactccgatacaaagcacttcacatacattatcttacctaatccaccttcatagcaccccgtggagcaggtcccatcatcagcccccatgtagagacttgaatatcacagctccaagccagatgtcccccgtgaatataccctcccaattctgccctattctactccactctgcctctcctgtcaccccccaaacagaggccctgcaaagcctcagctggtctgcatcaatcaaagagaacgaagcaaaactaacttgccattactgccctagtctctctgattgttggaagtagagatgtttcaaggagaggttttgtgctggaagccccttgaaaggatggagagggagtgtgaggactgccggagacgcccagcctaggaggggaagctttctgcttttccagcaggacagaactccttagaagcaggtgtagccctggctcatatccaccatcctgagaaatagaaaatctttcccattttacggacaaggaaactcagagaggttaactaacacatccagggtcacagggtgtggtagaggtagggtttgagccatttgactccaggcctggctttttttcccccaacagtagccggtcagcagagggtgtttgatctgtgtggtttcctcttcagaaagcagagactcactactgtgccccctacctgcccccagctgagctccaaaaacagctataaagctgatgggaagccgataggacagcccctgcccttcctgaagaccacggaaacctctcccatggtgcccttggggctgagatcagctctgtcaccaatacttcagggcaaaagtcgttggcaccacttttaatcctaatcctgtgtggccttattcagaagccctttgcaaaggccgatccctagccatagctctctctgctcggccttgggctgggtgaataatgacttccatttcctgccctgctggagccttgggtctttgccactgccaccgtggtgctgagccacttatttgttgtgagatgacccaaggaggaccagccggtacctgctaggcccttctgctggggcacggggtcagggggcagcacatgggcatgtggccccactcctgtctgctccccaggacaactctattttccagcatggagtgcccctggaggtggcgacagctcctctaataagagagttactcatggcttcactggagagaagagagcagctttcaacccccctctcctaaacgcaacgatatttggtaacatgcggcatcttggggagagcattcatgtctgtaattagttactgtatatcacggttagtactctgctcagaatttacggggcaaataccatttaactgcacaataactgcaggtccttgctgcttattgggtaatttactaaggctggaagaacggggcaggagggattctgaatgggaggtattgtaaccccttgaatcaaactttatgagtttgggtttggcagggaggcagctgcttgcagccagttctcttctctttgttttgcagagttggctggcagactgcttccttcccttgatttattgcaggatgataggtctgggactgggggtgggactgcccggggctacctggggctatggaagggactttccatagagggtctttggctgagagtctgcagcaggaacccagagtcggtgtcctgggggctccatgcaggacagcaaatgggccctgtcatttatttactccctccacggggctgctttttgtatctgggccagtgggtggagagtgcagggagctgtccttggttggcagcatcaagataatcgcctaagccctttcttctcttgcaagtccgttgctgcctgggaagcagccattcctggacacttggccgacattcctggccttaatctgcttgagcaaagtctgtctttgtttggccatgcactgtctaaactcctctaacctatttaggccacagagaggggagaagacacaataatgaaaaactcaacgtgcaacattgccttacgcaatctaataaattacttggtacccggctgccagctcagactaagcccaatattgcctgcagtaattatttggatcaaatgcagtttatctgcttcatatttgtgcttctgtgctcagtgataacttataaatgtcattgtggtgtttatttgttataatgaaacttaatggcattggaagccaagagcagaactggtggggcggcaggtttaaaacaatctcttcatctcgggagaaggaatgagccaagataacatgaaactgccctatagggaagagatttgcagagatagtggtgtcctcgtgctgtgtggtggacgggagtgagccaggagctttgagctggcaccaaggggagccgtctttgcctccagagatatctatctggatcggggagacatggctgagcttcaccctgcactgccccatctgtccttgctgctttcaggggtgggaggtgttcagtctttataccacctgatgcctgcctgggataagagatgaatagggatggaaattagagtccctgggccaggcacggtggcccacgcctgtaatcccagcactttggaaggccattgagggaggattgcttgagcccaggagttcgagaccagcctgacaacatgtgagaccctgtctcaatttttaaaaataaaataaaataaaataaaataaaataaataaaataaagaactcctggatgactgcattatggagaacaggccttcagggagaaggaagggagcagggttggagaataaaggaggatatcatgagggcccagacagaaggtggcaaggctttctcttctggttctggagggcattggtggtaggaagcacagagcatgagcagaacagggaagagctttcaagggttgcagggcagggcccccactggcgctgcagaagtacctgaggcaagggccatttaatgtagaactcagggttttggcttcatacagtcctgggctctgctatttcctagctgtgtggctttgggcaagttatttgtctttcctaagtttcattttctttatgtggaaaatgtgagtgataatagatacctctcaagattctggtgatgattaaatgaagtgatgtgtgtaaagtaatgactgtggtgtttggcacacaggatatatgataaataaggggctgtggcagtgattggcacatagtagatgttcaataaatgttgaatgtatccatgaataataacacttcccacttgtgtgcattacaaaaccctcctccaaacagctgagcttggatttagacctcacaattgttcagggttgatcttctcattttacagtgggaaatggaggcccagtgaggttatggtaacttgcccaaggcttcccagctggtagatggaatggggtcttagttctcctacctcccagggcaaggttgctgccaccagtccaccctggacagctcccaatctgtgctgggagactgacctcatccttcctgatgagctgcccctgctccttggagaccaggcacagagcctgtgctgacctccccagcacaacctgggggcagaagcaagcgggccgctttctgtccatttcatcttaatacaacattcagcattcactcataaaatattcattttctctcctcggtgacatgctcatgcaagtctcctaacatcataaatatggatgaagactattagtcatttttatttatctcactagccccttccctccccagcacaccttttgtcttgatctcagcacaaatgggactgaattggggctattaacccggatctctgataataaagccttgcatcctgtggtgctttatactttttttcaaagcatcacgcaatcgtgatgcatattttctccttacaacaaatgcgtggaggaaagagggctagcatcatgagtatacccatttcgcagatgagaacatagaggtcaagagagatcaaggtcaaagtcatatactgagacaggaacagaactaatttttaaaaaacattattattgttatttgtttgtttgacctccaaggaaaggttctctgggacactgagtgtgtttgcttcacacaaataaataatctgtatagtattttacaagtttataaagagtgttcacccatgttacttggtgggtccccacaaggcaggtatgatttactcttgtttgacaaagctcacacaaccagttagtggcagatctgggctctaaaacattatttcccaaagtggatttcagggaccactagtcctgacacatgctgcaggaaaaatgttttgtggtcaaatgagtttgggaactctgtgagtcatatcccctttgggtggcttaccatggcctttggtgtattagtgtctctgagaagttctgcaggaaagactctcattttgttaggtctcatgtagcttctccccaccgtgtctaatcacgaaggctgcatctgacggaaaacctattaacatgctacagaaatgctgcctgtgtgtacgcgtgatccctcctcccccgtgtgtttggaggcagtgaggattagagcgtggctgggagaggagcgtgcaggggtaaggacggggtaggggacccactgctggggactactagagctgaagctcccctcctcaggctgtgtcctctctttccctctgggcagtgcagaaaattcactcaatattaggcacagtcagcccagcccatatctggggcaggatcagaggggccgcctgagtggcggagtggggggtctgtggtcagtgaatggtgggagatttggggacggcagtccttggccatggggaaaaatcaacagggacccacaataggggcttagtcaagtctgccctggacgatggtggggaagtcaccctatcctcgtcgcccagacacaaagctcccgaggcagggtggaagtaagaaggccaggctttggcgttcagctggcttactctaacatctgtgtgcctttaggtgatgatctaatctgtctgagcctctgtttcttcctcctcagaatgtggataacactacccactttgtgacgtggtgaggattagatggtgcaagtgtgcaaaagtaccctccttggccctcgtctttgtgtgtcagctccatctctcttcccctgcttttttggagcccctcagtcagaacaaatagcttcccacctccagtcctccacgagcctgtcatctgtacctctctttagttctcccatcgccctgccttctgccattttattatatgcccatctccccaatggacctgaagttctctgcaggctgctgctgactctctcagtgcccacttgtatctgcaggcccgaccatcccgcgtcttcaggccaacctcccattgccggtgtctggaccccttctcttgagggctttctctttagttgcggaggccactgtgccctcacacagagcaggccagacctgctgggagacaacaccctcacccagcagcactccacccatgccctacaggagctggtgcagaaataccccaccgcttgggtgccctagctgtgaggtggtgttcaatagcacttctcagagtttcttactgggactgggctctggctgcccatagtggtagcaggtttggggtccccccatgccgatgcctcctttcccatgtcaatttccaaccctcccgctggcacctctgcaccttcatgaggaatgactacactagcgctcttgcttagggcctgcttccaggggaacctgaggtaagataagggcatcctccaggtgtcattcatctctgcgtacacagtgggtgctgatgaatctctgaatccagcagaaatgagccataggaacagcgcaggggtgactgtcaatcaaggcaatgacgtcagtgggctcaccacgtgggtgggtcctgggagcaacgagatagaatacctgctcccttccacatctggaagcatccacagccacactcacacctctgtaccttccccacctaatgtttagtcaaaccttggcaggcacagaggagctgaggtccagggtcctttctctatgagctgagaacaggttagtgttgtgttttgagatccttttatgaataatggttgagaagtgctgctctttagtactaagaatagtggttattcctagtgcatttgactcggagatggggactattccattgctctatttgtcccacactcggtacacagttactgaaactgtcaccgtgtcctatattccataggccattatgtgtatttcaaaccgttatataaatggacttgatttggcacttctgaatgtcattaaactcctcccataccagtaacaacacagtttccatagaaacgaatacatttcagaaaggaaggcacagggaagaaagcagatggagttagggggaaaacgcggccccctggttcctacttccagagcacagggcccggcactgtgacatgagcactctgtggaggtggggcaagctccttcaggtttttattgactccctttgataaaagccctggataattcatctcagcctgaacctgctcattccagcgcacggctctaaaaactttatggcaccgcaagccattaagcgccttcgtttattccaacttctctggggctttcttcagaccctggggagagggctgggggagggtctcagcactcaaagaattctgtgatgaagcctttgaggctggctggggatggaaggaagaagcagagagaagaaaggaggcctccccggtgcagttgacatagtggagaccccaggatcttgccagtggctgctgtccaagtcactgggtcccctcgtcatcagtaaagctagaatgcgaaaactgcagcctcctggggtggaagcggtgtggcgtttggagagcctggctgaggagctgcccaccgcctcggcaggctgcaagtttcttgtctttggagggattcaagcataggttgcaacagcctcttagaataaaacatctcacagggcttatttctccagaagccatgctggacactcctctcctggcctacagtgtgattggattctccttctctgtttccaatagctacttattcatacccggttaccgcaactgcgacattgtattgtagttgctgacgtgtttgtctctccccgcaagacagtggtatccttgggggcagggactgtgtttttacatgcacagcgccaggcacagagcgggtactggacacatggttggtgaataaatgagcattccgccgtgttcacagtctttacacacactggtacttggcagggatatggaaccagatgacctttggtcccttctggcctggagaatctgtaatgataggggtctaagcctgccctgactacacccgggatttgaatctagatttctcctactcctaagccacagggttacgttaagaatattagtcgcacgcctgtaatcccagcactttgggaggctgaggcgggtggatcacccgaggtcaggagtttgagaccagcctgcccaacatggcgaaaccctgtttctactaaacatacaaaaaatcagccaagtgaggtggtgggtgcctgtaatcccagctactcaggaggctgaggcaggagaatcgcttgaacgcgggaggcggagcttgcagtgagctgagatcatgccattgcattccagcctgggcaacaagagcgaaactccgtctctgtctcgagagaaaaaaaaaaaaagaatattagtcgcaatgataaaaggaaaaccagaaccaaaacagccacaaaaacagctgggtgtgaaatgttggagaaaactctccccaactgcatttttcctctacactcaccacaacagtccacacaggagacctctgtggccaaacaggtgggagcagcggacaccagctgggtgtcctccaattcaattctgacactgtctacctggagatagtgtcagatcccacaggctgggggctcagtccccaagacttcccccacaccctggcacctgtcacaagttcaggcttccagaacttctggcagacccgctgcaagttgggggttcccaagaccttctgtttgggtttgattaatttgctagagtggcacgaagacctcagggaaacacttacctatgtttacagtttattctaaaggatattacaaagaatacagatgaagagattggggggaaggggcaggagcttccacgccctccctgagtgcgccaccctccaggaagctttacatgctcagctgcccagaagctcccgaaactcagtccttttgggttttcatggaagcattccttcccctagggtgtgaggcgggactctctcagggaagggtcttaagacccacaatcagaaagtggtgaaaggttagagtcctgcgatggggcaggggaaaggagggccggagagagatcctgtttcccgaggcctgcccctgaggcctaacacacccaacatatggcaaaagactgtagcaagggctatgggagttatgagccgggaaccgtggatgaaatccccccaccccatgcgcctctatatagaaacatgtctagatacatcatcacgcctcaggccatgccctgactttcaaccactgatcccttacagcaaaagaatatatatgatcatttaacaattagtccagtgcactgtattgcatgaatgtctcccagggtgaggccactcaggtttgcaggcttttttttttttttttgagacagagtctcgctctgtttctcaggctgagtgcaatggtgtgacctcggctcactgcaacctctcctgggttcaagcgattctcctgcctcagcctcctgagtagctgggattacaggcatgcgccaccatgcccgactaatttttgtatttttagtagagatggggtttcaccatgttagtcaggctggtcttgaactcctgacctcaggtgatccacccgccttggcctcccaaagtgctgggattacaggcgtgagccactgtgcccagcctgcaggctttctttagatttgaagaaaagattccaaaaccaggagtggtcccagcaaacacagcttcccccttccaggcatctggggataccaagcaaagagacaatgtcctcttttggttcgagactctttccagttgttaatgtagtattggatttccttcattttataacccatttttcgtttctttactctcaggtattattcctcattttctccactagtcgtttattttttacctgcacttttccacctttggaagggacattgggttcggccactgtgtggtccagatggctgctggcagcactagtccagccagtgcctcccctcagtccattaccattcatacccgggaaggttacgtaagttccaaacgagtggactattcttaccaccaggccccctagttggatttactcttagccctaattttgctagacagggtgaaggcacctcccacccccatcagggccctaggaattctgacataaggtttaaaaacacagtgacagttttttgcttagaagttatctctgtttccagcacttgtagttgcagccctggtcccgggatcactgcatcacacaggggagagagaaaagtttttttttttttttttttttttttttttttgagacagagttttgctgttgctccggctgaagtgcaatggcacaatctcggctcactgaacctctgcctcccgggttcaagtgattctcctgcctcagcctcctgagtagctgggattacaggcacctgccaccatgcccagctaatttttttgtatttttagtagagacggggtttcgccatgttggccaggctggtctcaaactcctgacctcaggtgatccacccgcctcagcctcccaaaatgctgggattacaggcgtgagccaccgtgccaggccaagaaaagcttttttttttagctgagttgggaaagaaagaaaaaaatagtcattataccagtgtactccttccttagcaagaattgcatagttatctagcatccttcccacatcctcttccccagatcagccagaaaaacagaggaaaaagtctagtggggacactagtaccactcatggtgtgtgtgagcacactcgtgaaggcgtgcaagccagcccttcatgcttttatgtccccattttagacaaccaatatttcaatagcctgttgtatttctctatcaaattcttactctaaggagatctctctgaccattgctggacattatgggcttacagtgtgtcccttggtctgaagaaatgatggtcagctgtccaaatgcatacaatatcttctgttccatttttttttaaatgacactctgagcacttctatcttctactgagtaaggaaagcccactccagagtcagtgtctattctaggcaagacccatttgtagacccgcagcaccagtctcacttgctagctgtgtttagagccttcccactagggaatcttccacatagccactggcagtctctgtctctcttgctggcagacagaatagctcttactggcattatgtgcctgagagggtgcaaagggaacatgtccagattcagcccatctctacactgctgcggtgcctccatatctacccatttcatgagcccaggtggccacctcaagggagcagctggggctatctgcgtgtcgattcccgtcaccttctgaaccttgaagggagttcttctgatgggaactgacttgttctgctttaatgcacccctcaaatttccatagggctgtgctccacatgggcatcccattaaaaggccaggtttccattgcccttctgcctggccactcggccaggccattggtcactgcccatgattcagtaaaacctaaacacagaggcctctaccattgttcatttttttccatcactattaggaaaacagcatgcaattcagctcatatgcagacctgtatttaccttgtctgatcaaagtagtaaccttcgaaacaggttggtgtccattcacattggaactgctgtctgtcaaccaaacagctcctgagtcaatcaagagctgttcataatgcactgtccacgtgttgatcgaatccagcagcacctcacacagttccagagtcagttctagggggagaagaagctccctgcctgagagtgtcttgtccttgaattccacaggcagcatgatcctctagaaaccatttccattttatgtactcttctgggcactgctgtccccattagaatgtttctctgacatcaccgaagacaggatgagtatttcaggtgggtcctgcgcacccaccttccaagacagctaaggtttcatagcaaggcagtaaatgccctcaagtggaaattctctagtccgaagtcctagcagttgctgctgggaggtgctcagaggtgtttgccataagccccaggaattgctccatagaagtatatggagtcttcccaagaggaggtaaactttctggggaccaagacaagtgcccgctgcctgtgttactctggatgaatcacatccctttcctgagtcttggtttcctcctctccaggtgactgccaatgtttcttttaaaagtctatgattgtcaaattatccagtcccagcatcttggagctactgactaggggcagagaaggtcactgtcctcactttgctgacaacatctatgcaaacactgtgttgggctcctgggatctaatggagaccaaacagagccaactgactggtaggggagacaggtgttattaacacaaaataactgggctcccagctaaaccccacccttaagcctggaactgcagcccttagtgaaaacaggtgactcaatttttctcccaattgttgcttttttggcctgccacatccctatcctgtgcccatgaaaagacttcagctggcagagtaacacaagcggctgagcgtcagggatacaagtggctgagtggtgagcagggcagcaactgggcatcggagactatggatagacgaggctaacttcagacagtgcagcttcagggaatgattgccttcttcctgcaccatcccctttccaactcctcattccgccaagagccccttccatctcccaataaaatcctccgcatacactacccttcaatctgttcatgtgacctgattcttcctgacactggacaagaagctgggtgccgagagggcaggagcttggacactgctgtggggccgcacagagcctgcttctgccagagatgagtgactggccggttccagcgttcattccctctggttcctgcacttgcttgctcacacactccctctctcaagcagtggccagaggtaggctgagtgaaacaagccactccagttcccacccacaaagagggtcaaggttaagggaattatcccatctcattagtaaataattgcaatatgaatgtatatgtacaaactgaactcagagctctgaaaggaaggatctggttctacgggagcatgtgacacaggaactggatcttgactgaggagggatgggtcagtggaggcatcactggagcagagacttgagctgtgatttgaaggatgagcgggaattaccaggtgaagggtttggggatggggtgagcgtggcaagcagggtagacacagggagcagggtagacacaggccctatgacaggggccctgcttgaggagcagcaggaaggcccatgtgactggagcgcagggtgtttaagggggtaggatgaagtcagaggtaggtaggaaccagatcacgtggcaccttgtagaacatgctaacaatgtgagcattttttttttttttgagacggagtctccctctatcactcaggctggagtgcagtggcacgatctcggctcactgcaacctccgcctcccaggttcaagtgactctcctgcctcagcctcccaagtagttgggattacaggtgtgtgccaccacgcctggctaattttttgtgtttttggtagaggtggggtttcactattttggccaggctggtctcaaactcctgacctcaggtgatccacctgccttggcctttcaaagtgctgggattataggcgtgagccaccgtgcccggccttcagtatttttttcttaaagccattgaaatattttcaaaaggaacatgacatggtcaaatttgcatttcgaaacactgctctggctaaagtgtggaaaacgacctgggcatggggattgggcatgatagatgcaaggagccagttaggagagccctgatgcagtccaggggagagaggctggggacagggtctagggtggtggcatgagatggagagaggagggtgggtacaggaggcactcaggagataacatccctaggacttgctgaggactggatatgagtgtgagggaaagggaagttataaaggaactttggctgggtgcagaggctcctgtctgtaatcctagcactttgggaggcccaggtgggaggattgcttgaggccaggggtttgagaccagtctgggcaacatagtgaggcactgtctctacgaaaatttaaaaaattagctgggcatggtggtgcatgcttgttcttctggctacttgggaggctggggtaggattgcttgagcttaggaattggaggctatagtgagccacgatggtaccactgcactctagcagaatgaaaccttgttttggtgaaaaaaagaaaaaaggaacttggcagggtctgcagcttaggggtccacagtctaagagaggcaggactcctggtaggaggtaggaaaggtggctggaggaatgggctgagaaaaagctttggaatgttccctcagatcctggctggagagtggaaacggcaggtctcttgttccaagacactgagcgaaataaataacaatcataaagtgccctgtaaatctgactcttgccataaataataaacagggatattatacaaataacgggctttgcagccccagtggaagaaaacacatcagtaagaaaaatgaatttagaaaaaatgcaccccaaagccccaactaacaaaatgacggtattagccaacatcccgggggctcggcaggcagtggaggaatgggctcaggaaaatgactgtggcccttagcgcgagccagactgtacggctgcaacagagtgagaagtgctgccggtagcagggaggcctgctcatccctgggtcaggtccccaggccaaggaccctggcctgctgcttcccctctgccctgagaaaagcacagctcatcccacaggcctgcccgactctttccctgccacccagcatatagctgatatggcctgagttcacccttaatgacagatgggagaaagaaacacggatccaccttcagaggctgccaaggaaagccagtctattgacttttttgtactggttcctttggtgaccaagacatttaaaattatgggatgggctgtgagaacagggtgtgggctgggtgttgagatccaagatagatttttgaatcatcacattttagagacatacaggtcatcttatgaaacatgattccattttgcacatgagaaggttgagatcttagtgtctagggacttgcccaagctcacacagccggctcctcactcttaagtgctcctcccactacacatcccagctgtggggcacctctctttctatacgaggaaacagtagaagctttagactcatttttttattagtgtacgagggtgcataaagaacaggctctcacgccatcataaagaactttagagctgtcgaagaaatgagattctcaacctcccagggctctgactcccctgtaaggctgggaagtgaggacaggtgctgtgggggaggggcatttgcacacagagcctggactgggaccacagtgctgttcgggagctgtgggccatgcaagaggctgctagttatttatggaaccagctttccccttcctgggtgctccagctcttcccacacagggtagaggtctccagtcagcaaaagctgcctttgctaatcactcacaagtatttcgtcctgaaagatgaaagggacagcacccagaggcatttctgctctcccttggtctcttgaagcagacatcattgcaatgctgaaagtccacggaaaccgacacccaccctgatgggcagcccaagaaggcaccagtgtgagggaggagtaccctcctgtgcaggcccccctctgccccaaggggatggctgaaggggaggtcaaaacttcggtgcctctgcttcttccctcctttaaatatcctcttcctcatttccccttctcaagagtcctgtggcctgccagcttttctggtcccccaggaatggtcttctctggtctgtgtccctcactccaggtctcccctgattttctgcaaatcaactcaagttttccctgtgttctgccctttcttctccctgccttgccacttcctctctttccagccaccctgaaaaatgaaaccaagctgaagtgttagaggctttccctctgctcatggtctcagcctcctcttccagaagtctaagagccctgggtgtctggagccctgggctgtggtcctggctcttccagccacttcatatgggccccgggcaagttgctgcatgctcttgggccatgctgtgttattgggttgcactgtaatctctagagttgttgacaggtctaacatagaggaggcctgagctctctgaggcaggcacagcccctcccctgatacatgtgacagccttctactctgcctgggaataggatcaggtctggggaagccatgtgctttgagaaggtgagtggtctggatctccaggagagagaggtcataaagggggagggccaggaaggggaggtgaaggttgtgtgcgtgtgtgcacacatgtgggtgtatgtgtgcatgtgtatacatgtgtgcaggtgtgtgcatgcatgtgtgcatgtatacatatgcatgcaggtgtgtgcattgtgtgtgtatgtgtgtgtgcatgctcatgtgtgtgttggagatgtggctgaggaaccagtgagagtaaactggatctacttaaagatgtcctgagagcatgggctggcagtaggtggggtgaggaaggagagctggtacagaaagaagggaaactacccctggggaaggcctcctcacccagccctgcttccacgacttgcctggaccctactcccaggaaggggctgtagcactggaactggaagaaagcctgagagtgagcaccaaggtagactctaggaatcacccaaaacagggagaccattttgtggactgttccacatctgtgtgctctatctgaggcgctccttttcaatacctacctgacacctgtggggactttgtacattcctccattgtcactcagggccctagttaattacctaaatgaaagttgagcgactactccctatgtgcaagacactgggcgaaggcccagggagaggagaggaaggaacaggagtctttgccctcctccagctgattctctacatgggactgacagcacatgaggaagcagaccaataaataatcacacatcatgataggtgccactcgatacacacaccagctgctgtgatgagcacagggtgcagggagagggtgtctgtgtaatttaggtagatggaaggcaggatctctttgtggaggtgacacatacactgagatgtatttttactgtgagctccttgagggcagaaaatgtgtcttactctacttttttttttttagatggagtctcactctgtcactcaggctggggtgcagtggcaggatcttggctcactgcagcctctgcctcctgtgttcaagcgattctcctgcctcagcttcctgagtagctggggctacaggtgcgcaccaccaaccctggctgattattattatttttttttgtatttttagtagagacagggtttcaccatgttggccaggctggtcttgaactcctgacctcaagtgatctgcctgccttggcctctcagagtgctgggattacaggcatgagccatcgtgcctggcttgtgtcttatttttatagctccagtgcttagaacaattctggcacttgtaagaaattggtattatttttatggtattcaatgactgtttgatgaataactgaatgatcactcatcagcagttcctatataaagcacatgtgcttaatcacatgaagacaatgatctcaaacaaatgtgatattgttatggctagtctgtctttacttcctcctttcttgcctgccctttgttgatttctgtttgtatctccttttgatggctcaattgtgttgggtccacacagtagaggacacacacgcacacacacacatacactctccatatattaccaaccacctccattcctgcaaagactgcagattctatccacgaagctattaagcactcccaaatagagcaaacctctcattgactatcacgtgcctccttaaatgatctttgaatagcattttctttttattgctttgtgtagtttaacggcaccaattgcaattactctaacttatgataaaccccagatctataaagctcctgttcattcattattttcctcttgctccttctcaagctgttattttttggaatgtagtgaggagggaggagtggagagagaagaaaataaaaggacaccaaattaacaggaaaacaaataaaatagggaagcacttctccctgggtgacaggcaccttattagatactgttaaacagaacaaatatgctttaatacagcacaagtaggtcttttatatttattctaaatgggaaatacaatgatcatcaacttatctttaagggaagaagaagctaattgttctaatatctcactaatcctagcaactgggagaaaaataattgtttttccctattttaccaattgttcaatttataccaaggtgtgttgtgtagcatggacagagatttctatttcttgatgtatgtcatggctgctattccattttaattattaatatgtggaaattataattattttgagtattggtatgagataattataaatataaaacagctccgcatgctttctgatgcctttcttatctgcagacatgttggagtttgggcgtatgagctttagagagagagaaatgtataatgtggtacttagggcagcaaggctggctggagtggaagaagaggagcttcctccctccagagccctccctctccttcacctctgccttccagctctccagagccaaagctgacccacctgtgtctctcctctgccccactgcctcaccctcctcttaccctgtctctgagttgttagttgagatttctaactcatcacacatgttggctcagcttgcatcccatcccctcatctcctcagccacccagaagctgaggtcagatatctggagctatgggtttcaattccagcccagctcctgactttttggcttccccaatccctacaaacctctttcgagcttctctaatgagcatcgccagcaagagaacatgtctattcagcaccacggacagaggcacgctgtcagttcccacaaattagaagttactgcctagcagtcttgtcaaggcagtggtgttggggagggaaggggaggctgagaaagagaaaagtcagtaaaggcaactgactagcaggacacagaaaatgcggcccccaactctggttgtactcagccatggggttcctacaaatgggaagtagctttttgatgctgttggcttcaggcaggcagcaaatgggggaggtgatcacttcctgtgcttaattgtgctggcctaactcttgtcagattgtcaccatgatgggtgctggaaacaggtccacagctggcaaagtctcaggcatggggagcgcatggggatgtggttgtcgtggtcggggttgggaggagagacagctgaggagcttggaaagagggcactgagaccatgctatggggatagagatggtagaaagaagcttcctccttcttgctggaatgggaatgaggagacatgggccctgggccctggaaggggaggggtccagcccatggcaagcatggctggtgggagccaaggcttcatttgtctgactttaatgaataaatggcatccccagccattgtttatctacttttgaatcctgacaaatagtctgtggcatctgatggagagggttattagctgcatggagacagatggctagggatggagaggattggttctttattacagcagacccgtaagtgacagcactcctcctcccagcctctatgccaatgtcaacacgtttctcaagccttcagtgacccaatgaagccagtgcaagaggaagacagaatggcctctgagtaagagggaggggtagggtcagtggagttgggaaagggggcaggtttcctagggtaagttctttgggaataaagacattgccatattcttctttggtattctcctaagtgcctgtatagtgctgtttattcaacaggcattcaagaaacatgagtgatggaggaggcaagtagagaggtctggattagaaatgaaaataggagcagatttaattgggctggctgtggggtggggtgcggaagaaatggtagggaagagagaggaagagaagtaggagacacaaagggagaagggaagattgcataaagaaaatgcccctgaatcagcatcctgtgtttcaggcattcactatgcttccccatgtgattgtacaaatggcttcatggaaaccaaactggtcttcccactgtccccttctgagaggtcccaggttcttattcctggttcctctgtcctgtggctgtaggggagagcttcctccctccagattactcccgagacaatggggaggttctcactgaccttcattcattctccgaaacttgtccttggccatgtagcccagcaccagacagcatcctctcttctggaggcccagctctggaagagaagcataggtgggtgagttgggaatgggaacaggtcaggcattgttggggggccctctgcagggggctgtggagcttgttgctcttataaacagaggtgcttttgtttagccaacatttatatggaaattgttatgttccaggcataagtttaagccagcaattcttcattttgattctcataacaaccctgtgaaggatgtttccccattttctatcatccccatttatagatatatgaagttagtggcactggatgaaagagctagcaggtggtaaagccagagctttgaacctaggcagtctggctctgagtccatgctcataaacataactctgggttattgaggccctttgtatctcaggcttggggactatgctcagatcaacttgggactgtggccagacctgccagggatgatgcagaatctatccagtcgtgtctaggatggaacagtgcaaccagacatggtgggtgactcaggaggatgaagtgattgcgtgagtttagggcagcggggcgacacagaggttaaggtataggcagaagagctctctctaccttttggagagggtgcgtttctggtgctagagattcctgtgccttcctatatcaaggcccaatttagcaccatcatcaagcacttatgaaatgtagacttagagcacaggggtcgagatagctgagagacacggactccacagggctttgacccagttggaaaaacaagatggaataacaattccaggtagcaaatgcaagagataacttttttatttgcacagtattttgtaaatcagtgtccattgtgtgtgtgagcattaaattggagtccatctgcctcacaagaaggcaagctttcctctctggtatttgtgctttatcctgattcatcttaatcactttatggatcctgaagcaatagcacactaatttttttgacccccctctacccccaaacaactcactgaggtgggcatatgggccactgcaactgacattatgcagatgggaaaattgaggttcaaccatgttaaatgacttcccacgattgtcttagacccccaccccaccttgtagcatagaagtcttacaaatgtgtcagctgccacaaacttggtaaatagataaggaatttgatttctggaagagggaatatgactgcagctcttcctggcccttgccagggtttctgggctcctccctgctccttcctttgatttctcagagaaagagggtcccaatgagtgatgcatcacagcaccttctcccacgacaccgactgcctccctgaacccagccagtcagtgtctaggctcaagaggatagacggagcgggtcattcctctttctcctcttccatccaccgtctgcagcccaggtccacccaccaagcatagcaggatgaaagagagtgcagggcccatgagacacagataagtcaagctcaggggctcttgccctagagaaaaacaaaacatggcaggaggtggcagaacgccacggcccagggaggtccctggctttgatctcctgattctttaaaggggtttattgactatcagtaaagagcagagaagcagatctgagggcactgtttccaaaggcactcacttctcttccttcccctccacactggcgtctgaaggcttagccaaaccgccctcacttcaaacggtcttacatctcaggcacccaaattgacgatgttaagttccctcattcaaggccttggccctttcttcaggggctcctgctctgtcgcaggcctcatggatcaaagcccctttgatgtttacttactgtatttgtggattctttctaacaaccaccttcaagaggcaggaatgcagccttccaggagggggccagtggaagtacaagctgcgaggaggtgctgagctccctggaacaatagcctctcgagggagactgtattgaaacctcaacacgctgacgacaggcagagttaaccagcccattgtaattgcacacgcattgttcatcattagaatgatacaattgctgacaattcctattatatttttgccattgacttcgtatgcccatctaaagcacatcagcaatggctcctaatgagaaagggagtttgggctcctggactaagcccaaactcaatccaggagcttgggagggaggcaggggagcactgagtagggagggcagaagatactggatggatttaggccaatgttccagctggtcttctggactgtgactgaacgctcaggcaaatggaagggcgaacaattctcttacagatttagagagtgtgagcaatctgttgactctggattgtcttagttggatagagaactcaacctctcctatgccacatactaggacaccccccagggcaactgcttgaggagaggctgtgtggacaagtggttatgatataataactaagagtctcactgattatgtttgatttttgcaaatgagcaggaaaagaagttttaaaaaacctgattaataaaagaaattgagaatgaggcaatttctcaatgtatttggctcatttaatttgacacgcgtgggttagtcttaattatttaggcggctacgttacaaggcgctaataagcacactgcagaaatttattaagtgcgagggctctctgactgagactttgtagagaagtggggagaagctactgggatctttgcaagaacgagcaggttggaggatgagtgaagtgagaattagttaattgtccatatatgaaaatttgggatgtcctttggagagatttgcaaagctaaattaaaggtcattgggttcacatgagtgtgccagcagggagtgaagtgggggaagggaggggatgctggaaacccaagtggggaggtgaatattgtccaagctactaaccacagagagaaccaggaggaagcaggaggcaattgctttggcttggggagactctaccaagccaaactaactaggttattaggagagagatgatagaacatgacagaaagaacaggaatctctctctttgtgaggtagatcagccaccaccagactgtcaccttccttgtcccatagcatggagatgaatgggagagtcagatcacagatgcacattttggaacagtaagatgatgggatcttctccaagtaggctttgggggtgctgtctttggctttatcagtagcagaaacacccagatactctaaagctggctatggaaaaataattaccatgaaaggagtcagccctggcttaaaaggaaagttcatagcaaggaagtccagggtcacctgcagatggggcagtggagggcactgtcccaggaacaaggaaggtttaggaataccacctgtgcaaggaaaaatggattggagtagggtatgtttcttagggagaagataagtttgcacccttgggaactcctggcctctggactctgagcaactgaagtgtcaggactgtgccttctcctgctctgagcccgtaggaccaagcacagtgcctgacacatggtaagtgctcaggaacagtctgctgacttaatgaaagggctggctacaaaatatgggactgtgaagggttccttctgactcgggtcagaatgaaaataagtgggcttcactgtagcacaatgggtttaggttagcagaggttggttgtagagtgaatgaaacttgtagctcattggaagagaagcctagataacatagtgggatttcctcctgggagaaataaaaggggatggctttttaaatgggatgggttttcttccatttcagagggtgcagatgggatgttttctagccttagaattccttcattcttactagtaatgtagtgatacggtggtattatttcatatttgtgggatacttattttttaatgacgctgtcatattccctttctctttagatgctcacagtaagtagctctgtgacacaggcaagtcagaaattatctatttcattttggtttcacaaactgaggctcagaagtaaagtgacaatttaaggccaacacactagctggtgatagtgcccatgctggaacccatggctgatttttggcttggttcttagggtaaagtacggggtcgcagagctgcagatgctgcaaatcaagacagaccagagactagagcacagatcagcggtgtgggctgggacagtgctataggtcgaattcctcaccaattctgtgttcccctcctgcaccaaattcgtacattgaagtcctaatcccagtccctcagagtgtgaccttgtttggagataggaaatttgtagaggtgatcatgttataatgaggtcattaggacggacctttatcctgtgactggtgtccttatgaagaggaaaatctagtgatagacacatatacagggagacgctgtaaaaacttgaagacagccatctgcaatccaaagagggtgcctgggacagatccttccctcccagccctcagaaggaaccaactctactgactttggacctccagtctccagaactgtgggacaatacatttctgttgtttaagccccacagctggtggtactttgtaacagcagccctagcaaatgaatatagacaggacagggaggagtgggtcttctctgaggcctggcaatttccactggccatggttctctggaacccagcccccagagcacaaagctgcctgcagggagcagcatcacactctgctaaggagaccccagggtggctaagatctgttgggagtggcggccacaagtgacaggaaagagggaaggtggggagagaaggctggttacgtgtctgcatgcctggcacccagcggcaagctgggatgccattagcattcctgcttccagggtgaggaccgtattggccaggacagcacttgctggttgcctggttgccctgttcagacattaatgtgccctcaagtaactgcagatggagccggtgacaacggataggcaccagcctctgctacctcaccatttctgaggccatcaagtgcatctggatggctgcttgtagaaggccttcctgtcctgtccccaagttgcccagtcacaacagttcaggtgtgcttgctgaagactaaccccttcccacctgaagctagtagactcgagcacgtctctggaagcctatcaaacaagaaacagaaattaatggcaggcagtttggtgtggctgtagcagaagaaaaaagatgagacaggagatctagccagggaccagatcctggagtagccaatgagcctcacccaggagtctgggctctctcttaaaggaggtgggagccacgcagaatgctaggcaggggaaagacaggtgagacttgcatttcataaaggatcccttcagcactggtgcagatgatggatgggagatgagctcagagaagggaggctggctgggagaccgctgccatactccaggtgggagatggtgggcttgcatctgctgcttcttcctgctctctgaagatggccagagatcagaaagcaagggaaggaccctcagttttatcctgacattcatccctgccacgttgacatagagagcaggggaggggctgaaaaaatagctcccattccccagacagtgcctgagatcatctggaggagacaccagctgggtttggttggactcacagggaggccacatggggcaggggaggtttcagaactaacagagctggctggagccatgctccagcacttaccagtgagcaactcttaggcttctctgagctttggtttcctcatttataaaacgttgattctaacggtaagaccctcctcacatgattcatatgaaaagcaaatgagccaacacatgggcaaaagtgcccagaatgaagtacctaataagggtgagttcaataaatagaaacaaaataccaaattctacccccctcgtttttttctttttcagatatgaaagtggagatgcagagaggtggagtgagctctccagggtgatataatgagctattaggttgcatacttcccaggttagcacgtagccaacagtgacatggactggaaatgtgaggccagtcaggaagaccagccaggtggctgtcatgggagaggccaaggaaccagagagcttgggaatggagaggaaatgatgaatcagagacattccaagaagagacagtggtgctaagtgacagagtgggtcaagcagaggaagagggcaaggatgaccccagtgtcttttgtgggatataatggacaaagagacatgtctgtatcagagtagggtgatgacaaaggaagcctattaagtcacaggtgataatggtacatttctggacttactgtgttcgaggtgacaaggttctaaagtgaagaggacttggatgatcatgtgagaaggagttctaggctgaagaaatatttttaaccagttgcgttgacctcagagggtaaacattttgttgggggaaacagcagttggatcctgtgggtagactctgctacaagcattaatcctacccctctggaaccaggacacattaataaatgtgactggtgtaaagtccaaggcacagacactcgcaaagaggccactaagtgctgggcactatgtgcaagagaaaaaaatagtaggcaaacttcctagcccaaagatactataatccagttggctatacaagacatatacttaagaaaaggtaactaaaagtcagagacaggtaatagttcggtaaagaaagtcttgaggcagcacgcaagttatttctgcatgaatggcaattcttactgcaggagtccccaggaggaaaagacagcttcaggctgtgggatggtgagggaggtccttgcaaaaggccttgaaagctggagattgtccctagttttgtcttagttttggatgtctaccaatggccctctcattggtttttgtctatcaatagccatcagtagccattctgcccagcgatgccattctgattgcagaatgatggggtcttctgtttggaaagttttcactttgattctgctaaactgctttctgcatcggttctgcctactcctattttcagcataattactcatatcccaggcaataataatgcccatacatcatgcaaagatcataattttctgatcaacctctatcataaagaggactgaagagtggagtagcaaaggtatattaatcctgactagtgcctggccctggacctccaggacgagtgataaatgtttaattagcccaataatacctgttttataatttttggatctcattgcttgctaattctaagtttactaaataactataaactttacgttgttgtaaagacataattgcttcttcattgcttatttcatatgagttaattatactagaactaagtttttccccattcatattatcaattagttgttttaaactattgatttgtatttaattaactatgctattacataccaattaaattcatataagaggaatctgaaacagctgtggtcttaaattacgtttttgaaataatgagttctataacatttcatgtcaagttattgtcagttaggaagagttgacaatcatttgtgataattccaaaaacttgttgtgacccgccagcccatctcaccagctccagcaggcagcaagcctccctcacacacctgctgatcacgtgccgatcagcaccttacagcttggtaagcagtggcagtgcctaacactgggataaccctttgccagccctgccttctccagcctgctccagccatgccattatttggctggcatagctctatcccccatgcggccaaggcaggcattatcagcaactcctcaccaccagctgtggggtctagaattatctgtgctgctatgtctcagatcctgtgtgcctgcaggaaatctacatgcccatgtggtcatctatccttcggcttctccaaatctctgctcactggcttaagtctgtacatctcaggtgggaaaaaagacagcagtcatttgctgagctgcaagggacatttaacttttctcatctcgtttcaccctcacaacacctttatgatcacaggtgttattctccttgttgttatttagcgagagattgacactttagaggagtgaggagtttgtcctgagtcccacagctggcaaatggtgaggcttgccgtacacctccatgttggtgcttgttggtgcgtcgtgccatgctctgtctccattctctgtgagattcgactcccaaccaattcggagtctcagccctttgggctggctttttgataccttgcctagctcttatcatctttctctccttggagggctgggttcctcccctaccctcagacactgcctgggatctttctcccaactgatgaattgcctggaattctgacacagccatcagctttctctggggcacttggccatcaacatgggacccaaggttggcagagctcaccccactcctctgtacactgaaagtgggacactggttactatctttgggggctgggtgcagcccagccttgcccctctcccttggccagcatcaccaagtgtctgccacctgggaccaggctcatgtagttcaccatcacaatgaaagctgccatgtgctgattgcttatgcttcattagtctctgggctgagcactttgcatgccttaccttctttattcctcatcaaaactctataaggtaagtgctgttattattcctatttgacagaagggaaaccgaggatccaaaaggttacaaaacttccccaaggtcacattgctagtaagtgctgaggttagtaaagctaatcatgaatgagattctttggacttccagtataatccgtttgtgagaggggtggggcggggggatgttaaataatgttggttaaagaattttacgggaaacagttttatcccatgtgcaaggatgcctcagcccgtctctgatttaacgtatctaattccaatgagttacttgctaggtgggggaacagagaaataggatcatgaaggccattcctgtcctccagtctgtcttccacacaccctgtgaggaacaggggctgccaaaagccatatgcctgagggctgttagacttttcctaacagaaagttggaagtcgtgactagtgtttgaatggggccagatgctcgacagctatgtgtcctacccctggggaggctcagcctggtccattcagtccatcatggctgggaggccaggcaggaaaaggcatttctgctttccttatttctagaaggaccaagagttcccaaaagactaagactgaaggcaataaggaggcaggcaaagtcccagcctgcctccaagtattcccttccccagcccctacagttctcttgaggccaagatctttgcaaagccagaggcccaataacaggttatacatacaagactgatttgtgaaattagtctttgcccagattagtgaatgtgtggattattagctttgctgtacaggtgaggctcagggaagccaagcaattttcctaaagtcacacaactgggaaatggacgacccaggattagaacccaggcccatttggttccagagcccaggcttgctgtgcccttcttccaggatgtggtcccaatgtcatgcacacagcccagctgaccagcagagaccccagtgggaagaggggaccccccccccgccaagcaggtgctgctgatggagtcacaggcatcactgtcaggtggtcaggagcactgagaagcccttgtgggagtgaggctcctggagagcccctttctcagggactggagaggcagggaggtggggtgaggtggggaagcgtggagaatgcctgcctactcagggtgtgcaggcagcaggggcggggctgctatttagtgatgggcttacaaaccttcttgtcacctatttatggcccacataaaactctgatcactgaggattaactgaagagggtcctagcagggccacacgctgactttaaagaattgatcactggagtcaggcagtcatgtccagcccctgccctcaagcccctcacatgctgccgaatgagtaggggtagggggagatgtctgctctcacttggcacaagggaagggggcagagagaagaacaaaatgtcctgcgagtggggagtgcagggtttttaggggtggagatgtgtgggctaaggtccagtgggctgggaatgccccctccacattctgggtggaaaagcggcacaggagggaggccaggggacagcacgtccttgcccccagccaagtcacagtcacagctgcctggttcacagtccagtgggcatgcgttgcctcgcggggtgggtcctgttcacccaggaatgctgcgcaccttcactggggtggaaggagggagggctctccagctctccttgctgtctctcctccctcacacgtttccgcagagaggactgtcctctagggcattgtaacttgggccaccttgggagctgaggctggtgaggagcagaggatgaggaactggtgagatctccccaacagcagagccaagcccaggcagctacccgcttcccccacccaccccagcccacacagcaaggagggaaagtaggcggtggggttaggagaggacccagcggaaaaggcagggaaccccgctgtcctcccattactgaaatcctccttgagccttacataccccattacgacgctgtatcctataattaaattgaatctgccagttacctctcagcacggcagcaattcaaactcattggaggctttgtttattttcatttatttatttatttagtaattatttatctagctatccagagagctagatggaggccctagcccaatgtttcttttgtcttcaaaaacaagaaagctcaaatgcagtctctcccacttcaggtcaagagaggaaaggaataacagagaccacagggtggcagcagatccgcggggggacctcttgctggggggatatcgctgggacagggttaaggtcaagattgcaggggaagttttgtctgcctgccagtcatggtctggaccctgctcctgattctacccattctattcttgtcagagatactttatggaaagtccacacattccagaaagctccatggaagccccttacaggccccagacaaggggcttcattctgagggactagaacatcggttgcggaatgtggaaaccaggttaactgagtattattggcaactaacacacctgcagagctttgcagttgaagaagtaaatacatgttcttctttaaccctaaacatttatggaggacactgaggatgagagaggttccacaacctcccttgctcaaaatcaccctgctgctaatggcagggctaggatttgaccacaacgcttggggtaaaaccaaactcccccacctccttcagagccccatatccaagctggtggcccagcaacaaaaatcaaagctcttttcttctctttaatgataacctttcagcagtgagtgggcaaaggagagcatgatggctttgagtatggaatcaacctcaaacaggtccaggggagcgattctgagccaccagccatcactcaataagaacatgaaagtttatttaccacgaggccagcccagtgggaggcagattgctactattagcatgccaaggactgcacagaccctgcacgtcaatagctgagccccagagaagtgaccccttttggggttatccaatctagcagccccaccagagcaaaggacgagggtggctgggatagtgtgtgcttacatgtgtgcacgcatttggagaaagggaaggaattccagacttgagatggctccttagacttaaatctcccttgaaaagaaaatgctgcttatgaaccacttccacccttgcctacctactcctgccaacccattcatttgtttattgatgagctgcttaatacttcttggaataggaatgaatagtacgagaaaatacctgggtccacactggcaattcctgggtctattctggaacaatcatgcttacaaggttttcggtgcacatgggaggtggggatcagtgtgtctctgggacctatttacccctatgaaccactggggttcttgactcaggctctgtcagtccacagagggtggttatggcaatgtggaggaggccggtggcccagggcctgaactgcaggagaatttatacttcttgttcatctggagaaagttctctggccagaggacacagtgagggagcctggtttaaaaaaaagaggcttaagctaagaagcccggggagtaggaagttctatgctaccctggcttgaagctttggacagtcggggcaggttctctcttggctcctgaggccaagagaagccagcctaggaaggttggaccattgatcccacagccctggggccttctcacagtagtgtgggtgtcacaaccacctcttagctcttgatcagagatatccaccttcagtctcctcaatgtgtacaatggagaggtcttgggctgcaataaggactggagataatgtatgtacaatactgggagggaagggtaaagagagttgtgttcctaaaccctgtctaaatgtatggaaccaaggccggacacattgtaagcccctataaatggtacttacttataaatataatatattattagaaagtacaggggtatgctaaaagtcaggaaaataataagatactctaagattagcctgaggaatccagttctgtagcttgaatagagactgctatgttgttggagttaatacccacagcagctcaaggaacagctttgttcagctctcagaggaaggggctgcctggtggctgtcctggggccgctgttccttctatcagggattctcacacccctctcaagcatcacatttcattcatagttcaagagcccccaagaatctcctctgtgtgtggccttctccacccctacccttgcagatgggcatcccctcctctggacaccaccccccgccaactgccttattcatacctcttcattcattcatacctttgctatgagactcccttatagatgcgaccacggttttgaatttttgctccaaccctcccagactgtgaggtgggaaccatctctattaatctctagaacctggctcagagccaggcacatagtaggcactcagtgcacatgtgtatgtgacgagtaactccacagacagggatgatctactctaatgttcaacagattaatatttgatttagcactgtgtgtcccttcaaaattctgggggccaagatgagggctgaggtctgagatctctgctggtttgagaatgggacttcctcctaccttcatttgtccttccttttacagaactataagtcagcctcaggtatgggtcagctttatgtagttaaccttccagtcattcaggtttttatctttgagtttattctaatttcattcattcattctcattcattcattcattcattcaaggagagctcactctgtgtcagttctggctgttatggatattgtgatgaacaagacagagaagaatttttgccttcccaagcttccattttagacagcttctatgtagttcctttcccttacacgtaatttagaggtaggaagtttcatgtgggtttgggcaaattattaaacatccctggacctcagcatctccatcttcaaaatgctgtcaccaaaccctctctcaggctggcagtgtgccacccaccacagcttggccttgcatggctggtgcttggtaccaccagttggtttgaatgtgggtgcacgtgcatgtatgagttcattaatttgcttcctttcttctcaggcacttagatttttgatgcacactgagagggtcctttttaatcagctgaggagcaagggattcctgagccacaaatgaggctctccctactggaatgcagaaggaaggacaagagatgagcctttactgagatgctgctatctgctgggcactttacacacacacagttatgccatttagtccacactgtaactggggagggagttgttgcttcctgtgcttctcatatgagaaaactgaggctgagagaggctcaagggctcccataactgaagacccgtgccttcgctgctgccactcaacctctgggtgggggatggggtgctcagtccacgtggaaggaagagagaaatagaatgtcacagagctctctttcaataaagggctcagcaaaatgtttgtcttagccgcgtttcctatcgacccggtgtgtggcacatggattaagtatgcagtttggtggtctttaaaggatgaacattttctctaggatcaataagctgagtgagtttgggtctgaattcatcaaaatgtcacctgaaacaaattcagtatcaggacttctgcgctcaggtcaggtcgatgggtgggggcagagacaaaacccagggaataccaggtctctgggaaaaaggtccagggcatctgttggacaaatttgggtctgataactcagagtggggagggggtcctagctggcaaccagcatcctagaaactaaccgctggcctggtacagtggcttatgcttgtaatcccagcactttgggaggccgaggcaggtggatcacctgaggtcaggagatcgagaccagcctggccaatgtggcgaaaccctgtctctactaaaaatacaaaaaaaaaaaaaaaaaagattagcggggcgtggtggcaggtgcctgtaaccccagctattcgggaggctgaggcagaagaatggcttgaacccgggaagcggaggttgcagtgagctgagattgtgccactgcactccagcctaggcaacagagtaagactctgtctcaattaaaaaaaaaaaagacactaaccgtcctttctctggtctagacgtcatccttaccttcagagagaatagctgagtgagaagctgtgtgaaactgcccagttctagattcttcgaacaaaaagtgtttttgaggttaatcagtgccattctcacacccagtgctaaaggattccccctttagcaccttggagaagtagtcacactggtttcccttggatcgttctaaagacagggagctcattactttggaagctgtggttttcatttttggagagtttaaataattttagagttcttctatgttgagcttaaatattccctacagccttgcaactttgcctcattagtcccaaatttgcactgtgaggcaacacagaatgagactaatccctcttccacccaactactgagaagtttaacagacaatcttttcttttccaaaataaacaacccttaggatgtttcggtcctgggatgcttgcagcccaggaaatgctccctccctctcccctccagcttctctgcaaatgcaagactctggcttcattccctggtccttcctcagtatctcacaaagaaagaggagggcaaaatgggaattcattggaagagatccttggttcacacgctaggaaagaaaagggatgatcttggtcttggcgtgaacttccacatgaacgtgactccgtgcctacctgctaataagagcgggagtgtggattgtgcacataggtggggacggggtgagaacttggggtgtggcgtgtccctgtgggtggacacattgtgaacagtaagtatcatgaatgtgtgacagcatgtggggcacgtgggtgagcgtgtatgcatgtacacaggctgtctgctcaggtcctgggggagggactcagaatccgcctcacacccatggagagttctcgcaatgggtatggcaaacttcctgaccaacaggcttctggacttctgactcagcaccagtcctgctccttctgtctcaatgactgtcccctgtccctggagatgtaaaagttccaggctctcctaccacacctaggctggacttactgattccaaggtgaaaataagccatcacgtattgaccatctgtcagcaagtatctaccctgcaaaatacttttcacacactctctcacttatcctcaccatgcctagagatgggactttgtctccatgtgacttatgaagacactgaggaccagcaaggcgagacaactgtttgaggccacacagcaacagaaccagacctcgatcaaacccaaagcccgtgctctgtccgtgtgctgcctccgagaagccatggccaagaaaggtctttgcaccagagctcaccaatgtctcggagaggtcctcccttcctgccagccattgatgatcctggaggatgaacgggtcgtctaaaacagatgacgctggtgcgggccccagggagttccaccaagagccttaggatttatcatgtgggagggtagttagttcccaaacgcaggtgagtataaaatccaatttcttaaattgcatccagggccaaggggtgcaagctgctctgtcagttatgacttcctcgggtacctgagactgtagctcctcatttcctaaatcctcctgcttgttgtctgagcttttagccctctgatttacttattagatttctactgtgccttttctctgcagagtgctcagtgtccccaggaaccactctctaatttaacgaataacttctctcatgagcaaatggggtccgggttcatgcaagaagccagtggaagaggagaactggggagacagagagtgagaaaaggggcagaaaaaacagggcagggtacaaaggaggcaaatgcaccacctgtggccctagagtggggagcattgaggttggatggcatttgtatctagagttgcacctggatctggacaatgcttccaggttaccactgctggtaagcaatgtgcccaaccaccctctctgctctcatgaccccctgcctctctccacctctgcgtgatgtttttctgttcgcctgtctgtctccttgaattgtgaggtccttaaaagagggagccaagtcattttttttttttgaggcagagtcttgctctgtcacccaggctggagtgcagtggcacaatcttggctcactggaagctccacctcctggattcacgccattctcctgcctcagcctcccgagtagctgggactataggcgcccgccaccatgccaagctaattttttgtatttttagtagagacggggtttcaccgtgttagccaggatggtctcgatctcctgacctcgtgatccacccacctctgcctcccaaagtgctgggattacaggcgtgagccaccacacctggcccccagtcatcttttaacacctggcacttgtcactgtgtctggtccacagtaggaatttaacacatacttgctggagaggccagttacggggcacagctgaaagcataaagatgcactgtataacatttcagcccccagaggacccacagttggggagacaaaggatagccaaagacaccatggctgggctggccagggaggtcttcgtggaggaggctggactatactgggccacctagaatgctggggactggtgaaccggacagcaggaggacattctaggaggaggaatggcttgagccaagggttcaggttgcgatgggcaagggggtccctgagtggaaggcaggacctgtgcagggaagtctagaaaggtcagtggaggcataccgtggagggctttgagcacagagggtggagcctggaatttcttctcctgtgatggagcctctagttcgccctggcccagccccatgtgctgtctggcacatttgtgcactgccctcctgcaggagggggcctggcacagtttctgtgcaccctggacaagcagggccacgtgtgggccaggactgctctgccctgtcttctcctctgattcaggaaggaagaacttgccctggactctgtctgtctaaaataacctcccctccccatccccacatggccctacctgttcccggaatttcctgttttttttttttttttcttccttgactttacagtctccgggttgcacttgaatctcaatggcatcatcccctttcagtctttgcatgtgcttcataaagaaatgactcttttgtgcagatccactgcctatggtgaagtaggtgctcatgtaaatgccaggtcctagctctggaaagggttagacagcccttctcaaaccatgcctgcaatgccagtttaaagaacatggaggcaggacagcagccatgggaatgaagggtggcagataaaatcagtgccccagaagctctggggcctcctctcattgattaaattttcaaatataattttgctatagttagtggggggtttagagctggtcacattatattgaatttttttttgagacagagtctcactctgttgcccaggctggagtgcagtggtgcaatctcagctcactgcaacctctacctcctgggttcaagtgattttcccacctcagcctcctgagtagctggggttacaggcacccgccatcatgcctggctaatttttgtatttttgtagagacagggtttcaccttgttgaccaggctggtcataaactcctgacctcaggtgatctgccctcctcagcctcccaaagtgctgggattataggcgtgagacaccgcgcctggcctatattcaattttaaaactttcatttatttttaaaattgaaactaaaagttgtagatctatttatggtatacaagacattttgataaaagcatacattgtggaatgaatacatcaatgaattaacatatccattacctcacatatgtatcattttttttttgtgcatggtgagaacatttaaaacctattctctgagcaatttccaattataggatacactgttattaactgtaatcaccatgtcctgtaatagacaggagtctcctcttgaaccagggttatgtctcagaaccagagtaggaggagaagcacctcacacacgagaggctctgctgtcctgacgtggcacggaagggaatggaagggacaaggggaaggtgctggaaaggggccagctatgaactgagcacaggtaacagaccacacctgacctcctggatccctagttacacaagggcatgtattcattgttccattccacagatgggaaaacagagactcctggggcttaagcagcctgcccagggtcacacggctatgtgacagaagggctggaacctagatcctcccaccccaaagccaggctcctccctgtgatctggccctggttttgcctgtgtgattcctctggccttactgggtgatactgagccaatcgtggagcctctctgggcttttgtcttctcatctctcaagcgaggggcatactctcaactgagcattctttgcatggcctgtcctctcagtcaggccagaccaggaccagctcctgccattgtgcattgcaaggatgcactgcttgctagtgggcctgagattcaccagtggcaacacagaggtgccttcaccagccttgctaagctctggtttgtgtttctgcctctggtgtttggtatcagaacgcattcccctgatgctgccggaagcaataatccagacacggttcgggggtttagtggaaatcctctgctatagcggaagaaaatgaaacccagtgaagcaaggatttcggcagatgcaaaaatctgcccatttacctccccagtctgaattccacggcagggacagctgagaagcaggcggatggatgaccttagctgcaggtcaggtggggaaggggtgagaactgagttcagaagactggggcttctgcaggtctaaagccccatgaggatgggaggggaaggtcaccgagtatttgcaaacatgttgtaagatcaggattgaccttaattgagtgctgactgttaaaggccagtgcttcgtgcagcaacatattttccttttaagcccttgcaacactgacgtattgaagaagtactaaagaagtattatccttaattatctgatgcactgaagaagtattatccttaattatctgaggtactgaagaagtattatccttaatattggtatgagggcttagatagcctaagtgacttgcccaaagctacacagtcagtaaatggcagagcacagcagaaatgctcactgctaacagatggacactgctatctgttcttgatactcagaccctcccatctctcccatccacaccagttacccaccatcatggaaacatgtggttccggatgtggacagctggctccccgggccccatacctcctgtgtgctcctggagccttctccatctgacacaccatgtcagatgtggtcctggaccttcctgctatcctcagctcactgtggactgtttctgagccaagggtattgtgtggttaccagggaaaatatgcccccgctctaggcctgccagcagctctagggcaataagccatctttctaaaatgagatttcctatttcagggactctgaaatctccagttctgccaaacagcaggtcttctcctcagcttaagatagctgggatcatggctgaggttgagctggtcacagaccatcccccactgaaccaatgataacaccctgccaagggcctcagcacgagcaccaggagcttctctgttcacatatttacatatcaagatagaaaatgaatatacgaaggagtctagcatgaggaggacgggatgcgctgtggagttagacacacttaggttcaaatcccagcgttgtcacttattaattgtgggaccccgggcaagacatttaactcctctgtgagcctgcttccttctttgtaaaatgcaaagaatgatcccatctacctcgaggagctgctatggggataaaggagagcaagccctcagtacggtgcctggcacgcagcgaggactccctaaatggaggctcctgctgtcacgaccctcgcccggggaaatgcctgtcttctccatttagaaagtgacagctgacggcaggcccgaggcagccaggtagggaggctgcctgtgtgcaacccgctgtggaggctgctggtggctgcaggctttcagaaggcattacaggccattgttttaatcaatactatattatttcctccgcggcaactatccccatgtttattatgtgtaaatagggtttttcaatgatgtgaatgtgttagcttaacgtagctgacattcagcgtgcacaatctggtggctgcccctcaggacttccaggaaaatgagatgatgtatccgtcacaaagccatcctcgtgagtaaaatttgagcagtggcagcagccagggcacccgatgaattctgcaggcgtgggctgcgtgcttgagaaggaaaacagacatcaacatagcctgggagcacagtctgcaggcagtgtggacagttggtgccccggaattagggcgttggcgttcccatctctttgctgccatatctagatcctatacagcttattccaacacctctccattgcctggcgagcgcctgtggatgcactcttctgcctactcctggaacttgtcaaggtttgccctctctgactgtagctcctcactctcctggactctaggatgggcccctttcttccccatacaaagcccccagtagtctgaaaactcatttttgtctatgctcctcagttcagcccaggcatgtgggtatgaccgagcctggctgcaaaggcaggcagaggggagcaaaggtggtctttctcaatgtcccatgtgggcttaactttcctcctcctgtaccagggcactcagagtaacaccaccaatgacactaccagcttctctctggtgtctaactggactgaaggtgaagcaggtggggtgtcgtttagatctggggcagagcttccccactgtgacacccttgaagttgcaggccagatgccactaccacacatgggtcactgtcaacaggccacaaccccaatgatgggcacttaactcaataataccagatatcagacaactgtggcttcatctgtagagctctctggagtgcatcataaaggaagtaacctttttcttttttctttgcttttctttttttttttattttgagacagagtctcactctgtcgcccaggctggagtgcagtggcgcaatctcggctcactgcaagctccgcctcccgggtttacgccattctcctgcctcagcctccggagcagctgggactaacaggcgcccgccaccacgcccggctaattttttgtatttttagtagggacggggtttcatcttgttagccaggatggtctcgatctcctgacctcgcgatccgtcagccttggccttccaaagtgctgggattacaggcgtgagccaccgcgcccggcctctttttttttttttttttttttttttttgagatagagtctctgttagccaggctggggtgcaatggtgcaatggcgagatctcggctcactgcaacctctgcctccctgattcaagtgattcttttgccacagcctccccagtagctgggattactggcactcaccaccacgcccggctacattttgtattttcagtagagatgggttttcaacctgcgggccaggctgctctcgaattcctgacctcgtgtgatccgcccgcctcagcctcccaaagtgttggaatcacaggcatgagccaccgcgcccggccaggaattaaccttcaccaggatagtttgtggaattttatcaagaggcttcgctcccatctcctgctttcttaacagagtttggaagcagcggaccggataggaaaactgcttagggttccaccctcatgccaagtggcagaggccccgggggaagcctcctgcggaacgtgggaacaaagggatgcggggcctagcactctacgccggtgtctgttcgtctgtccagaaggcttgtcacactctgggggggcatctagctaaaaggtactccatcaatgtaaacgaccgtcgctctcgttaagttccatctgtgtgtcttaaagctcccgcacggaacgtgattggagttgggcttcagcttccctgtgctgcctgagacagaggagggagatgtttttcttggcaaataaatatgatatcataagccctggcaggattccagcctgagtaatggccgtctgccttcctaattccctcagcagcttggaacaggaacattactctttacttcctctctttaaaaacaaactctctattggagcgcattactcagccacaggatccctccccggacgtggcggcattcagatgatgggaggtgaggaatgagctcagattacagcgcacattagggaaaacacagcaaggcatttggcccagaaaaggcacctgaggaccttgaattagagcggccactcctcatgtgtccttgttcatgaggaacatagagctaaaatcaataaaaatcacattgtttagcgctgccgtttccctggtttaaatcatgaaggagtaagtaggtaattaggtaatccagctcggactggatagttaccttcaagtacgaagcggtcttgctgagaccctctcactgaacgcgagctgggggaagggtctcgtggcctctctactcacaggagcactgctgcctctaagcacataccccgccctctttctgcttgtcattagttcttcctaacaacagttagaggcatcggtgttgttactttccattttataaacccgaggctcagtgagactaattaggtaactcgttcagggccataaattatacatagcagaagtcagagttgaactcgggtcttttggcttcagattcaatgtttacaacgccacatcaagcctcatcactttctctggcctgtgaggacttgggtgctgccacttgtcccttttgaagtagcggatacaaggtggcaccgtgaaggcactgggtcaggagctgggacacagctttgcatcacttgggcactgttctgctggggcctccttggtaaccaaccatccaggtgaggataaaaactgacccagcttgtagagagatcttgaggcaggcatgcagcaagggccctaaaattactgggagaagggcaagtcactgttcgaaggcttgggatggtgaattcagccaataaacgtcctttgaacacttactatggctaagcatgggggcacaactgtaaaccagagagagtccctgcctcagggagctgggagtcagtgggagagatgaataaacaggcaacgacgatgcagtgtgatggatgctccagtggaagagtccagagcaccgggatgatgtgtagggagagccactcaccagacatggcagttcttggaaaatgtccactggggacatgacatccaagctgaaacccgaaggacaaataggggacagggagatgaagacgggggctgcagagcgttccaggctgtggaggcagcgtgtgcaaaggctgggaggtcagaaagaacacactctgctccggtgatggcatgtttggtctggcctggagcagagctgcaggggaagctgtgaggcatgaggcagagaggtaagccaggagtagtttgcagacccctggctgggcagctttccaatctggaacagtgggtcatggagccatcacattcccaaacccacagcgcttccctctcaccaaccctgtagcctgcagtcttcactgtgctctcgactcccccagcctttcattgtatgtggaagaggagccagaaatgcacccaaactgaaagaggagcacgcagcaccaatccctgaatcaaaataaaaatccggctgcactttatctcgctgaaggactgtaatctgggagatattcatttaacatatttctgtctctgaatggcttttacttttcactaaattgaaaccgcagtacaatatatgtgaatgattaggttgtgtaatacattccagcaaatttagattaggaatgattatgacttaagtaaaatagttgaacacaattcttattgccatctatcttttcacttctttttagttttcatgagagtgagtgaatgcaaggaatgaatgactctaaggagagctgggccctggtacagggaggggcagaggtctgtctttggaaggctttaggaagaagggagaggtggactggaagactcagatctagggctcgggggaaagcattgggccatgaggtagattggggacaagtcctatatctgccgtttgctagctgtgtgacctcaggcaagttacttaaactctctagtcttagtttcccatcagcaaaatgggctttattgttccccggctcatggaatcattgtgggacacaatgagatcagggacatgagagtaacactggccaagagctcagatggggagtcaaagtcctgatcaaagtctggctctatcacttattagagctgtgtggccttgccctttgatactcagcttctctgagccccagtttcctaatccacaaaatgggaataagtgtactcagccacaggtatccttgaagagaggcttaaataggatttttttgcatgttaatagtgctttgcaaaatgcaagttacctgggagggctatgctggctgataggggtgggaataggaattggggactcccctttcctgggatagcgacctggaggggtttgggtggagccttgctgcgggccctgaggcagggaggggaaggagaggaggagtccttgccaaaatttccctttggagtcctaagccttgcacgcgccctgggcactccaatcctcctcactccactgctctattttccccatagcattgaacatgctgtaacattctatataatttaccaatttattatgcttttgtttagaatctgtttccctggttcaaaggtaaggcctacaagggcagggagctgtttaatcccctgataaatcccaagcacctagagcacagcttggcagttaggaggcatgctcaggaaatatacgtcaaatgaatggatttatgagtagggctggaattctgtctcctgagaacaagtgagctgaggtgggaagaaggtggcggtggtggggggaccaggggagacgagggcatcagtcactccagcagggagcttgctgcagggagaaagagagaacagcaatttgggccgtgaagcctggcactcattcttcaagggggctgcaagcccccaggattttcctggaacccagggcacccgcacactagctgcctctcccggtcccttccagcaacctgaggaaatgccttccaatcagagcaattactgctgccctggagccgctgcctctccaggtgtctgcctcctgcggctctggctggagacaatatttctcctctgttcatcacgagaacagggacaacaaataacacaatggcagatgaagggccctccaagccctccagagctgaaagagtctgggctgttggcagcgtctgcgtgcaggggaacagaagctacaacctgcgtggggtgtggggatgactgactcttcctggatgggggcactgtggccagctttgtccgggaactgtgctgctcctggtccaggcaggcagggctgtggcagccgccctccgcccgcccaccagcaggcagggactcagggcaccatgggcttgggaaactgagagagagctatgtgtgtcagttgtcttgttaagttttttccccttggtcttaaccatgtaggtactcttgtgttcaaaggaggaaatggaatctcagagaggctgagtcactggtgcatagtaacacagctcatcacacagcagtgctgggataagtgctcccatgtttctgaacccaaagcacatctcgtcgctctggcactgagtgatccgtgacacagatgtacctatagggcgtgagtgcagccccttacctctcagcctcagtttccctactagtgcaccagtcactgaagcttgggaggtgtgtcagtgactcaacccactttatcctgccacctcacctgaccttgctggcatttcatccctgcctcctggggctggggctggatcttgcctagtgccccagctgctggctgaggctctactcagttactcctgaacgctcctctttctactgtgccccatccttaggagcaggggctccctctgaataccagccagggccactgcagcagaacatgccacagtcctttgaaagctgatctcaacaccagtatggatactaactctggctttcattgttgagcatttgttgagctcaaatgtaaacccaggaaccagattctgagggctgcatacctaaccattatacaggcctgcctcttcctcatttgacatggtcttttgaccttaactaccttggttattcgttttgttaataccccctttcaaattgatttctagaactgaacccaaaattccagatgtagcctgatcaagcaaagcctagaagaagaacatcacctccctctgttttaaaaattgctttgcaattaatgcagtctaagattacacccactttcctgggcccccagctcccagagtcgactcctatggggctcttcagccagccctgtctacagggctctgccttaaatccctaagtcttctagaaactagctgctgtggcagaccttttgtgtggctgagatctgcaacaccccagcggtccccacctcaagggctgtgtctgccgtggctgcatgcggccctgctgtggctcactgtggacacagcagacgaaagagaacatggtctcagctaagtggggggctggaaggaggagaaatggtctgtgaaggtcactgccactgtacggtgagtgatctgtccccatttcagcctcagtgggagagtgatggagggtgtaattagggcttgagctgtgcctgtgggggctgctgcaccaggctcaaggaggctggggacacagctggtagtctctgccctcctagataccttggtagcgggagccgcccttcttgggaccactccctcgctggccatcccagccaggtcttccatccctgttctccccaccccttctctcctcaaaatttgtcctgtatgtctcatttcacccattctcttgaggatttgccttattagaaagtgatctggctgggtgcggtggctcacacctataatcccagcactttgggaggccgctgaggcgggcagatcacttgagcccaggagtttgagaccagcctgggttacacggtaaaattacgtctctactaaaaatacaaaaattagctgggcacggtggtgtgtgcctgtagtcccagctccttgggagtctgaggcaggaggatcgcttgagcccgggtggaggaggttgcagtgagccgttattggaccactgtactccagcctgggtgacagagggagatcctgtctctcccacacctgcaccccaaaagtgatctgattcaaatgctgtattaagatgttaacatctaacgactggctggacgcttgtaaccaggtgtattccacaggtaacaatccttcaccaagagaatcccttaacctaaaggcatacatcccttagggtgaaatcctgtgtgttctggtgggaggtttgtgcaaggttggccccggctggttataacagccagggcattactgcacatgtaacctgcacttcccagtgatgaggaaatggcagctcagagggcttctacatcttgcccaagatctcagacatgctcttcctgtccagccttgtgtataccagccatgctctgccttgcacctggacctgaggtcagctctgggggccccatcagggtggtagtgcttctagaaggatctggctgttcagagaaagctctctgtcctgaaggcctgaactgggtgaggaacaggagcactataaatattgctacaatttcttcatcacctgccatgtcctagatactaagttaggctctttacagctcataccgtgttgtcatacgtatgaccatgctctgttttaccagtaaggaaactgaagttcagaaagtttaagtaacttacacttggccactaagcaggaagtcctggcagggggaaaggcaggcctgagtcagcctgcctttgggccctctcaccacccctggagcccaagcaacataggcctctcatagggccaacagctcccacccctatcacatccttcagggtgcagtgccacggctgggggtcgcttgcctttggactctccagagaggagtccctgggacagctgaggccttgctcacagccctaggtgggccaggaaataacattccagggccttttgtcgagcccctgggatggggacttgcatgtgctgggtgcctatgatgcctcaggccttgttctaggtactttccgaacagttattgtcgtaatccttataacaacaccataacttaatccttataacaacacaatactataaaggtatcattgttccctttatatggatgagaaatactatgtcttaatccctataatactatgtcttattatacaatgctaggtctgaatccttataacaacacagtactataaaggtaccattgttccctttatatggaggagaaaagcaaggccaagggaagtctaaagttacatagctaagaaagtggaaggagctgagatctgacagtttccagcgattccaaactcaggctctttctcctacaccctgtagcttctccaagaagattggggtctaaaggggcagagctttctccaggagcttctggtccattgagggagatggaatacatcaggatggaaaggaccatggcaaaaaacccacacagtacactctgcatgcctgctgtgcgggaaacagcgcgcctggggccagagggaagggaggagggagccagggtggggagcccaggaggcacatcaggggaggccttggggaagatgtgagtttggcaccagtcgcaggtaaggcctttttctgtgtgctctgggaagagaaagctattgagctgggtgtggtcacagcagggaagggctgggagcaagacactctcagctcaggcagaaaaggcctgttgttgagagaaccgatgcaggctgccgctgggagcagagggctgggcgtggcgtacctttctttcctgtgagggggctaggagctggctggggtgggagggctgaggggagcaggcacatggtccagccacgttaggaggcttgcacaaagggcttctaggcctgaagcctccagctcccaccccgtcagccgacttgcagattgtctgaatgggtctccaataggaaaaaagccagggctttggagaaacagatgcttaccacggaaccaggatgctgtcgtctgcaggtcacccctgtgtggatacagaccgtgggccaggaggctcttcagagcagttctcccacagctcatcctgtaattgactgactcatcggtcactgcttgcgcgctcagccattgttaactggtgacttgaaaattacctttatttagcaccgttatcgggaggcttcaggggcgccagcatttccacgccaccagctctctctggctgatggcagcaagcagcctcatcacactgtccccagctctaagccacagccactccctacccactgtggggaccagggaggggccctcgtgctaagtggatgcagtaggcaggccagtacctcccaacctgctgtgaccccctctgggtacaggtgggcaatgaacacccggctggacctgtggcctgctgtctgttctcctctgacttgcttgtctgctgatcatttctccatagccacgttgccctgtatgcatgagacaatctggaatgggggtcatccatggggtctgggcctgcacggagtggagttaattgcagaacttgtgcaattccttaattctgagtgaacgtgcatataagccttagggagagagaacattcatagcttttagtagattctcaagaggatttgtgagccctaggaagctgggaagccaggttctgagtcatggttctcagatcacccctccaggaagctgctcaggttagcccattgcaccgttgccatcactgcgagactcagggggtccagtggtgcaatacaactgtccccctccacccagagggcaaggccaggtctgtactctgctcagtggtggatgcagatgacaaatcacaaagagagaacaaagagatgacatttgcagaaactcctgcctttcactttctgctttattggggaaaagaaatcacatccccaggctcccttccctctgtccattggcacagtgtatcctcctcccatcctccacccctccctcctggtcacaggttctgccctgagatctgaagtaagctgtgggactcatctacctggagaagaaggcaggcagaagaggaagggagggaaggatggaggagctggtgaaaactaacagtaaggtgaagggtagggctgggggctgggtcggagccacaggattcatggcgtactgtgatttttttgttgttgctatggtcctttctacctggatgaattccatctccctcactggaccagaagctcctcgaggaaactctgcgccctttagactccaatcttcttggagaagctacagggtgtaggagaaagaacatgagtttggaatcgctggaaactgtcaaatctcagctccttccacttttttcgctgtgtaactttagaattcctttagcctcgtttttccttctttctttccacatagcatggggccttcaactgctggagggtctgggcggtcatttatccttgctgggcctcagaggcctcatgagtggtgcctttaagagtgcaatgaggccgcagcagaaactatctctaaggccagctcttaaattctctaacccatgctcctggccaactctcctctgtccagccgcaggtcctcatagaaaggcagagacactgaatagaacatagaaggggttgttttcctaaagctcatataaaattctgaagcctcagcgatggaacctgcatttgggagctgctcgatcttttctgttagcatttccgccacgtgcttctcagcgttttgccccagttggccttccgcccctgggagggggaacaatgtctcctggtgaaagtcactttgcagctgccctgggccctcggaccctcaggggccttctgggttgtgaggcgtggggcaccccgtcctgagcgtgccctgaagatgggcacagagctcccccagctgccgtggcactgtttccatgcagctgtggggatggtgacaaggcctgagggctgtcagcccggctgagagcactcaagagccacttcaccggccttcttttctctttccaaggctcttaacccacttgtggagggggtggcgggtgaggggctgaagagggtggatgtccactttgggcagacaaaggagctgcagtcagcctcctctccagcctggctctggagaaatgcagtcagcctcccctccagcctggctccagagatccggagctgagggcagtgtaggagctggcagggcccttggcaaagtggagcccagcaggctagttgtcccaggtttatcgcccaggattggggggctctgtgtggctcctgtcttagctgatgactcagatcttggactatttctcccttatcaaggtcttcctcatcctaaacttggccttgatttgagcctctttagtttaccaagtgtttacctgaattatctcatttaatttcacagcaaccggtaagggatgcattgtgagcatcatcttactgaggactcagtggctatgactcaggactgtgtcctttgcctaaggaaggccacacagctagtcagtggcagagataggactagaatgagttctttttctcccagggagacccagtggccagaaggcacctgcagccaggccacaccgcccccttaggagcgatgggggacagcaagaactgacaagccctgatggcatacaaagcctccaggtgaccagcagtgacagacgccagccaggacatcctttccagaaccttctctagctctgctggcataagcagcacctggttttcaaaggctttctttggtgtgtgtctatggtcataaagaattgtaataaacaatgattaagggtcacaatataggctggtgctgtgtttcctcccttaggagcagaggaaagtggttgaggtctccaagcaggtggggagcccttggcccctaggaaggcaggaaagtctcccaggataaatctgtctgttctaggctctggtgaacccaacggaaagccctacgagcctggctggtggctgagctgccttctccataggctgttcaccaatctcgagagtcacctgccatgaagtcccaggagttctgacatccagtgttcatgcccatggagcaaccaacaagaatgttctgttcactgccgcatccttagatctaacacagcacctggcatatggtagatgttgagtacattgtcaaacaaacgtaagtgaaaggaaacctacaagatcatcatctgcagataagtcacaaattattagccctatttttagaggtggtagtgaggcccagagaggtaaagtaacatgcccaatgtcacacagccagttagtgagggaagtgccagactctaggtctcctttcactatactctgtcccttctgaaggggggaaggtaggaatgtgatgacctcggccccagggccaagatatgttcttgccatgtttcttagctgcattgagttgacagtgatctgatgtggctaggtaatgaagagatggtttttctctgggaagtgactctgctccctgacttctggcaggcatgcgggagtggggaggaggtatctctgtgtggagctctacattctgtcttaggagcacaaagctcttcacagctcacctacgcatcttgagcccagctttcttcttccaggaagggggaatgaaagcaactattaataaggtaataagaactgaatcaaccatccagcctggtcttccagaagagtttgatggcctctagccttgggcaagagagacagagcccgggctgcagtttcctggcctaaaggatgagtgtctgcagatccatctaccagtttctagaatctttaaagcagcaggaggaagcaggatggggcattatatgggctctagtctctttacaaagtcattcagaggaaaacagggacctaggagaattttggagtgtggtagccagacagacctctcagaaattcccttgatttacactagccatcaccaaaatccctgtgtctccattctctccctttggagggccgttcccagcacgagttacccagaactacccacccaatcagagcccttggctctctgtggcagggggccctctctggtcaagagcagcctcgctggtcctggagcctgggccagagcccgcctgtcactctgcagctccgcaatgtcgggacaccaaagggcagtgccagtagcccgctgcaagctgacaaggctgagttcacatcagtgctgaggagtcgacaggaccatctgaattaagtggccaagtttagtttttaattaagtccccgtggtcttttaaaaaggtcactgacgacaccatcttctttaaggccaatatgaaaagacattcaaagtcaaagttctgagatgggagccttgtaacttgaaatgtcacaggaagaaatttggaaacagggaaagaggaagctggtgggaaggacaaccctgtcacattcttttgccgtcagcttcacagttcccacttggagctccaaactatttcggtctcaaagggcaagtggtcccaaggttctctcgagtgccttccccgacagaggattgtggagcctcttgtttgctgtgccagtgaaaaacagagcccttgtggtccctgacacggaataaaagttgatagcaatggggcagaatgtggcaacttacccctgatggctgaggaattaacaaaaatgtatgcaattggtcaccatcctctgcacccattcctgtcttcacttttctacctaccttgatcagtactgtatcatttggaagtacagttctgtctaaaacagagcacagcagccacttaagtcacccatagcatcctatgaggattgtacagtgagagcaaagacctgtgcctggcttagacccctaagagaagtagagacttgaggtaatttgagcagagtggaccacacctcctagagaagagatttggaccagccaatagctaatgagcaggcgcaagaatattttcctggagttcttggctcacgccaatgtctgaagagcgggactttctgagtggtgaagcgttcagtgactttgctagggtcagaggggttggaagtgctcagtagtgtgtgtcacattttgttcatgtttgcaataggccatgtaggaagtggaaagaattttggatttagattcaggaaatttgggtcttggggcaaagagtgctatttgcctacctaatatacattctcccatttatttaccattacagtactttcattgttggtgtggcaggttacccaagttaaccaaatatggatttcctagccttccttaagaagctagaggtgattgatgcgaatattcagagatcactggtaggcttctttaaagatggctgattcacctgggaggtgcacctcttttgtcctttcctcttgtttcttcttcctgcctgaaatgtggggctgatgactggagcttcagcagccattttatgaccatgaggtatgacccaagaatggaagccagtgctaaggatgggctgcccatctactcctggtcttcattttatgtgagagaaaagcaaacccctaatttgcttatgccacttactttggatctctgctacacccagttgaatgccaaactgatacacattgattgcccactctgtcattcactcctgagggactttgggcaagtcacttaatttttctgggcttcggtttccttacctctgcagtgggaataataattctggctttgtcttgcaagcgttacttctgacctgtagggctcactcttaggcttcctagaatgttctcaaccccagtctgaagatcacgtggtttttgtgcctgagcagtggctgcctccctcccattgtttggccagataattgttcccaaactaagaaatgtgcctgccttccgacttcaatggctgttataaagtccccttgtgggctcccattttctagagacacaatagcttttcctggcttgcccaggcctcacccctccttgctgggtgcagagacatctgctgtttcaagctgctaaaagagaagcttcaaagaaccccacattggcccctcttagggctctgactcatataaatgtttctagaaatcctcaaaagccttattaatctgttaagacatcccagaagcaggagtctgcacacccaatttccacggcttttcagctgcttccattgtctcagccgcattgtccctgctcggtgtcttggcccctaatggactctctctgaggcaggcacgctttcggctgcacctgctattccattgcctgactcttttcttcttcttctctgttctctttaactcttaaaatgaaaaggtgaccagctcttcctgggctgtttactcctctagctcccctgtgcgggtctctgcttcaccccctttctcttctggcatgtggctggatctgagtcagagacatagaggcccacatagaaagtaggggcccatttgtcttttccatcaaatggaagcctctaggggtctgtcattcctcatgcctagccaagataccgggtatccccacaagcctctgaaggggacttgcttacagctcttgcatatagaagctctaatcaggcttctccagaaactccctcatctctggtccatacagtaatgaccctctgatgtgtaaccttcactgtggttgaagggccctggagaaagagccagaagaccagggctctgttcctgacttgaccccagctggtttccattttcttagactagcatcaggggacttaacttgacagccaaggtcccatggtgggcagcttgccaattactcctgcctcctggttttcagacccctgtgtgctcccttcccttgagtatgggctagacctggtgacttgcttctaaccaatagaacacagcgagagtgatgggctatcacctctctagttaagttataaaagactagtttgcgtgttctgtcctgttggctctctctttttctctctgtctctccttctcagatgcttgctttgatgaagaaagctgctatattggagaggcccatgtggcaagaacttgagtgtagcctgtagccagtatccagtgggcaaatgaggctctcaatccaacagcctacaaggaattgaatccaactgacaagcatgtgagtgagcttggaagccaaccctgccccaggtaagccttgagatggtaaagccctgacttacatcttgattgcagccttgggagagaccttgaagcagagggcccatctaagctgtgcccagattcttgacccacatatatttagaggtaataaatgtctgttgtcttaaactgctaattttaatacagcaagaaataactaatctaggtccttattagctaagaagaaatgtgtttcttgccttgttcctctgtatttaaactctaggtccttaaacctttcatacccacgagctagccacttgggttgtgcatgtgcaccacccaactccaccaaccaccccactccaacactcaaatctatgggtggtgcaaatccctttactcttactccaaacatacatgatcagaaaaaatggaagaaagacatagctgaaatagagctccaatgagatgattcctggtttctactaggaatataagtaaaatttgaatttttgccagaatccaaagtattcaaggaagggctccttatacacctttgatcattcacttccatgtctcatctttcaaagcttggcttaaactttcctcctctgggaaaaaagaccctgacttcttcagttagggttactgttccctctcccagtcacccatcagttttgtccatatcagagcattctattttagttatttgcatattcccttctctctctcacccctccacggatctcctaccccaggaaggtcagcatccagtgaccttttcaggaaattacccaggatttcacaatcttagtcagaagcgaaatttaaaaccctttgtcccccgtcctcccagccccccgatgttccaggaagccaaagcacagagcaatctttccaatctaggaagcaataaagaaatgtatttatgaaccagcctctatctaagggagagaatttatgtctcttcatgctcttgttgacaataataactgattgctgcatcaatgtgatgcaatataattttaaaaccctccagaacaaggatcagaaaacaactggcagagagactgagcggcagccgtgggcatcttgggttttgcagctcagccctgggcctgctaatgccctgaggcgatgggaacacagctctgggagcacctgcaatctcatcttgtttctttccaagcaccagggaagaaaagcaatttgtttgctctcatactctaaagatgaacttcccgtgctcaatcaaacgttattatcccaatgtaagtcaatttacctttgaatttgaaggctattttcttcctaaatggctaattatgggagatagatggctgtaaacagaagtcttctacctcaacactccgccaggttttctccttatggcacctgagagaaccagagaaaggaggcctcacagtgtcctggccccctctgcccacttgccgcccctcctccattcttctcatgcatcctgcggtgccattcgcccaccccgcctacattcctggacgcctatttggagtttcatccccctgaattccatcccctgccgcgtccatttctaggagctccattccctcgtgccatctcccgtttttaaggactggactaaaggtggaggtcttggcctgagaaccgtgcatacgggacagcatgagttttaggagacaaggggtcctgtgtgtgtttgagatgaaacaaggtcacctgaggccgcctctttgatttgcctgacagagtcacagaagctgaccgctgcgaggcaggggctgcggccttttcccgtggcatgatcaacacctcgcaggaactaattgaatggccgagtttgtttactgagaggaggagtagccccctcctttctcgcaaaacaaagtctttccccaggagcggtggcaaagaggtcagccctggcagcgtttctgttttgccttttgatgaaagcctactctggctgctctgaagaagggagctcattgtgtgctcactgtcagaggtggctccagcagggaggccacagccctgggggctttttgggtcttggggttatggagcctgtggtgtgtggggttatctacagggactgagctttctagctcttctcccagaagtctggcctctggtcctctgccctttccacctgggccccagaagccatagtaatagcaacctgcctttgtccggtgcctcgtcgtcgtttatgcaagtctatatactttatctcacttgatcctcacaaccatcctgtgctgtcatcctcccctgacagatgagggagaggcccagagaggtcaagtgctctgcctgaggtcacacagctaggaagtgacataactgggacctgcctccctttggcttgaacgcctctgatctctcccgtctgtcacagtcccatcacagaaaggcaggcatgtggccccgtggttgaagccctgccccagctgtggatccgcatcacctgggccaggcttccaatttatgatacttactgagaccttggcaccacggccttgataaacccctctgccctgggcttgagcttgctgttctgtcgggggcagttcgcggggctgggaggacaggtaagaagggaggagcttttcatgagctgctctggaaaagtttaaggccatggtagggtcagctcaggaaagcacagcagggcaaggggcaggtaggcctgtccaactcagctaatagctacagaggtctcaagaagtaatgattggaggcctgactgaggcatagagaccaataggagacgctctctctcctagctcagaccaaggaaccctagaacatgctcctccaagttcacccaccgtcaccctgcaggggaggggtctgccacactccaaaaaagaatcaatccactgtgtgttctgtggactgttatttagagatgcccctacagattcctggagctgctgggccccatgccagggcaaggatcccaggactccctgtttagcatagtactttgattaaaacaataaattcccattgaataccgatgggcaggcaagtgggggctcatgccagcctcggtgccctcctggcatcatctcacagcaactcgtttggggagaaatacctccctccgctgtgatgagaaccctcattcccaatgaatgagggggcagaagctgcctgggagcctcaggaatgagggcatcatgggcaggacagggtaggactggggcagctgcagatggcaccaaggatatgggggccttgactaagcagggagggccacagaaggggagagggggcacacagaaacctcaatggctggcccctgtctggtcctcacctcctgaccctgtctctgcagacatgctgaactgggaggaacatgcttgggtcttggccccctgagcagctgtgctggagccacgcctcagtgcccagcgctgctgcatctgctctctggcagcacatggctgcatgtttctctgggccctgcctggtgcgcagcagccatatcctgggcaggtgtgctggggctgttgcctcacctggccctgggatgctggtagctccggattgaccagggtttctgatgggaagggatgtatgggagaagccagggagtggagagagaactcgtgttccccgatacaaggctttttacccatgtctccccaaatagccccccctcctcccactagccccgaggctggagatcaacatcatggtcccatctttaagaggaaccaggatctgttttgagatggccaatcagccaaagaatgccataattcacgttatccattcacttttcagttgacttccttccttccttcctgctttcctttcttccttttatccttcctccctcccttctatccattcagtaatatttactgataatccttcacatgaggcccgatgctaggctgtggaaatcaaagatgaataagcaatagcttctgtccttgtgctatctcctccgggtgtccagtattatgaccactgtatttctgaaccgaaaacgaggacgcagagctgacaggggtgagtgtacacgtgggaatgggcaggaagaccaccctgaaggtctgaggcattctgttcctaagctaggatgaaactgagtattccatacatactggctgcattgcatttttgtctagcattctttaataagaacagtaagagctgccatttgttgaacatgtaccatgtgccaggcttgtacaagataatgtgtataccatatctcatttagtcttcaccacagccctacagagaaattcactgtccagacagggaaactgaggaccaggccgttcgcagttagtgttagtacagtccttcttggccactctaaatcctctgctgcctctacagctggagggttctgatccgttggcttacaggtgtgtcctgtgggccacatgggggtgggtgggtgttcacagcacactgcctggagccatggtgcacacagcagggggtctgaggctgcgcagaatggcccacttctaaacaagcgtgtctgagctttgccaggtgtccatgtttggaacacaataaaagaggaggtcttcgaaaggaggtgactcagagaagcaacgctagactcaccccagagctgcaacctgctaacttcacagagcctcacagcagaattatttaaccccaagccccctctcctcatggggacaaaagagaaatcaggctgatgctatctccctcatagcacacttaggaggagcaaatgaaacggcatatgtaaaagtgcattgtaaattgcaaagtggcagatgagattattattactgcttccttcacctcaacaaagacccataatcacagacaatgcatcgagcctggtgagggtgtggcctttcttggccctgccctttctccttggctcctcccacgctcttggcttttctcctggattccctgctctcccatctgcagcaggttggggccccatggataactatatctagggaccgactcctgggatcttaccaagtcacatttgcagttggtgcctccttagtcactgccaggattccaggcaggtataatgtgctgcacttaatgtagaggatcagggtcccagtgagcagcttcatcttcaggcgtcgggagtgggagcaatggagcacccatggtctccaggtctcaggccacttgggtctgggatttgaggctcagggggaggagtcctgcggtgactgctgtgaagtggtgtgggggctcaggatgggacctacttcatgggacatgatggatgagactcaggatgccaggagggaggcacagcccacacttagcagcttggcgcacgcaaataggagctctgctcacagcctgtgctgggcacttcatttcccagagacaaccggcgcgttttaataatgtctacttgggttaatgaaagttgtcggtttcacttaataaatacattgccattcttggccacacatatccgtcatgctgggcctggagctgtgcgtcccgcctgagttgagtagggatgctgggagtgggaatggggtggggaaagcatggggcatatgggtagagagtgaggtctggagggcatgggacatggtccctcttgggagttaagcagagggagtcctctcattgcatctttcctctgggatcaaattagaggcacaaagggcagaagggaaccttggaggttcctcctgttcattctctgcctcagggaagtgacacacagaatggcccctttggcagggagcagtgagccatagtgtggtccagagggacgcaggccatcttgggaaggaatcccagttgaccactcattatctctgtaactaagtcaattattcaatctccctgagcctccatttcttcagtaaaatggagctaataatcatatttgcttcatagagcctgtttcgagcattccagcataagccatgggaagctcttagcaggcacccagcatctaaagcactcaaatcagagtcactagtattattaatgttaaaatattatttttatgaaggcacagtttagtatggtgtttatgagagtggatctggagtgtgggtttggatttcgggtgtatcacttactagctgtgtcactctggagaatttatgtagtctttctgtgtttcagtttccaagtctgtaaaatacggggaaataatacctaactcatggagctgtgaggagtgagcagattatgacatgtacatcctttggaacacagacccaataaatgttaagaattattaagttgtcgatttcacagggccatgggggagggaagtccgggctctctgggaactgccttccacatttccccaccttagggtggtctccagaccacatcccagatgaccttacacaccccaggggttgataccaggccgagaccctcgacattccagggagggaaccggaggactccagtcagtttccaagctgcataacttggttcaaggttggcagtgaggggagagacccaggggagggatcatgcttaacattcttgggacattctccttgaactctgcaggggccttaaaacatccctaagtgccatacctctacatgctggccttcttctgcactctttttttctttctttaaaagcttagactgattaaagatgggaagggatttggggggtcaagggaggactctggatgggaaaggggagaagctcagatgatgggaaggggcgggggtggccaggcagtgctttctagctgaagtaagcagctttggaacctgcctatcacatggccgggtattccagggtttttaaattgcatgccacatgtttatccttattaagcagttgttctcttccaaggggctctctctggcagccaagaaccaaccacagggcttgtcgtggggcttatgagtagctagggcctcccaggaggtcgtcagagtggatggaggggcaaagccaggaaaatacctgggggcttccactccctaaacccagggaaacgatggagtagctgagccgagattggctcacctccttgtacaggaagaaaaactgcggccagaggggcaaggcgaggaagtcgccataacacatttggtgtggttttgggcagacagaacgggtttcttatggctggggctgctttctaatgtgaatatgagtactcttggctgggagaggaagggctggaggagagatcaggaaggagagatccacatctggctccgagctgactctcggtgaccatgaccacctccttccactggagggagcagcctctccgcaggtggggctgtccctcaggagcaggaactgggctcccgctggagagaagcagcgctccacgttcaaagaccattattgccattattaattgatcgctgttattatcatgtaggcattaagtggcttcctctgccctttgagttgtaacacttagggcagctgctagcgaggacaaaacaaagcttccctactgcaagagctttatctgggtccctgctgctgtgtggccttctgcaattagccattttacagatggagaaacttagtcctaatgatttgctgaagggccgagttgcttagccctgcagggtacacagatgaatagggagcgttgctgagcacttgcaatcaagacagagttgccacccactgcaaggacgaacatcactactgggtcagctctgcagctgcaagtctggggaaaagggatccacccaggcactagggcaactgctcagccccatcgcagcaagggcccgaggaacgagcacgtcagctgtctccagggcctttctcatcatctcccgtgcctgccgtgctgtctcttaccaacccaggagggagggttggtggctgctgctccatcctcaccctttagaccaccccacaggtgggacagggtgggcccaggtggagtctgagctgggtgccaattccaggaatgcagctggaggtgggggcgggccatggtgggccaggacaggtgggagagaaaagcaggaggcagctgaagggggcggtctcagaagcccccgctgggagcctcctatccacctggcaggcgtttggaacaacgtgctgaataacagcagcatttgtgaaatctaattagtgcaggcccaacttctgacttcctgtgcgggggctcctcctctagccccaggctatcgagctgaattaagctgcctaagatcacctcattaaattcactaaccttgcttttccaccaggtttagcccctggtgcccttcctctgtctgtgggaggtgcgcgtctggcattcctccagtgcgttcccaggcaggtgttttgagaaactcccctcctcttccctcctctcccctccccaaatggctcccttaatcacgagctgctttcttctgagctcaataatcaccctggactaatccatacacaaaatcctgtggctgcagtaggagcccccttcccagccctccctggctaagggatggtggtcccagaggcactgaggactcctcctggaggcaggcagggggctgtccagaggcagagcattgggcctgctggcaaactgctaactggcacaggtgacttgcatttcctggggcctaactgctgggagtgcacttctggagtggagatgggcaatggggatgcctgatgagacctatgtccaggacaggaggggaggggatggagaagcagctctggagcccagcttgctgttagccctgagaaacaagtgacttcctgtgggtcagagtacagggtgggtagcagaaacaatcaggccagaggggtatttgttgcagaagagaaatgtgatgcaattagtatgctaggagaatggaaaactaacccggagacagggctaaagttactgcccactcaactctgcatggaattgtgctgaattgaggagcactgcagcgagacctgaccaccgcccagcccaggttgggtttgttttccccgctctgagaccggacctcaggaaaggggtgcggggaaggttgggttcagaaggagagactctccagccacacctgtgaagctccaggcagtttccctaatgtctctccttagcctcttgcagagagggctaatgtatgtcttccccccgggctggtggctgggttaattggaccttgtttatgtagcatctattatttatgatttcctttcgtctctcctgagtatgacaactgtggttaagcaaccagagttattcctgcctcgggacatgtatgaggacggtctcctttgcagcctacctgaagtgaatgtgaggccgagaggcttcgtgaaaggttaagtgggtgggggacctgctgggagagaggggcaggggaatgtgcctgagatcagacagccttgcactaagctcagctcctttctggggggacctccgatgcatgctcacttgtataaaatctaactggaactgggatcgtgttctgggggttccgaactttggctgcatattggaattatctgagatgtctgaaaaacctgacaaccagagattccagattaatcggtatgggggtgtggctacaaggtttcagagctccccagtattctaatatacagcaaaagttgagagccactcgcagctccagcacattcttactgtgtcagtttttttctgttgattatgaacaacagcagctaacattaatagaacctgatgatgcgataggcaccgagataagaattttatgtggatgacttcaacgaatcctcagaacaacccaatgttgttggaaggtgcaatgatcatcttccttttacagatgaagaaactgaggctcagggaggttaagtaaatgaggccgaagtcacacattgtttcagttaccaagttaggcctgacctgactccaaaatctgtgctgttaacttttttttttttgagacagaattttgccctttcacccagactggagtgcagcagcaagatctcggctcactgcaaccttcgcctcccaggttcaagcgattctcctgcctcagcctgccgagtggctgggattacaggcatgcaccaccacgcctggctaatttttgtatttttaatagagatgggggtttcggcatgttcgtcaggctggtcttgaactcctggtctcaaacaatctgtctgccttggcctcccaaattgctgggattacaggcatgagcctgcttgtctgaactgtaagaggattttaacagtttcccaagcaatgcttcatattcacaaatgaacacattaggctcaaggacagaagggacatacttaggatgatagactaacctggcccagcctgcaacctcatgggaatgtgggataatgagagagaatgtttgcattggaggtctgtgggcgtagagcactcaacaaatgccaggcactggggctataatcacatggggagaaggagccaaccgtgcatgtctgaagcaggtattctcttccctgcaggtgccaggactacagacagggcaacggagagcaggggcttgctggagaaatccatccttccctgggatctcttggagggctctccatctctcttagagcagtttctttcttagacagttgaagctgcctcagtggtctccccagatcatgcaggtcggggcagaagcttctcactcagagaactgagaatatcatttttcacagaagtctaaggtggaatttagaccaagatattcttggccttagcagtttgactcgggcgggggtttgaagctggaacttttcaacatacatctccaagcttcaggaggaagctagacacatctgaaagcctctgaacaacctgcgatgaagattcttgaaaaaagagaccatttgccttaggggctaagagtacaggtgcaagagacagaccgcccacattaaaatctgactccactcctgagctgtgtgactttggggaagttcctcaactgaagtcacaaagacctaatctgggaggtgggaatagtcatagaaaaaggatcgtggggaaatgaaacgagagaatacatgtaacgttcttggctcacagcgcccggtgaatgttagctgctattactgttgttcctaccaccgcaccctctcccattcctttccttctcaattctattgacatttttggtgtctaactccttttgagagatcatgacttttgtagaactaggctgctttcactctttgagggtggtctttctgattgatccatcagtctgcattctccttgccgtccttggtatgcacacacatgcatggaagctatattcctccttcatactggactttgaggacaacgttttcatgtttcacatttcccacttcatctcctttgttttccacttgcttagtttcctactcttccctttatcctgaggtgtcgtgagggcaatggcctgcagagtccaaaggtggctgtcatgtcatttgtccacgtttgcattcccgtgccctccccacagatggctgctctctgggctgcacgcacgttgggttcactgatcgcagagtctttttctggctgccaagaacatggtagcctcccagaggctgttggcatgtggatgctgcctctgtgatccacagccccgccaggctgatgcttcaggaatggatcacaccttggctggacccatcaggctggaacaccagattcttaatcaactgtaggtgctactgtcgctctaggacctgccgatgccctctgtccttctctggtgactttgtccacgtggatcttcagttccttcaacatgtgtgcttgttgccccttggagcccacctcctcaagcaagcctcccagcccagtcagcccctgtgcactctcatgttacctgtgcatctccttcacaactcacgtcactgatggacttacgcagttgggtgtgtatttggtaacctgtcttcctcctgctgaaatatcaactccaagagggcaaggagtgtgtctatttgttcactacagtattatatgaacacccctggcatataataagtgctccctcagaatttgagtattatatggacacccttggcatataataaatgctccctcagaatttgagtattatatggacacccttggcatataataaatgctccctcagaatttgagtattatatggacacccctggcatagaataaatgctccctcagtatttgaataaataaatgtggtgtcaatttggattaattttcttgatctcatacttgtgttctctatgcatcctatcacctggctctgctactaactgtctcatgaacttggaagctttaggggttagtcttttttaagtacattcgttaaaaaagagatgttgttcatataacataacattttcccctttaaaatagacagttcagtagttttaagtatatttacaacattttgcaaccatggccatgacctcattttggaacaatttcatcgcccccaaaataaaccccacacccatcactccccatttctgtccccgtcggtagccattaacccactttctgcctctgtggatttacctatactggacactcctacaacatgtggccttttgtgtccgtctcctttcacgtaacaaaatgctttcaaggttccatcccagttgccacatgcatcagtactttattcctttgtatgggtgagtaacattccatggcatagctataagcgcattttgtccattcatcatctgctagacatttgggctgtttccacttttcggctattgtgaatactgctgctatgaacatctgtgtaaagtttttgtgtgaacgtatgttttcagtactcttgggtatatacttagaagtgggatcactgggtcatatggtaactctatgtttaatttttgcagaaccgccaaactgctttctgaggagtttttatttgacttttttaaatgaaaggccaatttagtgtccacccccttacatttaaatttttatttgataaagaactcctttagaaacatattaaaaaccatggaatctccagataaatgcatatgtgtgaatatacatcatttcaggggtcccagaaccatcagaaactggctgtggatcccaaagttcgtgattacaggctcgcacgcagcagtgttttaaggttagatgattttctccaacacagaactccagctacagttttggctttttcacacggatattggagatggataatttggctaatgagttctaatccatgttctgatttgcatctgggatcagaacattcagcagccatttagttgccttaattttttccacccactctgcaatcatttgattgatgtgcaattacctccccctgcttggacacgtgctttcccctgctcatgtgtgtcatccaatgcctgataaccttcattttttcccatttattttgtgtgtgttggccactgtttgatataattatttttgtaatcatcttctattaggtgaaagaatattgcagtagagaaagaaggaaaaagaaaataaatgccttcctgacaagttctaatattttatgttcacaaatctcccaatatcagagcaataatattattttctcgatgtgcatttattaaaatgtaaagtagctccatcacattgggaacgaaaacccttgcattaccttggccagaaaatatcacttatttatttcagattgcatttctggaatgttaatactgttgcttttttttttttttttttttttatttttttccccatagcctttatctagcaggggagtgaacctgaaggtctgatttctaaacaggccttgctgaatgcacaggaccttaatttggttttaagaattgcttttggctcttgatttatgatgaggttcttttctgtgtaattcttttggctgaaaactgaatagagttctccctttgtgggtggcattttgacatcacattttaagacagggtacagatgtaagtggggagtagggaagatttataaaagagaagggggattaacatgtgcgctttaagggttggaaaagttcgatctattgtcgatttctctatggtatcaatggcataccccttagattccagttcctaagtcagaatgttaatttccaggtagcctagtaaaagagatactagattggaagtcagaagccaggagttctaatcctatttttccctctaagtaggtttgtgaccttggacaactcacttccattctttgcgctgttttctcaagtgcaaaaggaaaggttgaactaagatggatgggttttaatcttagctgcgtattagaatgccctggagagctttgaaaactacagtgatactcaggcccttagatcaattaaatcagactttctcatgagggtgcatggacctgggcattggtgtctctactaaacactgcccaggtggttctatcatcaagccagagatgaggacccctggtgcaggtgatctcagatgtccctccagatttctggttcctcagtgttatgagctgggcagtgatgtcagtccagccaaggctggtgagatgtatttgcagacaagtgggccgcaatcacaggattgtgattctgtgctggggttcgaggtgtctccgctgggagactctggggagatcctgaatggaattgaatttctcttagtatcaggtctgggttggggcaggtaaatcttcctttctttgtgggctcatggtgctgagaagatggatgagctggggccggtaaaatagctttgttccttggagaaagtcatgtagagagataaggtaggcttattatttttcgagtggaactgggactgtttagcctagaaaaggggggacttggggagaggcgtgatttgcggtcttcaagaggctgaaaggctgtcatgtggaagagggattggagtgatttgagatgctctggggggctgaactcaggtctgtgggtagagagtcagggaaagacattttggtgcattatgaggaagaattgtaatgtagagctgtgcttcatattccccgtgcatacctctgccttagcacctgcttttatgacagtcttctctacaatgagacgacatctttctcatctctgtattctcagcacctaatccagttcctggcacagtcctcaataaatgtttattgtcattcctgtgattattaattactgtcatgaatgcccactatgcagatcacttttcttgctttatcttgtttaactctcctaatgctttagaagtaagtatatttattaccccactctacagttaaggaaaccagagctttgggaggttaaggaatgggcaaaatcacagccagtaggtagcagaggctggatgtgaaattaggtctgtctgactcaaaaacctgtgttcctaaccatcctgcccaccaggatcctggaggtattcaagctgaagatagacaaccacttgggggacctagttgtgccatggcaataagtatggattgagttaggacagtcccagatgatgatggagccaggagctgagtagatttttagagtctgaggtcacccagttactgctctatcagccacctaccccacattcctccagtgaggtgttggcccggtccagaggcagagccttactacctttggctacataggctctgggatggcagtgctctctcagcagttatggtcttttccaggtaataagtattgcggcctcctctgccacttgcctgcattaagccttttggtcatatgtctggggagcagacttctttgtatgcccccggggacaggacaggatggagggaggagccctgggtgtgtgtgtgtggggtgcgtgggtggggagatgcatgactgctttggttatgaaacattgtgttagtgtgtccgttcacttcacatagacacagtgattgcattactacgcggccgagcatacgtggcagagggtggaagcagctgaggaaggagcaggtgctccaaggaaatctttcatcaaagtgatggcatagctaaaggcacagaaagaaatgcattactgagatggcgttgcccgttcatgggcggctgcaaggaaggctgaaatggtggcttgggagaatgaatgggagaggggctggaattggctggaaagacaggaaaaggaaagagggggagaaacaagttcgtgggaatggtgattcctttcaaatggggtgcacagcctgacaagctgtgcgttcttcttaaacacagcccaaatcaagtcttaacttgaaagaaaattaagtcagattcagtcatgaccctcctgttagcctggttgggcatagaggctttccagaaaactctctctggaggggttaggtggtggttgtagcagtggtaagcacaaaaaagggagccagcatttgagaatcaagtgcttaaaatacatcatcccatttgtttctgataatgaacacacagagtgggtgataggattttccttttacagatgagaagactgaggctcacagggcttttgttgttgttggtttagagataaagtcttgctctgtcacccaggttgaggtttcatggtatgatcatggctcactccagcattgaattcctgggctccagtgatcctcgagccttagcctcccaagtagctgagactacaggtgcacaccactgtgattggctatttttaattttttttgcagaggcagggtctcactattttgcccaggctggtcttgaactcctgggctcaagtgatcctcctgccttggcctcccaaagtgttgggattacaggtgtgagccacttggcctggcctcatagatgtttcaaagactaaattataagtgaaagccagagagtcttacttaaacatgacttaaaaattgtttattttaccacatcatgtgatcttccagttttccatcagagcaggcaggttggaggttgggggcttaggagtttgctttcacagcctcactaaataaattttggggaatggccacagattctagtgggcctgttagcctgacgaggctgaggttgcagacaggacccacagaatgggagaagctgagttacttgcaagttggaaaggtgatgtcatcatgaaacaaaatggatttggttggtgggcttgcccacgcagttagatggcaggtggtgaagaaacatggcctcttctctcttataactctgaggggcaggaggagagagctgggaatcactagattcactgcagagaagtttggggctgtatctaggtcatgggtaaactgataattggaaaagaaattcaaggttggacattcattttgatttttggttttcaaagtttatacttatctactttcaaaaataattttaagagacatactattttctcaggaaaagaaatatatgccctctaaatagttttcttccttgaatattgccagcaaatcagccatctcattgaatattgatggttgtagagcaaatcacgaatgctgacctagagctgccatttattgagttcctactagggatttgactctgttttaggtacattgcacatattagctttataaacattccccacaacccagcaagataggcatttttatccccatttttcagatgaggaaactgaggttcacagaggttaactgacttgctcaaagtcccactgtatataagtagcaaaactaagatttgaactcagatctgtctgacttcaaaatcaggtgctctttctactctgtgacatgaggctatgaacatgtgaatctcagaggtaaaaagcagagttggatatggtttggatctgtgtccccacccaagtcttatgttcagttgtgatcctcaatgttggaggtggggcctggtgggaggtgattggataatgtggttggtgttctcatgaatggcttagcaccatcccttcagtgttgttctcatgatagtgagtatgtgagatatcacgagatctggttgtttaaaattgtgtagcacctccccactcccctctcctcctgctctggccatgtgagacatctcgcttctcctacaacttctgccatgattgtaagtttcctgaggcctcagctaggctgaggcagatttatagttacgcattggccagggtggtgctaactcactcatgagaactcacccacatgatccaaaccatattagtgagccaaactctaccttttagctctgagattcatgtgcgcagaaaccgccatgtttcttgtacggcctatggaaccaggagccaattaaacttcttttctttataaattacccagtctcttttgtctttctttttttttgtttttagacagagtctcattctgtcatctgtcacccaggttggagtgcagtggcacaatcttggctcactgcaaactccgcctcctgggttcaagcgattctcctgcgtcagcctcctgagtagctggtattacaggcatgcaccaccatacctggctaatttttatgtctttagtagagacaaggttgcgccatgttggccaggctggtctcaaactcctgacctcaggtgatccacctgccttggcctcccaaagcgctgggattacaagcatgagccacctagtttcagatatttcattatagcaatgcgagaacaacctaatacactcacccttacctcttcaacacaaagagtcttcccagagcatccctgctaagggctgtgacttgaatcaccctcctctactaatgaaagactcgttaatgactccacgaggtgtcaggtccactgtttgatcctgcattggttcacccaaggaatatttaatacgtgtccactgtgtgtcaggtactattctagaacctggcaggccagacaagggcctggttctcatggatcttgacttctagttggagaagcaagcccttgaaaacaaagtaaataacaaagagtttcaggtgctgataaatgcattggagataatgagacagcggtctagagggtgtctggccatagggatccctttagatggaataatcagggaagattttgctaaagagatagcaactgagttgagatctgaatgacaaggatatgccttccaaagatctgggagaaaggggatttaaggcagaggaaacaggagatgccaaagctttgaggccagactgagtttggcacattaagtaagcccaatagcctggagagaacaatcaactagggggagaatgggaggagatgagcccagagaggaaggcggaagccagatggtgtagggcccacctgccatagcgagggctttggattttatcctaagtgtggtgggatgccatcggatgggtttgaatgggaaaatgacataatctgattcacattttaaaaaaagatcctatgtggagactggattgcaggaggcacttctaattgttggaaggactgttctctcttctactgatcaaagttggttcttcaagtaatgacccttatgaaactgtcctcacaacattaatgagaattacaaaccagactttaggcggatttgtagttaggcattggccagggtgcactggtgcactttgacccacttcctagcagctgctgactgaccaagagtcacacagcatgctgaccacctgctttcccattgttcctaaagatagaatctctgacactggacctttttactcaagaattacttaagttatttttcggatcctgaaatccagtggaatggctcatacccaccagtcttaagacccccaatcaaggaactgacccagcacaggcatgcggtttcttcatctccctgtcccatgacttcattcctcacttcttgaccaattagtgatcccctattcccttacaaaatcaaactccttaaaaatcccatcctaagtttctcggggaggcagatttaaggtttcctctcatttggctgccgtgtgattattaaactctctctctgctgcaacttccactgttttgctgtttgcccacacagtgggcaatcgaatctggtggtcttataacacttgaccaaaaaccaaacaacaaaaacaaggctactttcttccttcttaaaatttttccaatcagctattatagttccctttagttctttctaaacttcccttgttctttgaattgatccttggattctagacccaaggtggattctagacccattatcttgatcattctttatcagcaaatctcttgcttgtccatgtccttattaacatgtggcatccagtaccaaacactctttcaccagcccaggattctgaggggctgtgaattccaaggacatccattaatgaaaagtattagactaagtctttgttgagtagtaattcttaatgtgaggctctaggtccatgaaagggcccacatacaccacacaccattgtctatggggtgcctgtgcatgtgtgttgtgtatgcatttctaggaggagagtccatagctctcattaaagtctcaagcagagcctcctccttgagaaccactgccctaggaagttaaatcaaaggatttctctactaagcagatgttacaattagttccttcctggtcccacattcattcccttgctgccttcttcaatgcttttataggtctcttgatctcttcttcctgcctcataccccactttaaattccttctttagcttctaataaatcatccaaacccagagaagataacttctgctttcttcttggagcagcaactagtgaggaaggccgtaccccacttgctggatgagaacatactgacaaataggcctaagaccagaggctttttgttttttcttctcttctctggactcataggtctttggaactgacctgtgtgcctgacttgcagacttcttaagagcagggcacagagagactggaaagggcttgagtgtaagcgaatgcaaagggcaaagtcatcttaaaagaattattattcatttcccattgcagttaattttggcaccttcatcagggtttaaattctagtaccatatcatatcaaaggaaaaaagtatttgatgtacgtgttaattactgctaagatgtagctacttaaatcaagagtttaatcttcatttgactattcagaacagctctgagtgggggatggggagaaccccttttgatttgggttactttaataggtgatgagaacttcaagcaaaatggctttctaatttcagtatttggatgtcttgcaattagtacccagctaaaggaaaaataggaaaatcaggttcctccaggaattcccaagtttttgcttgttctgtgaagtggaagaatgttctgaataatttaatttcatgtgctcaaaggcttgagaatctgcagagtgatagcctaatggtaagtgatatcttaaaagcgtgtgagaggcttaaaaagtagatccatgtataaaataataaactattatttaaaagcacaaattgtcaaaatgatactactcttagatacactctttataagaaccatcttggttgaatcctaatgtgcattttttttaataccacgaaactataaaacccattgaaacaccacattatttaccaagtgattaaatcatagtcatctattatagttttactagaacattgttttcttggaattccaaggctttattgcctcagatataacactttactcctaataatccctattgattttattatattaccttatatttttagatttgttttaatgccttgcattacattttagccttaatgtgctatataaaatgagatacatcatcatgtttctcaaaccttctgaaggtaattatcttaactaacatggataaaaaaatgctcattgttggctgctgacagtggtgggagtctgggggtggggaaggtacattgtagtctctgggactgttggttgtatttctggacagttgaggtgctgcccatgggctgggtgaatggtggtgggtgtggtaatggggcattgccacagattaggtatctcatttgtgtcattattttgctatccttgcctctcttgggatttgtggctcacactgcatttacaaggtgttttacatacagtaattgttcacttgctaaatcagccagtagagaacttggtattcttagagaaagttgttgcacctttgggtgctgttttaattactttttcaaggtgccttctaaatgttaaaaatggtgacacattttatctcaagttgaactttgcatccccattctctggatttggggtcattctcttgccttggagtctggagggaggagaggagtcggttctggcttgtgagccatggtgctactggtccctctggaggaagggtagctactgatgagccttccctgcagcaattgtgtcccaagatctgacacactcttatcagggccccagcaaataactcagcaccttcattacaaaagttagccaggtatggtggcatgtgcctgtaatcccagctactcaggaggctgaggcagaagaatcacttgaaccctggaggcggaggttgcagtgagctgagatcacgccagtgcactccagcctgggcgacaagagcgaaactctgtctcaaaaaacaaaaaaacaaataaaaactccacaaaacttcagtggagactagattcttgactactaggaactcaaactctaaaaggagaaaataatcacaccagctacactttttacagtgctaactatactttttgtagagttaactacatgcacaattttatttgctttatctatattaattcttttcatccttatgaaaagcagatactatcattagctacatttcataatgaggaaatggaagtacctagaggttaagtattttgcccaaggtcacacagctagagagtggtagaccgagaattcaaacccaggcaatctgatgctcagaacctagactcttaattacactaatatgatatttacaatttacaaagcgttatccactagttatctcactgattttcccaagagactttggctccactttagacataagaaaacagaaataggtcatcatttgtctaaggtgacagagcccaaacccactaacaggacagttttcttcaccttcaactcatctcaatgggtggaaaaacctacccacatgctatgaggatgggaaaccaaagtgtctttgcacataaacagactgcctccctggaaaccaggcctgtccttggtggtgtatgagcaggcccctgggatcgacacatggatgaagggagccctctgaattctcccacatctctgggcacccctctaatgtgctcttctcagcttgttgctccttcactgtaagtccaagttctttgaaggaaggaactatgttggtattctgtgatgtacgcggctctgtgtgctggtgagattttgtagccactggaatgatcagaaaaacgtctgtgtgaatcttgcatgatggaagaggaaaccaggtaagagtgagcaagcaggatggtaaaagggataacagctgatgggccagcaaggatgcggggaggatacctgtggtcaggaccaggttgtgtgcagggcagctctgattgctttcttagcagaaagcacaagaccaggcaaagcaggcgaggagaaagccattgaataaatactaagctagaaaacaaagatatacatagaaattctaggttctcaagaaaataaacaaaccaacttacagaaaacccctttccctgtgttgaggccctctgttgaacctggcaataaacgttatgcctctccccaaccccagtccagaaggggctggcaggtacctctttttattcattgagaaagtaacggtgagcagttttgtgaattctgtgaattacccttgaactggtcagaaagatccaacagctcagacaaggagaagggaagagctaatctcctcttcacctgtgatgactgtttttccacctgtggcttgggaaggaccatccttgctggtgatggatgttgatttagtgctttgagatccctggaagacaggtcaggcaactaacaaggaaaatggcattttgggtcaagtcactaggaatgaagaactagaatacagggagccagggggtggcggtgtggcggggaggaggccagaatgaaagataggaggatcagagaatggtgataagtttgtacaggtgggatcatcagttattctccccaaacagatcattcttgtcttctcctctgatttccactaggaaaaaacaaaacaaaacaaaacaaaacctgaggtatttcttagaacacgaagcatgaatcacttacaccagagatgagaaaagcaccatcaggtgcttaaaacacaattataattggaaagaccaagaatttgtggttcatttctagcaggtgaacaaatgtatgtttataatggtgtaaaaaccctggtttccccttcccattcccggtgccttcccagtgtgcttggaacactctactgtgttattcacctgacggattaagctcagcagaggcaagctgcctaggcatgtcgtgtaattcagcattaagtatcctattgattcactgaagtgctgccatggatgttaatggagacaaatattgtggctgtgatttttcaaagggctgagtaattcccgagcatcaataacgtgtgtcatgatgtaatgcagggagacctccagatgcttgacttgaggccaactacggagggcagagctgatggaagggcccgttggatactgacccagggcttggggagatagcctgcactttctccagacctaccatcagtaaggatggtggaaattggggtggggcagggactgctgatggcgtttcctagtcactcatcacaaggtcactgattgttggatggcatgggcacgcttcccattatggaagcttgctgggccttaggagcttataccataccctgtttcagggaacagggtgggttttctcccctctccagttggaaacactacatatccctgatgataatgcagcaaaactactatctaatcttaacagcgtctaccctgtgccctacttgatctgagcatgtgaccacttcagtgcacgattccagtgactgctttcagagaggttacatgccttcctcaaggtcactcagcttcctcaaggtcatggactaggctacaatccaggtctcaggactgcttcccctggtctattctcagttacctttaggtagggtctctggaaatcatttgagtatatggcctgaaacaagcgacattttcttccaaaaaggctctgtaaaaatctcagggttggtcgttgtaaggaataaattattcccaaacaaatctcatttcagtcaaattctgcagactgcccaatctttcctacactccaattcattctccatactgctgcttacattatcttgaaacaagacaaatccaatcttgtcactccctagcatgaagacttccatcagcccctctctgctgacaggataaactccttgcatgatattcacaatctctcccccaagcctgcagtgtgatgtcctgcccctcctgtccccagcacttggaacatagcagaccactttatgctctttgccccctgaatattttatacaagtgattcctggtgtctagaacatctttcccccacctgctgcccagaaaacctcagcccattcttcaagagccagttctactatcccatcccaggaaaccatccccacgtctccagggtagagttatgagtggtcctttctctgagaccccacagaacactgcttatccctttattacccctgtataatgacagccttcctattgaacttactgatttattttcttgtgtatcttcctgcattggaatttggatttctgcggttgggggctgtgtctttgtcatttttgtcctcttgttggcatgcagtaagtgtactacataagtttattcactgaatggatgaatggattctggaatcagaaccctgctggggtagggactatcagtagggtatagggcaaataaattggccctgtgagatacatgtttctatagtcctgggtctaggagggacccttgggggcttgagaactggaggcagaaaaactgtccttcaactcagcagcatgctggggtcttggagagagtctctggggctgggtgtgccctttaactaccatgtcccttgaaaatggtagccctgagaacatatgcaaacatgtattcccttgggaaacagagtctgacattctaatgaagaaccagcacacttgactttgatcaacaccagccttataagcagcatggatattgaaacattcagtaaccagcatggcatgtgcatgggtcagtcagaatgcacacaggccacagggctgaagcagaggtctggagggctccattgtgccaaccattaactctttagtagctggacagtagggggtatcttggaggagggtctgagaatagcaggagaaacatgagtaagggggcttgcagcggtgactactgaccagccagtataaaaatatttcattattttaacaaccggccctggtactgctccaccggtgcctatcagcccgttgataagtcttgttaaagaataaccacagttttggctgggcgcggtggctcacgcctgtaatcccagcactttggaaggccgaggcgggcagatcgcctgaggtcaggaatttgagaccagccttggccaacatggcgaaaccccatgtttcaccccatgtttctactaaaaattcaaaaattagccaggcgtggtggcgcatgcctgtaatcccagctactcaggaggctgaggcaggagaatcgcttgaacccagtggggcggaggttgcagtttgcaccattgcactccagcctgggccacaagagtgaaacactgtctcaagaaaaaaaaaaaacaaaaaaaaaagaataaccacagttttgaagcctcaaaggaaggtgtgtgtgcatgcatgtgtgtgtatgtgtgtgtgaaggaatgaggcagagctctataaaggcagtactagagtggaatctttcatttttagttgtatttcaatataagcataaggaggtggaggtgagagaatttcagactgaggaactgaaagagccagggcacagagtgtgaaagggacctatttgggagaggtggctgtaggatgctgaggattcctgggggagatgaggaaggagacagaggctggagcaggtggccaagggccttgaaaaccatgttgaagcatggtgacctggtctgtgttcctataggccgccctttaggcaaaccttattgcttaggctggcttttgggtggtccttgctgggacaaccagtggcgtcatcttcaccaagtctagggtggtcacctggtgatgggaacaagcttctccttaattaagaatgtcatagcagcctccctggctccatggtgactgacgctgccagtccagctgccatgtggccgatgtgtcctaccgtggtacatcatctcctaattaacatgtcttgtcaggtccagcggttggctttagtaaatatgcctcaagcagctgtcactgggaccctgcgtggggcctgctgcctcattagctccagagaagggagatggcattggcggcaggagggagggagaagaatgttctttatggggggtgttggcaggattagagggatgtcagatgctcagagagaactcacaggccccagtggagggcttggatctgagcaccatgagcctctctctctcccatgtgtagtgagaggataggtgggtagcagtgtgggcaggaaaacagcccaggagttgggagacccacatcttcattctgtctctcccaccaccgagcaaggctcggtctcctggtttgagaaacaggaatgatcccagctctacctatcctgaagtttgttgagtggttctaatgagcaaatgacctatactattctgaaggacaagaaatgctaaattttacagaaatcaagccagggcatggttgtaatttggggctatcagagagaagtctttgctcagacaagactggtccctctgaacacacttcgcccacccctccaaggcttctggcctgcatcccactgcactgtctgagcactcatcaagacctgctcaccacccaccaatcctgtcagactctttctctccagcctggcctcgccttctctgtgagaaggaaaatgagaacattccggaaggaagcactcttctttctctggctgctggagtaccttccaggctgtggaggcagggagctgacttcacagtgactgaggagacataccttagcccacccccactggattttgagcacatgcctaaactttgtacccatgagagcacatagtaggtggttaatgaatgtttgctgagcaggaagaacagtatatcccgttctcctagctctcaaaacaatggtgggtgatttcatagtttctttcagcaacttgttctattgccaacctttctataagccttcttctgagatccagcccagtctccttgggcagtgtgtatctgtttcctctttgtccccagcagagaatagaaactgactgtcattctctctgcctctcctgaaagactaatactaagcactcttatctcaccccttcccatctttcctattcatcagatttcctggagcccagcctgctacctggagccagggcctcgcctctactgccccctccgctcgctctgcctgtgcagggtccatcctgaggagagtctgagcaactgaggatgttgtgaaagcatctgacagcacagggaggcagggcttccccagcccagcagaggcaccaaacccacgcaatttgtaaatctttgataatgagcatttaaagggcacgtcctaatgaagggagccaggaatgactggccatggaatgcaggcagaagattttaattaaaatgcttgtctttttagttttcctcttcccttgtctcttccaaacaccacctccccccaacccctgccaatgatgcacatgtcttgcttctggaccaggcctgtgcaaaaaatgtgcgtctcatatttcccttgatttagttgctctctgggggactgggtgctcttcttcagctgggcgcgctgtgtgggtttgacagggactgtgcacatgtgggtagaggcggaccaggactgtgctgcctgcagccaagcagatgtcctcaccccaggaagcacagtggggctctaagagagctcatgaatgagtggcagctgccagccttgtgagcttcctgtagtgaagctctggggggagctctggggggccagctgggagacttctgggccaaaggggtgttttatggggcctctcacgatacttttctctccaaatggctaaatggagtgtggcggcagagcagctgtgagggactttgcactgctctctctaggggtggagggaccgttggctggatgccttccacgtgctcctccagatccatgtccaccctgccctgtgccctgggaatctgagctgtgtggattccagcagcagacttccttgctataggcttcagattgggtctgcccaatgaggaggccttggcaggacatgggcggaaataggaaaatgaggttggactatattttctggcgctttctttgtgagatcatctcagggctggttgtgtcttttgattgaagtccacagtgcctggtaaaggtggcttctctaaaagatgctctccttcctggttctatgagccactctgtcccttcactgctgccactctttctaaccccaagatactatactcttccttgtattactcctggagcaaaaccttgtaaacagtccctttattaaactctccagattccccaatttctgtgtattgtctgttttctgccaggatcctgatagattcacctgttcttttccagactggttccttcgcaccagacacatggtcagaggggattattcatgttattcctgggatcctagctctgatgtggaatgcaatgtagtctggtgggtgataaacgtccctacttccacatagacggactgggtttggaaaagtgcttgtgaatttgtttcccaggaactgatgatagtctttggacttctccaaaggtctgtgtcgaatggaatataagccccctctctgtgtgggatgaggtgggagtggggatttattcctccccaacatgttttcatctgggctatgatgccattctcattttatagacaaggccactgtggttgagtgacttacccagaatctaagaggcacgttctcttcaactaatatttagcaaagaattaaagcaggttttctaccaattgatggaaatctttcctccttttgttccttgccccttttgctatttgttcactatgaagacctggcttcaaggatcttgtggggaagtgagtagggctttggtcttggactgggaaaaactccactcagatacactctctgtcagtcaagctctcaggcttttccttatccagcaatgacttacctcttacctctgcctggagctggcctctgagtagggtttctgatcttggcttagcagactgattgcctcctgcttgtgcctcagggccctaagcttttagaagcatgcctcactcccagcctaagagcttgtctttgactcctgattggccctttttcctgatgtgtgggttggtgttctcgaccccacagggcgctgaactccagttagaactgccacccatggcaactccacagggtgagcccgccctttggacctgacactatgtgcctgatcactctttcacagacgtctcccttccttcccactccacccgagtcaaggctcctgaccaactaggagacagaggccctttctccttgacacgtcctgcctaaagtgtcagcttccatccctgcctggtgttccccacaccaaaatatgaaaccaatctttcttctcatacacagtgacacagtagctacttcgtgttccctcttcattcagttgtctgtgcaatcagtctgtatgtatgtattcattcattcattcattcattcattcattcattcattctgctatgtattcagcaacctctaggtgccacagcttgcaaatatcatctgaattcattctcacagatctctagcagatctctagtgttcactgttactgccattttacacatgaggaaaccgggtcaaagagtaactaagcggcttgatgagggccacacagctggcaaatgtcggagccagagtttgaagcagaacgtatggcattcgcactggaattctcaaaccccagcacaaggcacctattcacagacagtttgaagttgttcatatgcagaatcggaagattctgagcagattccatccctcctccccataagccacacttccattagctctgctcaggacaggtgggcccctgtgtgttggaaattgagatggagagaggtgaggagagaacaccctgagggagaagtgtgtgggggtggtgcaggcaagaccaattcaccctgaggtgatttgcatctttagcaggagtacatgtcatgctgtcacagccttttcctgtattgacataataacaatcctttacttttgttagcactttgtagctttcaaagcagtttcaaatccattagctcattttattcctacaacaatctcacaaaaggcagaaattattatccttattttgcagatgaacaagctctgtgaggctatataacttctccagagtcaggaagcctggatgcaggcctagatacctgactcctggtcttatggattatgtaccttgcctcacttttctcattgttactttctgattttgagccatttagggggaaaggatggcttcctagactctcagaaacccctcactcttgggttccaggccacctagactacataaagcagtggttctcaaattttatttgacaccgggatcacttggaaggccatcacatagattactgggccccactaccagagctactgattcaggaggtctgggaggggcccaagaatctgaatttccaataagttcccaggtcaggttgatgctgctggtgtggtctcacactttgaggaccacagatataaggcaatgcctatgagtctttagctgaatttctctaatcagggctcttcttctgggctgcagaaacctcagatacagaaagaattgcccttgtgggtctctccctggggtgagaaatttgtgtatgtcttgcttcactgactgtggtgtgacccagagaatgggaagaaaacctcaggctttttggtttatacacacacacgaaaggaaaatgtccacacatgagattattaattcattgttcaattaagttatgatctctaaaattatcacaatatttggctcggaggaaggcagcactgaatagcttgttacacgtaatgtgtgaataatgtaactttattacttttcccactcgtaagtaattgtgactgacacattggcaataacacagattgccttcttaccttcccctctctctactctcagcacggagcgtttactttcttgtctctattattttcttgctcatcctccttccctgccacaagcctcctccactgcatattagccactgctgtaacaagtatactaatgtctcctcatcaatttttatctcccaatgcccaggcacttggagtctaaacttaaaaaaaaaaaaaaaaaagaccaggcgcggtagctcatgcctgtaatcccagcactttggcaggccgaggtgggcagatcacttgaggtcaggattttgagaccagcctggccaatatggtgaaaccccttctttactaaaaatacaaaaattagcctggtgtggtggtgcacgcctgtagtcccagctattcgggaggctgaggcaggagaatcacttgaacctgggaggcagaggttgctctatcaccactgcacttcagcctgggcaatagagtgagaccctgtctaaaaaaaataaataaacttaaaaaatcattctctattaaaatccagtctaagcactgccatgatttgggtatggtatgtttggccatgccgagtcccaagtctcgtgttaaaatctgatttcccaacacacaccggggcctgttgtggggtgggggtgaggggagggaatgtagaggatgggtcaataagtgcagcaaaccaccatggcacacgtatccctatggaacaaacctgcaagtctgcacacctatctcatttttagaagaaataaagagaaacaaacaaacaaaaaaattgattcctagtgttagaggtgggggctggtgggaggtgtttgggttgtgggggtggatctgtcatgaatggcttggtgtcattctcatgctcctgggagtgagtgagttctcattcttcgttcccacaagaattggttgttgaaaagagcctggcacctccccctcgccttgcttcctctcttgctctgtgatctgcacatcccagctccatttccccttctgccatgagcggaagattcctgaagccctcaccaaaagaaaatgctggcacaatgcttcttgcacaccctacataaccatgagccaattagatctcttttctttacaaattacccagcctccagtattcctttacagcaatgaaaagggtctaagaaaaacactgtcttgtcttccttttccatcatccatcagtgtatgtttttgtaccagcaagtatgtttatttaggcagaaccacaggtactggcaacgtatctacagtgtagacatgaaaagaacaggaagagcataagtaacagagattttgttcacatggtttagtcatgttcccactgcaatgtccctcttcatacagtatttcttacctccttccacctcttcagaaagtacagcgtagtccacatgaatgagacctgagtgcactggggcatccttccctcctgctctgggggtcaggtgtggtaatctggcttagcttcctccaaagctccagttggaagggaacacgttctctttttctggggtgatccagtgtcgaaggccaatttacatgcagactgggtgtgttgtctgtattgctctgttcaccggtaccgaaggctctgagtaaggtggaatcagaccctactctactttccctgaacagtgagagcagcaagagctaacagctgagcatctactttgtgccggaccctatgacatgcactttccatgcattcatgcagtcttcacaataattgaatgtggaaggtgccattgttccctgtattgtaccgctggccagtgagagccaggagcctgtgctcatcacaataccatagttttcagccccccaggctaacatctaccctctctcgtggtgcctgggacccttctggacctgatcaaggtgtagcagctaatggactcggaacaagtctctgtagatttgagtggaggcgccacttgggctggagaggcttgcggggagctttgcaggggaaatgaagcttgactcttgggtcctcagggtttaaggtttgccttttttctcaaaaaagacttaaagggaaccaggtcccttgtacctgctgtgtgcacctggcaaagagtgcatcgggtggaatgcagtcctctctcaccaagctcttgcactccattgccccctagcctagaatacttgctccctgctcagtaaagaatcaaattcctgcaaatatccatcctcggtcctaggctacaggtctgcgccctctcggaggcccttgctggtgctctttccactaagcctcactgcctctcctgtcttcaaggggactgattgcactagggaagtgtggagggagggtatatgcacccagggaagaaagcagcacagcacttctcacagctctggtctacagttgctccactcagcaagtggggacagttccagcttctgggctcttcttgcccctaaacttctcctcgatcaggagtaatatagtctgagaatgagcacaaagaacactttttcttttaaggattgaccttttgctcaatgagcaggattgaaccttgaacccaacaaaagggtctgcagtgaggcagggctggacagctccacctctaggcaggcacagcaagtgtgggcattgcttactgcagagaggcttcccttctaaatccactcatggggggtgccaggtgcttccctccaaggcagaaggtaacccctcccagtccagagcaaatcacggtctccatgtttttcctccctggtcccacataggtgagtgatatatacagaggttagacctcagggttatgttatggattggagggagcagagaagcttcctcattaaaagggctgggctggttggctggctccaaggccctcagcacctctgggcttctgagccatgggagagttggacagaaggctgaacagtggctgatggcctggaggaggagatagggagggaggagaaggctggatgctgggttcccattgtacacccccagcaacgagcccccctgccagcccagagtaaccagagatcttgggccacaagtcagacacacctagactaagatgtggctttgaccccagctggatatctgctcacgtcatcaaagctcttgaggcctcagcttccttatctgtaaaatgtggctgggaatacctgttctactgatctgaagaattgttgtggtaatctgaagaggcgattggtataaaaataccaggtaaaaggcagagtgtgtcccatgaatgagacaccctgtccttctccctcaagacatcctctttgtttctcattcccaatatgaaaataacaaaccattctagggaacaacttggttatttttgggtcatgggcagggccagcaggcctacaggtagcgggagggatcagtggaggaagcgacgtgattcctgtaagacttgaatgcccctgagtcaaagtctgctctgaagaccagcccccttagagtgacagagatggggctacctcacaactctgccacttactatttttaggaccttggggaagtcatatagaattttgaattttagttccttcatttgtaaaaatgggaagggtaatagcactatccttagcattataaaataatggatacttatggcatacccagggcatggcatgtgctaagcattcaataaatgtggactattattgttatttcctttttgagctagttgtgtttgcttgctacggaggaaatacccatttcaaagaattgggaggataaaattaagagactggtaacccagcatctgccgtttaacagatgccctgtaagtgagtgccttcctctttctcccttctggcacttgttctgttgagagtctgtgatgcccaaaccttggaattaaccctgatagaaaaaaggcataaagccactggatatgtggcagctctgccttcgtgttgggctcacattacagacatttgagtgtctgcccctcatcctgccccccagatctcactgctctctgagtcttaccttagtctcctgtcttttcttctgccctcctggacccagcttactgcctgctctgctgccagcaccctttcttgtgtcttggtatctgcctgagacctttgttttgctggttacggttgtggcctgatgggctaagctaggccctttgtaccacctcagaacagcaggggatgcagcaataatgccaactaggagtccggatgatctggacttgaatttgtatcccggtttaaccacttactctatagccttaggcaaggcacttaatgccattgcatgccattgtcacatcaatacaatgaaagtaacacctatatcatggcattactggaagataaaaagagatgactgagggataaaaaggcgatgtgaaagtccctaggagggtaggcacttagtaatactaggctacctcccttcctcctcacttctctagtctcaatgcctgcttaggggaggggtagagatcagggtggtgagttgtctcctctgcaggatgactcagcccctccctactcccctactctgttactgcctttgcctcatcatactctggaaaacctagactaaagtaagttttttagctggacctatttttggaggtggagaatggaacttcctcactggtatgctgagttttgatttccatatgggctgatttcagagtaactgggaaaattcagtaattagcagtagcagcattagtgaatcatgttgtaatcatcctcttctcgcttcttccctcttctgcatgttccaaatgctattaccgacactatctttccctccactggcccttggcctcatgttcccactgcagacgttgtgcttcctgcttagcactatgggtcagcctctgggtactttcctccctcccagcctccagcctcctgctcaagcctctgcctatttgtccagaaccctggtgggcacatttagctagtttctcctcttgcaaattcaacctacaggtttatttcaattcaaagaaaaaaatgactcatctaaatcctgataaaaacatggctagtgctgtctgggctgatgaaatctacttggagaatggagaacctaagagaaccttctctgtctaagtctggatatctctgcggatggtcacttaaaaaaagataaaaatgcagaggagggttttccttagcaaaaactaataatcagtggctccatccatttatccatctatccatctaggaaacatttacacaatgtctacaatgtgccaagcctagcactgggctttaaggacatacacatgatagctgagaagactagcaagtaaaccgatgaccattgtacagtggaaaacatgccaagagcacagtgggagcatgagtcagtgagcagcaggggcagctcctctgagagggaaatgcttaaatattgaggaatggagagaatttagctttgcagagtttgctttcattggtatgcgtgtggaactaaggctcaacaaatggaaacctgtaaaatctatacttactcaaatttttgtagagcattgtaatgtgctgggaatgggaagctcagaagaggaataataatgggctttgctttggggtttagcactgacttctcagaatttgagaatttggaacatttaagtaatcccatttcctcttgacagaattttcctaaaacatgccagagagataggaatagaaacaccttgcttgttcttaaagaatctaaatctccacaatgttccctgttcattccatcatctcctgttgttggaaaaacgtacttgtctgtcctctggctgcaactaaagtcagtcctctccttagggcacccaggaactcttgatgtttcaccagtcctcttgctgagctaaacccaagagttgttctgtgttctatactgagtctggcctagtgtcacagaatctgcattagacatagaaatcattactgcataaatgtggagcaatattaacaaaaagctgaagcattcagatgaagaggcagctgttttgccttaggcgggctggggtgggtagccccatagtccgtggataattctccctccgtatctttccctcacttatcctatatgttcacgtcactgcagttatttggtgggcagttgtagtcttagatgagctttagtgaatgggagcccagcttgagggcttgaaattcatttagtgtaggaaccttggtgagaaggttgctgctgtggaggaatcgctatgtgaaaggactttagtcttcaaaagccggctaatgacccaggcatcaccccgtctccccatggccccagtgacagcaggcacaatgtctggatattgagtaattacctatttccttttctagatgatgtaagctctgttttgcttaccactgcatccccgggggctggacagtacactttaatgatttttttttaattgaatgaattaagattcacaagtaatttgaaaggcatctctatttatctcgctggtgtttctcagtcctgggctgcattgccaaagtttccagtttcttcatgacttggccagccccccaatcatcccaaagcccagttaagagaaacacttcggtgctaatagatctggaaacttaagctctggagggccacctgtcagatgagatttgccttcaaaggccactggctctgaccttttgataacattttaaaaaaagaaaccttacatattgactgaatcaggcctgtctccaatgaagatctaggcagctatttgtatttctgtttggatttttgggtccttttctttttgtacctctgggtaagcaaaaggaaaaacgttcctttgctttaccaaacctcatttaaaagttgtttgtatatattttttaatggaacccaatcccttaagcctttaaaagtaacctctactgagctcaataaaccatttccaatgtggcagcttctaatccaggagagttaagaaggcagatgctaaccaaccaccaattgcatcccaggacagttgctgaaagtctcagggctctgcaagctggagatgagatcggctaatcctgactctattctttcgtctgctctgctagctggccctacttgtacaattaatattctccctggtgttgattttgttcaaatatattgggcccatcaatcacccactttccaactcatctgtctggatcagtcatttacaaagttatttttgagccactaggattcttgtgaaatagacacaagaaggagctaaactcatttcaggtttgacctctgtggctgggatctgagaaggcttagtttgattacgcttcatggccatccaatccaatctggcttgtagaatagaaaggccacttgcttaattgggaacactttaatatagatatccattaacttatgctaaattacagtaaagcatctatggaggaacttgatgtgacatctgcatgaatactaaataacttcattacgatcagtactgtgacaatgaatatgaaatgaacgtgcccagagaagacaattaatctcccaccttcccaagccagtactgttttattttaccctgcattgtactaaaaaaataaggcatagaagctctatgattttctgtctatctcactcacccttcagctggtgagtggtccccgagagcttctgtcatttgtagagtggaaactgacccaccctgaggaatagccatgggcagtgggtatgtggggctcctggggacccactttggtttgggaaaggaggttgtcaagactaactgaacacaacacacacacagacgcgcgtgtgcgcgcgcacacacacgcacacgcgcacacacagaattaaaaggcatcctcatccggaactagcaaacagactgtcagttcagattagcaacatcaaaagcattccaatctgttccctgcatacattacatgcatagatctgagagaagaatttggcctctgaattaagtcagctttttccttctgggctgcttgtacctgaaatgtgtggcgaagagggtccagcagtcagattaatacacctcatagcatttagtctgaaccttacagcatggtcttaaagagacaccctctcatattacttgctgctgtttcacatgggttctttctgaatctggaatgaaccatgggacccttgggttgaagactatgcctaactctgtatgaggggtcgctcagaatggaggcatgcatgaaagaatattcctgggttctccattctagtcatttccctcctacgtcactgacttattgctggcatctcctccccttgaccttcatattggagtccttggatctcttctcaatcttatggctttaaacaccgactctactctgatgtctctcaattttgtatccacagcctagaccaccccctaaactctggactcatctatccaattgcctagttctcccctccacttgcaatgtgtaacaggcatctcaaatttcacatgctccgaaaagaactcctggtcttctcccacaggcctgcccctctcacggtcttcttcatctttgaagaagatgataaacttgtcagtggcaattttatccttccagttactcagaccaggaaacttgaagtgagtgatcctagactcttctcttcctttcacacccacatccaatctgtcaatgtagcctgttgtctcaaaatatattataaaccaaccacctctcaccacttcctctgctactttcttggcccgagcctcatcacttgttgctcagatggttgttacagtcatggttctgggtttagcagggtctctactccaggccttgtctctgaagagcctcttggtggtcacaaagctacttgccactctcatcagatcagggtgcagggtgtcatgagttttacagattctggctacaaatacctgaggtaaaaggatacctttgacattagcaacaacaggaagggagaaaattgctattaccacctagactgtgagcaaataacattctggccagtgggatatgtctcaccaatccatttacaggtcgcagacatttacaacaccagcctcctggcttcttatggggatagtggctgcatcatgtcccactgcacccttgcagctgactccatacccctattacataacacaagtctttctccttctctctttgtacccagaggctccagcatatttgcatagcatttattatgctatgtaaatacaccattatatatgaatttatagcatatgtgagaactcagagtaaatccaattccatctaaaaccacgtaatactcactgaggttcccaccacagtccccttgcttacatgtgcacatcctcaacttccactctttctcaggtcaggaacgtgtcaattctgcaacttcaagtggcagttagggaaggatcctctctccattatatgaaaagtaggtgtctagtggggaggagcttccttctgaaatgctcagaaatgtaccgatgtccttagatgctgcagatggagcccagatcccagtgagcgactgctgggctgttcacagagagccagaggcccctttggaaagggtggatctccataacccatgggaggggagggacctccaacaatcttgttagtgcatcaagtaatagatttttgacagatgctttcctgccttctagtccaaacttcaaaatccttcctgcactggtctcattggggttggtggttagttctcactttccccatttctgagaccagcaagaggctctgtttgcgccaagtctccctgtaaacactgtggttatgcccacactaggcaatgccttcctgggagataacattgcatttattccaggactcctacagggaacaggaggggaagaaaattgcctctctgtgaaagcacattacaatgtggcctagcccaagctagactcactagaaatgttaactctgccctgcactttccattccccatcccctttcctctgccttttccaagcaaactcttactctaggaaatacatgtttgattttcttgggtgaccaccatctccaagagaacctcttagaagtaggccaaggagcaaagaagaagtcccataaaggtcaagagcatcttacaggaaaggaaagtggttacggcagattgcaattgtaggaggaatgacacaaaaggggtaggctagaaccagagtcacataagaacagccttctggaggcagggggatggatgaaagaatgtctttatgtcccttcaagggttatgattttgtatgtgcaaaattctgaactgtacatccagttgaacaaagtaaacatttatcaagcatctcctctgtgtcaggcttgaagtgagaaattcaaaggtgaaccaagcatggttccagagtacaaggatcctacaaagtaaaagggtaaaaaaaaggtactttggcctcccttcttccctcccatccatccatccatccatccatccatccatctatccatccatccaatgcaaggcatattgtaataaaggagacacaactctaggcagatgtcatgagcactggaatcagattggaaaactgagtctgccacttactaattctgtaatattgggcagaaaatgtaaacaagcatagcttcaattttcctatttctataacaagaatattaatggtatctatttcatagggttaacatgggaattaaagaagataatgcatattaaagttcttggtacatagcagatgctcaataaattaatatttattaaactaatgaattacaaataaagaaaatgttagggaaacacagaggggagctcatcaatagttgaagagattgggctaaaatttacaggaaggatggaatttgagatggtcttgaagaggattttaacacatgcagatggaagctatttcagacagagggaaaaaacatgagtattgaagtggaaaagaggaggtcatggttcagggaaaggtgactagtgggaaataggactgaagatgtaggctgaggcgatatcatggcaaatctttatctctacactgatgatatagacttgatccttgggcaaaagtgcattagtagggattctggagcaaggcataactgtggtttaggaagatcaatgtggcaacacaatgagtaggattgtactgaagatgaattggagatagggagaggagtttggaggcagcagtaatctcagcgagattacgtgaggattttaacaaagctggtgacagtagaaatggaggaaatagaaaagagttattatgaactggtgaccaaaaagatgaagagaatgaggggaggaagagcaaagctgaccctgagcatttagggagaaagaattgaaaagatcatgatgtcaactctagctcgagaacacagagaaaaggcaagagtttttgcaggaaggtaagctatgtgctagatggagagttagggaccttgtaggaaaccacgtgcagatgctcagtctagctggaactatgtgcctacagtccaggccatcgtccagaactagatataaggaagtggcatcagcctcatagggttaatggctgaaagtgtgggaaaggatgtcattgaaaaggggctaaaataactcttgatttaggggactagcatggtagattgaagtagatccagtgtatagtgggctatgagaactgggaactggaaaatcaagtaggcagaaggacgaaaagctgagtgttactaatagtagaggtaaaacatgaggctaatagagttcagggactggagccaccaagggaagtgggaaaataggaaaggatgaaaagattgaagaccaagggaaggccaaaaagtaggtcaagagggagtgagaaaatgagtgaggacagagaagaactttgacaattggagctgaatgttcagtagttttgagtcgtgcatttcaagatgcaaatggggtagatgcaggtcacttgggggaagactgctgggacctgaggaggtcagaggcttgggaggactgaaatcaccaaggatgaagctggtgaagacatgggttgggggtgggggctgaaagcctggtactaaaatcctagaggaagatggagtcatgtccagaaaacctgcagatgaggtgagaagaataaagagatggtacagtggatggaaatattggggcaaattgctgaaattgaagtgagtctgtggaaaacaatatgcaggatgaatttatccgtctcctattaaatgcctcaaagagttaaagtttttaagttggagggtcaaagaacatctatggaacaaataataatctatagatgtacaaagctagcaaatattttaagtgctaaaatgtgtggtgctggtcacaaatagcttgagcctggtgcctttgaccagccctcctgacaaacagcgaacgtgccaagtcctacaaggcaccgttgcagcccaggagagctaaaatctatgccctggaagaggtgaggacttgggatgaaccttgagggaggggttggggttgaagtgggaggagcatttcagtcaatgggagagtggataaatgagcagaggtgaagtgaacacagcatattctgaatatatcgcaagaggggtgcagactgggcgttatgaaggaaaaagctggaggaagatagagtgggaccagaaagtgaagggatgcagactgacatcgtaacaattcaaatgctaatgaaatattctcaacttgagttccctgcggttgtggtcatgggccaattgcagtattcagtttttatgaagacctccagcgtcttcatgtgtggtcctcaaatcctgaatacttctctcccagagcatttaccacacggtgctgctggtatgccagcctttctccttccaccgtgagccatttgagggcagagaccagaccatctccgcagcctctcaggctacagggtaccctgcattatgcagactgagagctctagaaatatttgtggcatgaatgaaagaattcatgagtaatagccgggcataaatcagaatatgcacttgaactgggctacagtgttccaccagaggccttccacatctaaatggaagcatcatggcacgaggtgaaattctaggtttctgaagaagaaaaggtaagaaggactctcaaagcctttgttaattaaaaacacacacagctcttcagggaacatttccctgcctcccattctccctcgttgtactgaatggcagataaggtggtgtcttcgcctatgctttggaccacatttaattaaatgcctacattactgcttcctcacacaccttattttatttcctttccttccttccatgctaaagagggccagggctaatactaatgcatatgctgttaaacctttttaattaacttcaacttctcccagagatttatgtttaaacagtaaattttttgttgatactcaaatacataggcggcactcggaatgatgtacgagtactcttgtcctcaaaatgattcttcatgagttaccaccagagacgttttcatgagcctcttttattaaaataataatactcagcaaggcaataatgctttacagccggcagctaattaacccaccccaccccccaaacaggtcagcattagcatctgcaggttcgcgatatgatcgcccagtgggtcccccttgtaccttcgagtcagcactgaatcggtctgggtttgtgctctagcatctgtgaataatgattttcatttaaaacacatctttgttcttagactgtagctcaatctattattattgttatttattttgttcttgttagtgccttcctgcactgggtatcagtatttctgatctgcagttgacctcttgaaacaaaatttaaccatgccttggaaaatccaattgatttaaaactcttgtctaattgcaaaatccatttatttttctgcaactctaaatttgtgccccaagtatttttttttttttttttttgagacagagtctcgttctgttgctcaggctggagtgcagtggcatgacctcggctcactgcaaacttcaactcctgggttcaggtgattctcctgcttcagcctcctgagtagctgggattacaggcatgcaccaccacacccagctaacttttgtatttttagtagagacggggtttcaccatgttggccagactggtctcgaactcctgaccttgagtgattcacccgccttgggctcccaaagtgctgggattacaggagtgagccactgcgcccggccaccccaagtatttttaatcatgatctatgctgtcaattgtaattgcaatgtagcaattctttgccaacaaaaccaatctacctacccaagctcctgttcttttcttcatgttgagacaacgtttttccccacaagccaatgtggtcatatcacatgttgcaccaccgatgagccaattatttcaattttggcatcagatttaaaagagactttaatgatcctcaatggtataaactgaatttttattcctacagcaatttagtaatgatgatgacacttaagcatttagaaagtattactcatcttccaaccactgacaaacaggaggctcggcacttttcattttaggcacttttctaggcaagtctgatggggacctcagcatggacagcatttcacaatatttagggagcccaggctcacccctgctactctgccaggagctatagaaagaaaaatctccaagccccagtgcttgtctgctggggtttctagctggaaatcagaataagctcccaagccttgcatgcccgttttaattaacttgtctattcacgcatccaacaaatatttaatgagtttctgctaggtaaggaaacccagccccaggagggagactgagatatatgaggtatacccctttccctctaatcaaattcaaccccacccctctcaccagggtccaagttatttgaatacttcatttatgcatacgtttactcctttcattcagcaaacgtttatcaggcaccttttagtgtaaggtactctgctgggagcccaaaagtttacagcgaagatcaaatctgtcagcaaatccctttggttcttccttcaaagtaaatttggaatctggtcttcttgcccctccaaggctaccccctggtccaagtcacttggaccctgtgcctggatggcggccagagcctcctaattggtctcgcagcttccatccttgtcttctgctgtctagtttcaacagggcagtctgagtagtgcttttaaaaacctaagtcagagggagccgttcctttgttcagaacggtgcagagcattccatctcactgagaatgaaagccaacaccctctccatgactcatggtgctctccggggtctggcctcgttgttacactttgacttaatcttcactcttccttttgcttgcttatacagtttggatttgtgtccccacccaaatgtcatgtcatattgtaatccccagtgttggaggaggggcctggtaggaggtgattggatcacaggggtggatttcccccttgctgttcttgtgatggtgagttctcacgagatttggttgtttgaaagtgtgtatcacctcctccttcacttcttcctcctgctctggccatctaatatgggcctacttcccctttgccttccaccatgattgtaagttttctgaggcctccccagctgtgcctgcctacagaaccgtgagtcaattaaacttctttcctttttaccccgtctcacgtacttctttatagtaatgagagaatggatgagtgcacttgtgctggcctctttgctgttcctgaaactcaccaggcatgctcctgcctcagggtctttgcacttatgcagttccctctgcctgggatgtcctgtcctcggtccctcccctgcttcaagacattgctcggtggccaccttcttggggactgaccatcttatttaaaatgtgcaccccacgcctataggagtactttatatccctctccctgttttacctggctgtagagtgcctatctccatctgacatgattcatctttatttgttcatttcatgtctcctccactagaatgtcagccccatgaagtcttagctatttgttttattgactgatgtatcaatgcctagtgcacagatatttaaaatttgttgaacatatatatgtatgtaatgagtgcatgtaataaatagtgctgtgataatcttcaagaagcacatgatcaaataggaactatatctaaaataaataatgagctatgttttaagaaagctagaaataaatatggtagcccaaagggtagaaaattcattttgcctggttgaatgagtggctaaaatcacagtcctacaatttcaggtgtgtcatgttggaaaatgtattagtcagttttcacactgctgataaagacatactcgagaatgggaagaaaaacaggtttaattggacttacagttccacatgggtggggaggcctcagaatcatggagggaggtgaaaggcacttcttaaatggagatggcaagagaaaaatgaggaaaatgcaaaagtgaaaacgcctgatataaccatcagatcttgtgagacatattcactacccctagaacagtaagggggaaaccaccctcatgattaaaattatctcctattgggtccctcccacaacacgtgggaattattggagtataattcaagatgggatttgggtgggaacagagccaaaccatatcattctgctcctggcccctccaaatctaaggttctcatatttcaaaacctatcaggccttcccctcagtcccccaaattcttaactcatttcaccattaacccaaaagtccacagtccaaactctcatctgagacaaggcaaatcccttctacctatgagcctgtaaaatcaaaagcaagctagttactccctagataaaatgagggtacaggtattgggtaaatacagccattccaaatgggagaaattgaccaaaacaaaggggttacaaggcccatgcaagtctgaaatccagtggggcaaattgtaaagctgcaaaatgatctcctttgactccaggtctcatatccaggtcatgctgatgcaagaggtgggttcccatggtcttgggtagctctatccttgtggctttgcagggtacagcctccctcccagctgctttcacaggctgacattgagtgtctgcggctcttccaggtgaacggtgcaagctgttggtggatctaccattctgggatctggagggcgatggccctcctctcacagctccactaggcagtgccctagtagggactctgtatgagggctctgaccccacatttcccttctgcactgctttagcagaagttctccatgaggttcccacccctgcagcaaacttctgcctgggcatccaggagtttccatacattttctgaaatctaggtggaggttcccaaaccccaattcttgacttctgtgcactctcaggctcaacaccacatggaagctgccaaggcttggggcttgcaccccatgaagccatggcctgagctctacattggcccctttcagccatggctgtagcggctgggatgcagggcaccaagtccctaggctgcacacagcgtggggaccctgggcccgtcccatgaaaccattttctcctaggcctatgggcctgtgataggaagggctgccacgaaaacctctgacatgccctagagaattttctccatcatcgtggggattaacattcgactcctcattacttatgcaaatttctgcagccagcttgtatttttcctcagaaaatgggcttttcttttctattacattgtcaggctgcatattttctgaacttttatgcttggcttcccttataaaactgaatgcctttaatggcacccaagtcacatctagaatgctttgctccttagaaatttcttccactagataccctagatcatctatgtcaagttcaaagttccacaaatctctagggcaggggcaaaatgctgccagtctgtttgctaaaacataacaagaatctcctttgctccatttccaaacaagttccttatctccatctgagacaacctcagcctggaccttattgtccatatcactatcaggcttctggtcaaagccattcaacaagtctctaggaagttccaaactttcccacattttcgtgtcttcttctgggccctctaacctctccctgttgccaagttccaaagtcacttccacatctttgggtatctttttagcaactctactggtaccaatttactgtattagtctgttttcatgctgctgataaagacatacccaagactgggaagaaaaagaggtttaactggacttacagttccacatggctgggaagatctcagaatcatggcaggaagtaaaaggcacttcttacatggcagtggtaagagaagaatgaggaagatgcaaaagtgaaaatccctgataaaaccatcagatctcatgagacacattcacttccatgagaacagtatgggggaaaccacccccatgattcaaattatctcccaccgggtccctcccacaacacataggaattatgggagtacaattcaagatgatatgtgggtggggacacagcaaaaccatatcagaaaagaactgcaatccacgtctaaatgagaaaatggttccttgctataggatttctcagctagactaagaaagtcttttgggaattggtgggatggtgcacagtttgcgtgtttcactgagtcttgataattattccaactgggaatccctctccatcttccccaaatctcacaaattccagtgataaactccactccatgtctcaaacagggactatttttgagaaccatgcatgctctttccagatatcagtggacagcatccaggggggcagagtcagtgtaatttctcatggctgattttgacaggagatgtcaggttagtcttagttatcctggagcctaactggatcttgggaataaatctcttattttggtagcactttcaaataagtggcagcagttcatgcataattacttctgaattatctaggggatttatcaggtttgattatagatgcataatgaatttaccaaatttgtgggtattatggagatattaattccatatgaaacctcacaattcattcatgtgccatttgttttcattccttttttataataagctaattagtttaaattatttgtacttgtacaaggtcttgaaacacatattaggaatgattataccagagaacccaataaatgagaagttttggagacagcattaattgtgatgaagggttcataaagcagtggatgttcaattttcccatttggggtggtaataacaggtctaatcatgacacctccataaagtcatgggaagtccctaatgaaagtttctgaattcagatatttaaatgatggtagggtaagtcattatgccaatgggagaatgaggcaaaaagcggagttcatccttgtgctaaccaaagaaaagatgaaatggtgagggctcatcaattctgggccaggaggaagataggcactagtaggtctgatctgtctggaggattcctttaaaaaaacccaaggttctggaggtcactggcaggctggaatttcagcccctcagagtgaagggatgggcttctttggttgagttccggtgtctgttaaccccccaccccttgttctttgtgtgaaaccagcacccactggccaaaaagcccgggttggggtctctgtgggttgatggatataaaccatcttctttacttagggcacaaagaagaaccaagacaggagaggaagcctgggccaagcctgcctagggagtctatcgtggtaggaacaagagctaccatgccttgagcccattctaaatggtaggcaagtgctagatatttggctcacacatttcatcctcataacagccctatggtgtagagaatatcattatctccacttcacaggtcagggggctgtggacaagaggtcaggccatttgccaaagtcctccactcaatctataggtagcggggctgggttcctaaggatgtctgattctgaagcctggtccttgatctctgtgctccatgaccttctgtaatccccacagtctcccaaacatcaatgctgtcattacaaccccatcacctacccttacccttaccacaccaaagagttactcttttttgaaatctgaatctcagattttcactttccaggcaattcaccaggacagaggcctttcaactttcctccctgagatcttcctccgtgaaccaacaacaaaaggaccagccacctcactggtcctctgttgccagtagaaaaagccctacaaggattaatgcaagaagaagttctgctttgggtgagacatcagtttaatttatatttgattaaaaaagtcattcattcatgcattcagcagccagtatttgttaaatgtctcctacactcttaattgggttttgtcgggttgtgggggtgggggaggggaaaaagagagcaggtataataaagcttatgccagacaccttgtttgtaattgtcttgtgaggaatatatgtacacaactgaaaagttaagtaaacaagagaatgatggaataactaggcaagtgagagaggcagacagtgcactatctacagaatccaacggaggaggcggtactggggcccgtggtggcagaggatgacggctttgcagaggcagaggaacgactgacttgctcagtgaaggatgggcagacttggggtggcagaagaggcaccagctggacccgcccaggaagccaagcccctgtgctgcctcagtttgtaagtaggcatttgaccttgtggggaatcactctctagcgcctcaccgtctttgctgtaagatggagataatgatacctcatggggttgtcatgaaattcaaatcaggaaatggatatgaaatggttctgaaagatgtaaagagcaatataaacaccagatacggaatgagaaaaaagcggcaccggaagtggcattttgcaaactccaatcccccaggaccacatgtgaaggagctcttttcaaggtcacacggacactctgacccgactctctcctggcagcattcaatgtgacacgccagggcaatgagaaacgggaggggctgcgtgagacatggcaaggctgaggccaagccccaaagttcacggacattccataaaaagtgcacggtggaacctgagaaggtggagaagggcagggatgcccctggcactttttttgtctctggtgctatcaaacagaaaatgtcacctttgttcctctatagccatttttagttgcaccaaaggggggagttgaaaaatagaccttgtagctgcctccatgcgattcaggggaaggtgataccacttctgcctagagggtgacccccacgcccagcacatatctcaccctcagtcacagcgaggccacagccctcgattctagaatctgatgtccttgaatctccctatcacgggctcccagtttcaagggcctctggacacatgaatttctactttgagaatcagtttggctgtgtttcggtatctgcattcagcttcacaaggctggtgagcgagggctcgtggttgggacacctgacaggtggcggggaagacctccactggggacactgattttattgctagaagttgctaaaggatgagcaacttagcagctaggacttttaccacttcagtgatagaatgtaaagtcaaccccgagaagatggatctaggatacctaaactgaaagtttttttttttttttttttcacagcatattgcaatgcaacagtgaaaggaattttaaatgggcagcttctccttttctcctacctccaggcatctgcctctgaaatgttgaaggtggagggagataggattggcctttctgggaagacctctaagaaaggggtttccattgagaagaaactacgggtaacagttaaagaggaagagcatgtgtaatgtaggaagcgcttttgcttcagatagatgtccttccctcaccccagagcacagtaaccctaatgctatgtcctgcatctgtctggaggggttgtctagcctggcccacatcctgagccctctccacatgggcaaccacacagccgacatcgtgagaggtctgagcccctcagactcttgaaggtcaatggatattgtgtatcttttttctacactgcttcaatgcttttcaaccattatttttttttatttttttatttttttacaaccttgagtgttttaacgatttgcttctttaaaggctttgcttccctctgaatattatgactagcctattgggtcagaggccaggagtctgcagaggaccattcattcaccccagaggccgctccttgcttttatcctgtcctcaacatgatagctcaaactgccagattttacataggaggaaggaagacaccgaaagatgttcctagctggcacaggctgtgctgaacacaggtctcaccccactgtgggcaggtggtggtggagcacatctgtctctctccgtgttggtggctgtgatttggcagctctgccgaagatttgtgagatggagaagaaagtgcagggttggggtacggggaaaggggtaagaaaggagattagtcacttgagtcaggataatttttcctgatgtcaaagcctcacccaggagagctctcgctgttgcctgcttttatctggaaaacaatgtgagcagtatctctcaaaattaggtcagggcttgcagaggcagggacttgccaaggtgctaactgcctgaatcctcggtgggtttgcacagctctctgctctgacaaatgcctcctttgtctccctgaaaagcctgcctcttttctccttcacccctccactccccccacaaacaactgaatttggaaggttaaaaatcacttcacttgtcaactcgaaagctctccctcccacctcaagttgtttctcttcctgcccagggaaggcagctactgtgtgtccccctggggactggaaccactttgcaaagagcgcagatctgcagttttcacaacgcagttgtcatctcgggagcagtgtgtgcccgtccaccctgggagaggcttatgaaggctgtgtctcaagcatttcagggggctgcagatttagggggacagtcctggtggcttggtcttaggcttgtcttggctcaggtttctgtgtggcaacagcatgataaaaattctgtccactctaccaaaatgggagaagcaatagcaagacagcagggcagcaacagtcagttcttgtctggctttccaggacaacgtgactttctcttattttttgttcctgacactgtttgcactgactaagatatcacgatgatgaaacactgttgaatctaaaaggtgggtggggctgaaggaggggtgggaggaggccttagaagctaattagaatcctctagaagtgtgtggaaatgggaacctgagccaggagagtcctgtggattcactagattctgggactataccttatctatgctgtgcaaaggaataagaaactagtgctgtctcgggaaccagcaacacagatgttcccaggagcaatgtttgcaggtgagtgaggtcagggagggctacagagttaggactccgaagtcagaaagatgcctgttggttctgccgttcatatctgtgagatatcaggctggtttcttaaccataacctccatgattcagtttcttcatttgcaaaataatttaaataagataatatgttgaaaactcttagcacccaataagccttcaaaattataattgttttgtatgttttggcaagaaaatagaataatattattattggagtctctggaaaacctaggtttccaaacctttcaccttaagtagatttttataaaatgagacttcacgtggaatctcaacatacaaaattggcataagtgggggataaggcagcaggtgacagtggttgcgtgctcctgggcaccgcctgcccagcccctgcactgattgtcttacccacaggggcagtttaaatcttcatgcttttaccaccttatactgagtaagaagatgaatttgcacagatttctccctgcataatttctccgtatctttagcacagtttggtgatgacttttaagctttgacatcatgtactcataacctatctcttatgaaaataaatgaaactggctaggcgtggtggctcatgcctgtggtcccagcactttgggaggccaaggtgtgtgcatcgcttggggctgggagtcccagaccagcctggctgtcgtggtgggaccccgtctctactaggaatacaggggttggctgggcatggtggtgtgtgcttgtggtcctggctgcttgggaggctgaggcatgagagtggcttgaacccaggaggctagggttgtggtgagctgagatcatgccactgcactccatccagcctgggcaatggagtgagactgtgtctcaaaaaaaaagaaacaaaaaaaaacagaaaaaataaatgaaaccatgattttctctcacactgtattgtgtttaattttcatttgtttattctataaacatgacaggcttttgaactttgtattacctatatattttataatagatcatgcataatctctcaggagaataaaatgagaattccaaataaataattaaataaataaataaataaataaataaataaatcttcatggaatctcaaggctctgaggggcctagttagacaactgctggtttaaaatattagagaaatagtgggccagttccaaaaaagtagagccctgatgacatccagccagttaacatgttttagtaaccaagcaaaccaacccagaaagacatggatcaggagaaacctccatatgtggcagggcacaggtctgagaggtgagtgctggaggaaccaaggccagagtgggacaagctgtttagcaaagaagggcagtgtcattcctcttctcacccagtgtggggctgggacgtgtgggaactcagggcctgtagatgggttgggggtgaggtggagtagggagatggagacaatgacacagagacagtccgtccccagcccaaagaggactgcgctagcttgggagggaatgagactcagttggcatttctgcacatggtctgggtggacctgcgcaactctgattgtgtccatgtagaaacctgtgctgtgttcagtcactgtaatgcttttgtagttctatggctttttccccttttgcttccccttagttttcagagaaattccaatcaggctttactgctatctaccggaagagacaagaaggtaatttgaccagatcaagaccacccagcccagcagagcgcaattcatgaccagtccacagagctctcctcccggatcccatcagtttcacagagaagatggcattgccaaagcctggggctgctcacccaatccctttgtgtctgtcacagctctcccatttctggaggagtcgagttagcccctccttctcctttgaatctcttctctttaagactcgcagcttcaatacccaaatgctgccatgtctgtagtggtaatgcttggaataacaagtagttattgtcatacaagaagaataaggaagcttttgatgatctcgaataatgtggatatctacatcatttttgcatgtcagtgggtatacccagctttgagggaatggttatttttatacctttcaagacttggtatgcttaattatctagggaaactcataaccccaacttcctaagccactcctaaagaaaaagcacagatgcagtgactaaaaactttctggcctccttatacttcatctcagggctggaggtgactcagatgtaccttgctattttcatgatccattggtgtctcagtaatgaatgttcaccactgcagtgccctcatttagcctaataacctcagtaaggtaatgtttgatttgtgctaagtatctgattaaacaacataaagtatttaacctattgatcttttatactttgccagccctacattgctggatatactttaattactgactcggagagctttcctgaatgggatctgcatctcgttaagactttttctttgtctttaaggtgccatatcaacagcttctccttcttgttgcctctaggcttttcttccacttcctgctcctccgccagaccctgcttgattctgcaagactgacgtttggttaatctactgaaagtagagtcctttatgtaaccatgaatcttactgcttattttagaaagtcaatgaccacataaacaatcggacttgttactttgtccaccctgatctttggagcatgggaagttgtccaaagtgacaaccccattttaggcagttggtcacagctgttggatggacctaacccttctatctcacaaggagacgaggccagtgggcatccatcaagagaaattataggaaaccatttagactggccaattggttagctaattgctctagtctaaaccacttcttagaaaactacagaaaatgatacattttccctcttgcctgcaaggatatagtcatgaacgttaataataattagctgctttacatgctgtcttttcttcaagaatctcagacatggtgagtttatttattttttctcttattttaaaactagatctacaaaggctgagatagcttctccatgggtcctcccaaaatgagagtgacacctcataggattaagagaattcaatgagaaaattcatattgaacacttatcataatgccactgagtaagcactcaaaaaataggagttatactattagttattattagttatatcatctaagaagcctgcgacttgtgggttgcccatgaatttctgaatagagtcaggctgggaggaaggcacactggtccaagtgtctagttactttgtccagaccacctgataaagactgtctcaccctgtgtgccaacatcctttggtctctgctggcccatcacacataggtcttggacaaaaaagagtggtttgtggaggattaaaggtcatgaaaaggcgaacattcaccttcactcaagatgctgcccgaagtcagatcagaagcagagtcagaatggctctctaaacagcttctcaaaggatgccttccacgggctgatgtgcttgataacaatgcaaatgcaaggaacatgccccagacaactgaactggaatttctatgagcacagcccaggaatttgcaattaaatcaagctcgtgggtgattcttatgttcaataaagtttgagaagcatactactaagtgttgcctttaaaggcaactcgaaaacttgcagaaaacatctaaagaaggctggaggtggcctggtgcttattgtataagagcatctggcaagctccaccctctaggtggcattctggtcttgaaaagcatgataaaaatttggggttgctactaagcagggacaattgcgcagcttgtggagtggcttggagacctccaatagccctgctaggatctggggcagacagtgggcaccagccgatgccagggtatgtgaagggcaaaggaggccctttgggggaagagaactgtgaggccacaggactactgaaatagagctccatgcccttctccattgcctctgtaaataccctggggatcacttttactctattttctggcttctctgtcacttgtggtgcagttgggatgcttactttcacttccaaatgatgatacctcagagaatgcaaactgtaatgcacataagacacagacaatccatggaaaacatgatactgctgagacgtaggcacatgttcacactgacgtgcattgcatcattgcatttgttccaaagccggtaaaaatgattttcagataatctgctattttggatcgtctgcactgctgcttgcttccattagcatggctaattgagaactgactgtgtgtcttggaccatttccaggaagggaacccattgcctgtataatacaggctccctgagagagccaagtaaatggctggaaatgtcaggttgaatgcccacattggaggagcaaacttttgaggacgacctgaccattctcaggccagagaagcaatcttgttcagcatgtcacattgattgccaagtcagtaaaccataaaactgtcccacagctagaacatgcactgactctgagaaagatgaggcttggttagtaaaggatgaagccattccaagaccaataaaagatgcaatatggttttccctgggctgtatattaacaccatcctggcagctataggggatagaggcttggcaaacaactgtgttttgctttgacttttgcagagtgaggatgagatagaggccaatggggagatcatctgaggccagatgaaaggcttggaaagagtaagtctttacagaaacctagtctctaaagaaaccactgatgtttatgtgtcttggccagtgtcttctgtcatataacatcttggtgaaataccccaaatagatcttaaaaccaaaacatactaagaaaaaaggaaaatagaaagcacaatgttgtaactgccttctgggtaaccatgttttggatggtgtcatttttcttatgacataagctcccagatggcacagacactgtgtctcagaaaaaatagcaactagcagagggtcatgcctcatgtgagtttctgtaagtattgtttggttgtgtgttgtttatcacaaagagaacagatactattgtcagacaatctcaccagctgcattttgcaagaagaatgagagaagtcccctacaacttttacaattctgtgttctgtcccaaataacgacgagagatgaatcacctgggctgaaggataattgaaggaggaggcacattactcaagaaggtcagaaagcctatgtctaggattaatctgtgctcatggaatcgtttctatgtgttgctaatagctagagggtctgctgatttcatctgtgcccagtcaactccctgggcccacctctaatcaaaagcagaggacataaactgtgaagatttccaggatggatttctgaggacagctgtctatagcttcagatatggcactagacacagtggtgctcatcattggctgcatgttagaatcacctgagggagctagaaaactatggatacccaggctccatccccagagattctgatttaattggtcagggatgggtcctctgtatgaataattttaaaaatcacctaggagattttacttgcaagcagggttgagacagcccgagctaaagcctctttagtggtatgagggaaaacaggaggctctggctcagttcacaaagttgaagatcaaacccagccttcgaaacagcattcttcttctttacaggatgacaggaaataaaagactgtgggagttggggtttgggtaaagaggaaagaagggaagggagaaaaaaggagagagccaaaacgcccattgagaggaagggaataagattgattttcccctagtagtttttattcaaccagggtctgaaatgtgctcagtctacctcatgaaaagtgtgtcacccagggcacactggtgtttctatcgctagtcacagaggcttcgggcaactgctgaatggcagcattagggacccataaaaggaaaaatgcattgctatgactaagagcccattaccataacaattgtaaatgactttggggagtctgcccattgaccatcaaagaaaccagaaaacggggccaggccccttggagagcactagaggcttatgaaagccatgcactggtaatgttagtgtcttagtcccttcgtgctgctgtcacagagtacctgagagtgggtaatttataaaaaacagaaatttatttcttacagttctagaggccgggaagtgcaagatctagaggctggcatctggtctggtgagggccttcttgctgcatccttatatgcagaaggtggaaggcaagctagaacaagttagccaaacactgcataaagcctcttgcataagggcattaatcccattaatgaggaaggaagtctcatagcctgatcacctcttggaggccccacctctcaatactgtcacgttggcaacacctgaattttggaggcgattaggtttcaacatgaattttggaggagtccaaaacattcaaatcctagcagttggagatagcaaagcacattgtatgatgtgacaagaaagtcacatggaggcagaaaaagaagaagagacccagtgggtcaccccaacttcaaatgggttctcaacattaactttctagagtgtaggattttactttttccaaagtcctttctttttttttttttttttttttgctccatctctctgattcttactcatgtatttctactcagaactggagccaggaatccatactccctgttcactgtcccttctggcagaaatactatggaagagcagatgtcagtgatactgcccgatcttggcaagggaagaaccagcaagaagagtgcagggcatctccacacgtgggactgatgagcatggggagtgtggagtgtgagaggcaggagagggatgtgggggaggttttgatatcatgtctggctttttttttttttttttttttgagatggagtctcgctctgtcacccaggctggagtgcagtggctcgatcttctttcaccgcaaactctgcctcccggggtcaagtgattctcctgcctcagcctcctgagtagctgggactacaggtgcatgccaccacacccggctaattttttgtatttttagtagagacggggtttcaccatgttagccaggatggtctcgatgtcctgacctcgtgatccgcctgcctcggcctcccaacgtgctgggattacaatgtctggctttaacaagacaaagcttttgatagtttatctcctgcaattcctggttttctctaaggtggtgctggtttctactacacagggagagggatccacttgtcataattaaaacatctcatggaagcgtatgcttctgtgctttcctggaaaatgtactaatagctggggatggcaggttcccagggaagtggcacatgacatgtcaggggagtccagcaatggggaggcacaactcctaggcccttagatttgtagcctctgaacccattgcatcctggagccagttacagatttcatctgagggacaaaaggagagtgagagacttggaggctccctttggagctctctggcaattcatgattgttgagcaagaaagatggggaatgaggaattagttttcactgaattgccacagggcctgctctgactataagcataggagagccaccccagtcctgtaaagccctagagttgggctagcaggggaaagcacaaggtctggagattggaaggaattttcctgagagtgtgtgtgtctgtgcttttgagcctgtgcccctggcacaagggaaattaaccagactctgcatgttgtgggaattctgcatggcaacctaatagaggcttagcttttcattaaaatttccattaatactggagctgtttagagcaagttgaatgggaatatccataatgcacctcctatcctctattaccattctgaggatcagagtgaggtttcaggcttttgctggggccattagcattttttttttttttaccatcattatgatcatcaacccagcaccaattatgtagagcaggcaaagtacaaagaggctcacacagaacctatccttgtcctatgtgacaggcagggcaagagtaagagagcaggcacgcagaggcagagagtgaagtctagtgagaccacacggacatggactttccagtgttgagaagcacctccttcctcccacctgcctactctaaatgaaacagctctgtcatactgggctagagcaatctcaggtgcagggaaggcatagatcttctgttggaactggggatactgaaagggatgaagaagttcggcctcacctcttgaggatcatttctacagcagagctgcccagaggatcaccattgttaccagctccgatgtgcccttcctgcatgccaaagccagttctctcttggagatggccactgttgctctctgggctgtgggacatctaggaagctgatgtccttgtttcagggtcctgggaggctgtttcaatgacatctcatagagacactttcctttctaaccctggctgcagcctcatggcactacttcctcatctatgaacctcttgtgcccttagacaggggggcattccctgcctcaaccacaggtagctggagctcattctacagtgtccagagtgaaacctgtcccctccaggcagaatgaactgtgctcttactctgcagccttcgacacattattcataacatgatgattattttggagtgcgttcttttgcttctcacaatgagcagacactctactttatccagcttgtatcctctatgctaagtgcacagcagattacatggtagttccttataaattttttaaaaattgttgtagatttccttccacctgcctgaggtgaggctcaacactgttactgatgaaacagtccatgtgtggaaaaacagagcccattaaaaagaaaacccaaacacagctaatagtctgggaatggtgtctgcaggatgatgcagttgacacattctgtttgtgccacacgtgtgttttgtcactgagactgccagctctgaggggaaaaattctactataagaatatttaaaataagattgagtacagtggctctttgccaggtgtgtgtttcaggaggcattttaatgagaacatgctgtcatggtctgaatgtttgtgtttctccaaaattcatgtgttgaaatcctcacccccgaggtgatgctattaggaggtggggcctttgggaggtgattagggcatgagggtggagccctcatgaatgaaattagtgaccttgtgaaagaggccccagagagctgccctcttccaccatgtgaggacagagaaagaaggtgccatccatgaaccaggaggcgggtctggaccagacatcagatctgccagcaccttgatcttggacttctccacctccagaatggtgagaaatacatttctgttgttcagtctaagatcgtttgttactgcagcccaaatggactgaggcacatgcttcagccccagtggtgaagagcacagactttggaaacatgctatgtggacctgaggtctgcctgcaacacttagctgtgtgacctcaggaaggtttcttaatctctatgtgcattcatttttcatttgtaaaactggaatcataatagacccatcaccttgtgccattgtgaggatgacatgaggtaaaaatatatacaaacttagagtagtttatacttatactgtgtcagtctaaagcgttgttgctattaatgaatcagaaagcctggaactatgatctggacctttttattttgaaggcgctcctcggagattctgatttgcatccatggttcagaaccacttgcctactgcattgtctgtatcatagaagttgaggaaccattaagcattaataaataagtgcagcaggatcttggttccgcaggaagagtgtggattcttggaatgcaattgtcatgtggcaagttatttcaggttttcttgttatcctcctccctgtatctataatggacagccttgggttttacctcctgtccaggcacccgttcctctttctgcagggataagagtgagcatggaagtacttaagcaccagggaaaggggagaaagaaaaagtgggggtaatccaccaactgtctaaccatttcctgaaaaatagagggccaactaccattagagctcttagaggattgctgagccttctaagggtttaccaagaagggacaaatctaatgataagaaagttacagccaagtttattgaacaataacccatttccttcatgtagaaacaatgaagaaacattttttctcacttacatggcacaaggaaaacaatatcaatgatttgtgctgcctgcttgtcgagtctgtttaccaacttggcttatttttttactgcatgatatgaacacttagggttaaacagagctctctttttctctctggtgaggtttttgcttttcccatttttatttgtattgactaggaggtctttcaccagaagaataaaagaccatgcttttgaggagccagtcactgagtttctctgttgatcaatcaccattgctggtacaggtatattcattttgggtctgggatggatacaggtttgatgaaaggtccctggggaatgagagggcttagccaacagtctcagggtcagcatttcctagtcctacaagattcagatccctgatgtggagccaaggaaaggcttgagtgactaggggtctttttgaacaaggcactttaatttgccaagaactctacatcattttgtacaatttatttcagggagagatatcactttaagctaaaaaacaaaggaaaaaagctccagactactccatgatggaggacaaagcatctcagtaaataactttgaaagtcaagagttacaggaaataaaaaaagaagacaatcagagaatgtgccactaatgaattcaatcgcagcaaaagtccatttccattcccttgaactctacacaatttccagttgcaaatatctttcagaagtactgtacacacacagttggatattgagttgcttgacaaacatttctgatcaaaactgcttgcctagaaatggctgctggagcaacaataatgtggatttagaatgagccgggctgtttgcacataggtgtagtctatgagtttaatggagttttgcagaaggcaattgcctagaaaatagtgggtttttaaggatgaacttttgactcccaatgcgaggtgaagggaagatcgggggagaatagggagagaagggctgtcttttctgttttctctggggcaccatggctataataacttctactttgctgtgatggactcagcaatcaatttattctacgatcttttcccagacacactctcaactcatgtcggcttagttgaatggtcaccctacctggattctgagacccttcttggggcctcaattgggatatttacagcttccatttttgagaagtgtgtgtgtagaggcactaatttaagaacaaaaaaggccagtgacatctagggaaatgtcttcactttgggcaggagtgggatgaccctctgaaagctgcacaaaaggccacagatctggccgatctgaggagactggtgttttctgatcttgggacaaagcagttaaaatcctggagctcttgcatcttggagaaaaatcctgtagcttctttctctggggcaaggggcaaggctgtttggtcacactgtttagtgattcacagctgggaatcttctgtgtctgaacaatttcagcccctcataaggggttgatagctgagcccctgtgtcttagtcagtttcggctataacaaaacaccataaactgggtggtttataaacaacagaaatttatttcttacagatctagaggctgaaagatcaagatcaaggtgatggcagatttggtgactggtgagggctggcttcttcataggcagtgccttctctctgtgtccttacatcgtggaagggacaagaggcctttcttggacatctttcataaaggcactaatcccattcatgaactccgttttcatgacctaatcacctcccaaaggcctcacctcctaataccgtagccttggaggtgagaattttagcttatgaatttgggggaatataaccattcagaataaaacaccctggctatagaagagaggtggcttttcctctccccagacagcttccctttccccacagtccaaccggctgtctaagcttagggagctgcccctggggaagaggagccctgtcaactgcacccggaatgatggcctttcttcctgttcttcctcgttagtttcttcccacttctctaggatgacagagaggccccccttctcggttttctcagatagcatgccatttgctgtctcaaatctataaagagctgttgggaagtttctgtttttctttctttctttctttctttctttctttctttctttctttctttctttctttctttcttttttctctttctttctttcaaaaaagttcaattctcctaggtggctcacctgggcttttaataatgtttggctccattttaaacccctggctctgagtgtgctgctaagaatctattcctataggcgtttggtcattgcagggttaagaaaatttgagccgttcctttcctgcctatgttggggtgctgggtactgacagtaagagtgtccaggatgagggaatgcatgtttccagtgactcctgaagttttattcacctgttagggctttccatcccaattttcatccctttttgacaattcttggtaaaagctttgcaagtatggagctaatcaaaggatttctggctcccaacttgtctgctctttgttttgtttttgctttggttttttgcttctctggggtatgggtcttcatcttgtttgttatggcaagaattccctttagtgactagtgttgggagttgttagacccattgaacagatgaaaataaaaggggtctctagatctgggatcctggcactgagtgaagttttccttcagcgtatttcaaacacgtgcaagatcttcctccttccctgagacacttacctctcctttagttctcaggtgttggatcatgtcctctagaaaacttttccctatttaatcccatgtatttttaacccactaacataatccccaatgtttccatgtctttagttaatgcttgtaatatctatgtatttaagggcttaatcatgggcggttagatttttaacttctggttcggactaatacatcttttccagtgcatgggtacagatctcagtagcacacatggaacatttgctaactccgtggttgactcattcaagccctcccacgagtcagattacccagtcagccagtaaatgttggaggactcctgcacttcctcgtgggcttttctctcttctccatttacatttttctctcaaggttttgcatgaaactccaaggctttaaataccattgagatacagatgattttttaaattataaatccagtcttgacctatcccttgggctaaagatttgtagagtcaactgtcttcctaaatctttttttggaggtctaataattaccgaaaactgtaacatgtacaaaacagacttgtagcccccaccctgcacatctgtctctctcccagtcttcagcatgtcagtgcattgcagcaccatccaccccgttgctcaagctcatgcctcagtctcccctgactcttcccattccttctcccagcacattccacacaccagcatgtcctgttggctcttgtttcaagatacatccagaatctgttcacttctctgcactgccactgttccagtccaagcctccatcaactcttgcctgagcttctgtattagtcttcccaactggtctccctgcttctctccttgccacctaaaatctatgccccacatagcaggcataatgattttaaaaaatcagcatttgaccaaatcgaatggctgttcataataaaaactatcaaataactaggaattgaagagaatttcactaacttaatataaagagtataagaaaaacctagagttaacatcatacttaatggtaagagactgaatgcttttgtcctaagattggaacaaggtgagaatatctgttctcaccacccctattgaccactgtactggaagtcctagcttagtgcaataagataagtaaaagaaataaaaagtgtggagacttggaaggaagaaataaaactgtctttattctcgggtaacataattatctacataaaaaacccaaagaatctgtaagaaaacacctagtaagtcaatatagcaagattgtaggatacaaggtgaataaacagaagttaattttttcaatagaaagttggaatcgtggtaagctgcctaccttgccccacccttgggggctacattttagcttttactgaatggaatgaagaaagataaatacaaatttgtgtctttaacgaagaaaaaattaactgctttcctccataccaaaaataatctcaggaagtgattttgtagatacaacaaacttaatgtaaattttgtatagaatggcgaaggacctagaacagtcaccacaatactaaataagaaataagttggaggactcatactacctgatttcaagacttactataatataaagccacagtaatcaagacagtataatactggtgaaggaatacacaaatagatcagtggaacaggatagagagcccagaaatagacccacacaaataaagggacagtgttttcaacaaatggtggaggaacaattggccatctatattagaaacagagactagacacagatcttacatccttcataaaaaattgcttaaaatgaattatacacctagatataaaacatgaaacaataaaacttccagaagaaaacactggagaaaatctatggccttagattggtgatgagtttttctccttttttttttttttttgagtcgaggtcttgctgcactgcccacaccactcttgaactcctgagctcaaaaaatccccctgcctcagcctcctgagtagctgagattacgggcatgagccaccatgcctggttggtgatgagtttttagatattacaccaaatgcatgatccataaaacaaaaaattgaaaattttggctttattaaaattaaaaacttttgctctgctgaagacattcttaacatgtgaaaaagacaagtcattgaccaggagaaaatatttgtaaatcacatatcagataaaacacttgcatctaaaatataccaagaatcctgaaaactcaacagtaagaaagcaaatggtccaacttaaaaaatgggcaagagatctgaacagacacttcaccaaagaagatacacagatggcaaagaaacatatcaaaagatgatctatagcatctgtcattagggaaatgcaaattaaaattacaacatacctctacacacctcttagcatggctaaaatccagaaaagctgacaatactggcaaggatatggagcaacaggagctctcattcattgctgctgggaatgcaaagtggtacagccactttggaaaatagttttgagagtttcttaccatgctaaacatagttttaccacatgatcaagtaactgcagtcctagatatttacccagctgatttgaaaacttacgtgcacacaaaaacctccacgagaaggtttatagtacctttacttgcaatcatcaaaactggaagcaacaaagatgttctccagtaggtgaatgggttaataaacttgggttttttaaatacacaattaagctataattaatagcatgccccatgcataatcacagagtaaaacaagaaaggcccagcccattaggtcaaacatgctgagtgttgtggaacagcaaaaatctatttctaaagacttgaacagtagctggaaacataaaagttcagattattggctcagttggacttgattatatgagactagtgtgtatataaagaccctaaagttgggagggtatgtttaagagatacatgaaaccagcaggacagggtggtgctgacatcactttactacaaataaagttgttataaatccatatagtgggatactattcggcaataaaaagaaatgagctatcaggcgacaacatggatgtatcttagatacatattgctaagtgaaagaagccagtctgaaaaaacatattgaatgattccatttatatgacacttgaaaaggcaaaactatagaaaaagagcagtagttgccaggggcgtgggcagaggagagggttgaatagatgaagcacaggggatgtttttaaggccgtgaaaatattctgtacaatactgtaatggtggtagggtataataaaaatatacatattggatctttgtccttggttcccagcatggagctgggaggatacaaagaataataccaacagctctgagagtacatagggaatttgctatctagtcaggtacgtgttacagtgtctcttttcttctatgtccagtgagttcctcccttacttgttaaggacctaaactaacaatctagttaattaaccaaccaattccctcactcgtatttgcattagtgtttcaattgctttgcgttaaccttaagtttcaaaatttcttaagccggttttcagtaatctgcccttcatcaaattatagaaagtagcataacaaataggcttgagtttcctcatctcctggccctcctccgtctctggggaaaatattaaagacagaaatggtcccccagtgtagagctggagccaggaagcaggaatacagttgagggctaggataaccaaatgaaaagcagagctgggtgttgggcaaattggttgtattccgcgaatgcagacagctacacctgcaaagacgcaggaatgcagatgatcagataaaccaagttcaaagaaatgaggccacacttggctcgaaagagcggagaggttggtgggtcagtgagataattgtgctgcttgttcagaatctgaaccagtcccgtctgttatctggtcaggacaggtggcttgcaggcagagtttgggctcaggcaggtggcaccaagaggaaaatttatggatagacctttaactctggtcactttggagcccagcagctctggaaattggatccagatggatagtattttgatagcttctcctaaccaaggaatttatgctgattttcaggacccaaggggaaggaggaagctcctaaaggcaaggaattcataattgcttcttaccatgtttccaaaattcatctgtgttttcactcaccaccacagtcagggctggcacagggactggggaatgaaaaataaatgagggctcagggcctcactcatcacacgtgtgccttccatgggatgtcctggagcaggacagggaggagtgtggggaatagtctcctaattcaggaaaaagtctaggttgggtctgtaagatcttcctccactgagaaatgtattaatccttgccctgctcatagaagcaatgaaagaagctctaaacaccgggatggatgttcctccctccacatttgggtttttgcgtgagttaaactactggaagggtggagggttctccctctgtacggagctcagtacaggccaggagggcccatctatgtgaacacttctctgaaaatgaagctacttctggtcatagctctgctgttaactgtgtaatatgggtaaccccttaactgcctctgggccatggtgtcttcaccggacatttgcatgagagccagaggatggccaggaccctttcaagctctcatcttcaatgctcctagaatctccgttggaaaccatttggctctgctggaatgttacagaaagaaggcaagggcaattcttcttttctcatgaatgttttgggaattctgttgcttggaagagacttcaaagactgtatcttctgcttctctgtgagattcatctccaatttatgtcacaaggagatgggattttgaaggcatactaggtgatctccatccaggttttcatagcttttgcaagcacttactgagcacctgctatgtgccagaccttgttctcataagtcctgatttcatactaagacatccagacaaagaggtagcataaacaaagggcttgagccagtaaagatgataagcaggatgaagaatactgttgctcagtccccagtcagatagagcatccaacaacagcctgcccagctactctcagaatcctgacactgtggcccagtgcccatctcctttcctaattccaagcaagaaatcatccccaatactgacattcaccaacagcccttgcactgcttggggacctacaaaaggagattcttttcatttctcttccaaatttcatggcaagggcatttggaggagttagtggagaaggatggcaggggctttgagttgtcatcttttcttaggagctaagaattttaaattgtacttaattgctggtcacagtcaatggattctaagaatctgatgtgcttaccctgcacactcccaccagtccctcagcctgggccagccataaaaacacattactggtgtctgccatttggatggctggaggagatggcgtagtgagttttatttttacctgaatagtggggagccagctgatgtggtgcacctcgtgttaaccaataagcacctgatgggatttgcctcacgtcaagaggaagaaggggctcttggctctactgggccacatcccagttcagtgtttgtggaaggcattcaccttggagcttgttgcctgccaggccccactcttagggcctcttcgatgctggggagaatgatgtcagcaccacccattcctgctggtttcatttatctcttaaacataccatcctggcattggagcctttacatgctagtctcatataatcaagcccaacagaggcaatgatctgaccttctatgtttccagctactatttatgtctttagaaatggttttctacattccatagcactcagcatgtttgacctaatgggctgggtctttcttgctttcctctgtgattatgcaccaggcatgtaattaattatggctcaattctatattttaaaagcccacaactttggactgagattacaatgaacaacatttagcattggcttacctctgctttcacgtggagctgagagatggagttaggtagtagggagtgaagtttgttatgataggattgaaacctgcaggcagcagtattagataatttttctctagctggggatctgggggtggtggagaccaagaggtcaatcaccagcatgtaatgtggggccatcccaatgcctactgtcgttgccactcccaagaacaaagagcctgcttcctggatgactgggagccaaccatggtggaagtagggagtaaaaaggaactaacagggtcagctcatgaaaggttttgtaagccaagcataggaatttgaactttattctgtaggtaaagggaagtcatttgaagcagggaaatgatcacttcagcagctgtatgggtaatggattaatgaggagagactggaagcttggaggccacttaggaggccacagcagtaatccaagcagagaagaggaagctgtttaataggcagaattgaatgaacgtgttgactgaaagatagaaggagagggaggtgttgatgactccatgcttttggtttgagaagctggatggatgatgatgttaacaccaagaataagaaatccagtaggagggagaagtttgagaaaggaagaggatgccaggtccagtttgggacatactgaatttcagatggtttggggacattcaggtgtttcattgtttggccatgtaggtctagagctctgaagagagacttcattagagattacaagcaggggtgtcatcagcatcaaggtgctagtaactatcacgggcaaagatgaaatcagctaggaaagaaagcacagaaccatcaggagggaaacactcagggccaggccgaggcagagaagcttctggagggcagagactgagaagatgctttcatagcctggagtgaagtctgtcccatctgtcctatctcagttcaggctagaattctctcctaccctggggcctctctagtcccccagggccactgggctggctctgcagttggccacactgaggctgttctttgaccagtgtttctcaaatttgcacctgcagatgttgtattgttttgttttgtttgagttggggggagatgctgcgagtcctttaaagaacctcccatagcagtctgtgaatacgtattctgaggggtctttgagttctcaagttcaggaaactcagacgtggtcctggactctccttgcctggacttgaggtaactgccttggcctccctaagccaaagatgcatctgggccccatatgcgacccagggcttcccatggcaacatgtggtgttgtttttactactgcaactttttatttttctttagagctgattttttttttttccttttgagacagagtctccctctgccatctggactggtatacagtggctcaaccacaggtcaccgcagcctcgatctcccaggctcaagcggtcgtcctgcctaaacctcccgagtagctgggactacaggcatgcaccaccacaccacgctaatttttaaaaaattttttgtagagacagggtcttgctgtgttgccagggctgatcttgaactcctgggctcaagtgatcctcccgccttggcctctcaaagattttttttttttaacagctgtattgagatacagttcacatatggcccacttaaagaatacaattcagtgatttttaatatattcgcagatttgcacaaccaccaccacagtccatttagaaccttttaaaatcaccccaaagaaaccctgtacattttagctatccccttagcctcagcctctccctccccatcacctgggttttaggcgactactaatttactttctggctaatggattaatgaggagaggctatagattcccctattctggacatttcgtataagtggaaccatagactgtaactttttaggattgcacgttcccatctgataaccgaatctccattctggagaaaggatgttggcatagtctgggtgctttgctatctattatctcctctaattctcaccacctctttggaaagccagccttatcaaccccattttagttgagagtgctgaggttcggaggtgaaatgacttgtcagaggccccagggacagtcagtggaagcacgctgaacagggaggggcacccagctctgtctggctgcattcgctgagctgtcgctgtgctaggtgctgaagcagggctgggatgggggtgtgaagacagaaaatccaccagcagctcgcacgagtgggtcctcccagaatgagtccaggggagccccctggaccaaagcaggacagagctaattccaggaacaactgcacatttgtccactggttggagtgagcctcccccttttactgcatctccacgaggcagaggaagtggcagtggcctgagccctcagatacctggtgccctgggaatgttcccaaccagatgattatggctgttgtcaccaccaagccctgtcttgtcatcagcctcagtgtcaggccctgggacccagagacacaccccgtccccaggctccagcttcatggagcttcagaatcaggccctgttacacccactgcagggaacttatcatctcattataaaggataaggcatattttttcagtatggttatacgcggtaatgaagcatgcaggaaaccacacaagatagatggcagctttcactagtgaagctgaaaacttggttaccttaatagtctatttattacattcactctctgagcttacagcacctgattaatatctcccatcttctcccttgctatacaattaaaactagtaatatgtgattgcacatgctgactccagcacagatgggtgtgtggagttgaaggccgagataagaagtgaaggggtcaggcgtggtggctcacgcctgtaatctcaccactttgggaggccgaggcgggcagatcacgaggtcaggagattgagaccaccctggctaacatggtgaaaccctgtctctactaaaaatacaaaaaattagccaggcatggtggcaggcgcctgtagtcccagctactcagaaggctgaggcaggagaatggcgtgaacctgggagacggagcttacagtgagccgagattgtgccactgcacaccagcctgggcgatagagcaagactctgtctcaaaaaaaaaaaaaaaaaaaaaaaaaaagaagtggagaaggaatgttcttcctgggtcatgatagaggagtcagatcccttgctggtaagggagtgatcttacagaattaattacactcgaggagaaaaggaccctatgtccactgcccagtctcacccattgccgtggcttctggcaggggagtggtgaagcctgcacagagagaggatatcagtggaggtggccatacggcctttaatcagcaaaaggaaagatggctggactttaactcatttgcttggatgagaatgtttgaggttgaattcgattacaatgatgtagctactcaaaagccgctcccaacttcctgctcccctgcccacctgctcctgaagagctgagcatttggccaagttctgaccaatgagatgtaaggagaactctgctgaggggtttctgggagagatgctttgctttttgacaaaatggcaagtcacattatgagaacttgctggtgctgccctctgccccttcttcctgaatgtggatgtgatgactgagtttgggctgccatcttgtgagcatgaggatgaaaacgtaacatgccatggatggtggagaatcaccagggagagcctaggttcatgattacatcacccagctgacagcccaaccctggggtcatctacttctggaccttttgttaagcaaacaatatatagccttgtggttgaagccacagttagaagggcattatgttccttgcagctgagaaacatacctacataatctaaatggctccatttattgagcagcatatgcgtgtcctttgctaagtgctttgtgttcattttgaagcttcaaaacatgttccctttaagggagctactatgacctctgttttataaaggaggacacgagttttaagtgtataaggtcacacacctattccaggaaagagcagagctaagatttgaatccaagtctttctgactagagagttattactattaatcataatattgtgactttgtagacagttcatctcaacactgaactctgggaatgagtgttacttaaagtctggttggcataatagtactcagtataaatcacgaagtttttccacatgacccactaaaataaggtgaaattcagtcttattggtgattgaaaattgcatattttttacctgcctcaacccactccaaatagccggggttgaaattagtttagctaacctaacttgccccagccaattggatggccaaaaagtgaaatgtgtatgaagggaaaaggtcccagagagagaatttgagttaaaagaccaccagtccgagcctgtgtgcagcccatctcatagcttttgagtacaaagcaggaagcctctccttccgtggcatttgaagactcagagcaaggttaagatggctttgaaacctgggtctggttctcccagaaacacttctgttgcttctcctcattaaagaaaacattccaagtgtgcaattgttctctgagatgaatttctcaaaacacatgtgaactacttgagactattctaattcctggaggtgcctagtcagtgctggccatataacagatgctcagtaaagatcggttgctttcatgaccagtgagggcaacagaaaaaacaaaagatctcttaatgaatatgattcatcctcctagcctcagtgaaaaggcaaaaaataggctgctttcttggaaacgtgccagctaatggtacttagcatgcaagggaccgcgtactgatccatacccattagcccaatgctcatcaactcttctactggagatatatatatatatatatacacatagccagcagccaacagagggacttggccacatgctgattctctctcccctcccagtccatcagaccattattcagcaggaggtagtagggtcttcccctccctcttatgccctttagggcaggagctatctagagagggaaaaaaagtcagaataaacatatgcaaggactggggtttaaacatcccatgaagattaacttatctggagtaattgccttaactaggggatttttaatgcttttcaaagttttttagaggaagaaaaatatgcagaatgagtcttaaagcagccaacagaggagatacttagagcaaaaaaaaaaaaaagatatcaaccataagaagcccatagctaggaaattttaaggcactgattctaggggatttaataagaatgtaatttgtataattaaccattcatcaatgtcaatttcattaaatgaatgccagaaatattaccttcagcagcacgacctaacaggattgaatatattatatgaaaaatgaacacttagtggtttcccccactgctctgtctgtcacagcaagatttgcaaggctgagaaataatttaaagggtagtaaatgaaaccggctaaggcaaatgtgtgcattttggtaactaacctccgtcatgatgtatgagagttcatgtcaaaatgttttcctgcagcaatgactaaagggacttgtagctctctcccaggtggcaaaatgtgagaaataatgccaggaacttcccaaaggtcccccttgtcactcgcctggatacagcttactctttccctagataggctgcctagggtctaagaccagaagccatgtgtttttgtgtccagaatttgtagaccttcccttcatacctccaggttagccttacatccaatcacttgcctacctgtccaggaaaagtgatgattgatgtgcaggagacagaaatcattctgagttttatttatgttattgcctacagtcatcaggggagcacgaagcttgaggtaggtgggctgatgaaatatatgtaaataggacttatttccaaggttgctcatgagggaggcagtttatggagggaggcagtttatggggatttatccatttcagtgcatcataggaaaagtggaggacttgggagcgggggctgtagtaacttgtccatgtgtgtgctcctgggaatgtatatacagacacacacacacacacaccagatcaagcacacactggagatcagtgcttgagatttgcaaattgttgtcactggagttggcctggtgcctcgtgtatagtaggtgatcaataaacatttgtttaattgaatttctcttagtgttaactccactcccattctcttctgtttcagggttctatgaggctgaaaatattggatcagtattcctgaggaatctgcgtttcagaatcccaggtccggaaggacaagaagtactttgcaaacaaatcaaatgtacgtttaggaagatgaaatcatgcaacagaaagatttttcagaatttttcagcaacagattttacacacaattcagaaggaagaaagaacagatgagtttgggaatcaggagaccagatgtcaagactggactacatctttatattcatttccagatttaaagttctatgttgtattttatttgatgcaaagcaataaaatattcctccctcctgtgaccaccgaaaaggtcatatttaggacctgggtgaaggaagagtgggcatcacagagctgctgtggagtgtgtgcacagattctgtgtactaggtctgtgggctctgcaagactcaaaatcaattgctgaaacacttcttaaatgtgttccctcctatgcattctgctatgcatagtcgccctctcttccttctaggttagagtgggtgacactgagcatgtaacttaacctctctgaagcacagtttcctcatctgcaaaatgaggatgataatatcctcctcccagtgttgctgggaggatgaagtgagatgaatctggtgatactgagtaggtgtgcaatcaatatttgttttttcctgccactcctttaccaggctttttttcacctcaaatgagtgatgacctctgagtgcggagcttttttgtcaattttttaaagacagtggtccccagcatttttggcaccagggacaggtttcatggatggcaatttttccatggacctgggtagggggtggtttctggatgaaactgttccatcatagatcttcaggcactagttagattctcataagagacacagcacacagcctagatccatcacatgcgcagttcacaacagggctggtgctcctaggagaatctaacgcctctgctgatctgacaggaggcagagttcgggcggcaatgttcactcacctgccgctcacctcctgctgtgtagtctggttcctaacaggctgaggaccggtaccccggggctggggatccctgttctatgaggatagaaaatctggtaaagtaattcaccctaagatgccattaaattactatgacctcctgggctcaagcaatcctcgcacctcagcctcccaagtagctaggacttcaggcatgcactactatgcctgggtaacttttttgatttttattagagatgaggtctcaccatgttgcctaggctggttttgaccccctgaactccagtgatcttaccgcctcagccttccaaagtgttgcaattacaagcgtgagccacagcaccgggttactttgttactctttaggggtattggaaatattaagaaaatacagcagggagagattgatttttaggatttaagaagaacaagaatagttttgggagttctgggagctacttccaagggcatgaaccaaatctggaaagtagagttggggttgtgaaatattagaacgtgtggatagtctgatggtttgcaagtaagtgggatcgaccgtggggtctctggacagctccccagagggccgtggtccacaaagggaaacactgtcccatccaactctgagaaatgggtctgggcatccactgctttcaccgagggtctctgcatgactttaggaaagtcactagacttctttaaccatttctttcttatctgcaaaatgggaagagtaagggcacccatcttggaggagatttggcacgtgatgctcagcacattgcctgacaatactaagtgttcaaccaatgctcatgattggccagggcattgacggcagaatcgtaaggatcacagagacctcaggaacatggctctgaaggatagaagctgaaaatcagtgtgctgatatcaccccttttgtctatgaggagtgaatgtctccaattaggctgcattcagcaggcctggcagcctcctctctcttgggatgcaaactgcttatgtggtagaaacaggaagccgtcttgaaaccctcgccaggccccagacgcgcgtgggtccacctaccgtccatctaccggggtcactgagtcactcctgcccaggtcccccttcagggactgtcgtgggctgtggcctcagaggtcccttacagggtggtgggacccagggcccagggtttggctccgggtttttgggcagctccgccttcataccgaaggcagcttagcatggcactgtctgatctgctgacagccgcgaccctgccacctgctcagtgggatggcatcttgggggagcaccttgggcagggctgcccagagccctggaactggactctccctgtgcagggctgatgggaaggaggtgtgtgcaatatggtgggaggagccgggctggaggctgcagactctgcctctgtgcccgttctgggaaagcccctgggcttgctggacccatttctgcccttctgaaagcgggagttagactagattggggctttcaacattgctgatattttgaacagcagaatccttatcacaaagccaatggaaacaaagaagtgatacattaaaaacacatcgaagcaaaacctcctggttgaactggcttccctgcccctccaaagtggttccaaggtgcctccacaaagcctcagggctctgagggtgttagggaaaccacaggtgtccacaatgcctgccatgctatgatttcatctggccgatgtgtcacttcagtattctgatgaatttaccctaccaggccagtcagaatcgactcactgatgatcaaaaaagagaggacacttagaattaaattcatttctttgggccagtctcctttgtctgcacttgctgagaaggcatttatgatgccagtgtgacttatagttatcctggtaggtactgaagcttgtaaaggccacctaatcactttgctttggtattcattagtcatttaacacctctaaagaaaggaaaggtgcggcaggttgcgtgtgcgggaggggagaggtagtgttggcttggaccacagcgggagggacctgggaagagggagaagttgatggtctggtcactaatggtcctcagcaggacaggcttctttgtccttgtctcccccctcccttttgtcctcttctctcttcctctctccctcatttctggcttccctctttttctccttcctcttctcctcctctaatatggaaggaacgttagacacacattcctgtagatgctggagtggaaaggcaggttggaggaaatacaaagatgaaggacatagtcaatctcttcaaggaggtcatggccaagtgtgcaaggggacctcgaagaagcccagtgtgacaaggattgagaggtgtgctcaagatgtgctgagagcagaggatagccccagctctgctctggggagtcaggggcagggcggcagatgcttggggtcacatgaacacacaattgagcaacaaaacatagtcacacagggcctgcctcacacccagcactgggtgggttttgtgcaggagaacttcttgcaggagacttggagacagaaattctttgggaaggagatggggtagctgccttaccagagagagcgggatttctcagacactgctaacttcccacctccacacaagctgatgagactggctcagaaaaggggtctgcccccagtgcataataatagcagtgataattaataatctatagttaatgagattaaattaattattattttaattatgacatgttttcctcctctctttcccctgccagggcaggcttggcacttcccaggattacagtcataatggtaacagataaaccttaattaaaacattccaaaataccatggctgagttaaagtgctgtgacacgtcgtttccatctcattttgagatcttgcctatgacggcaaatgtctccccaccgtcggcagcatcttggccattcagagctgttgccctcacagcattcagtgatgtttgccagagtggctccacgccccttgggggcagatggccgacccactggatcggggccactggagactttttccctcatgctgggctcttcacgtggcatcctgtgcctgctcaatgctgaatctgcttcccatgtgcacagcttactcctttgctccacccggctctgcctctgttcccttcacctgcttcttctcaggccaaggtagacctgaggaaaggattgaaaggattgtctactctggctctgtgggcactgttcctgaggtgtgagcaaaccctgcctcagatggcccccgagtccatcagcagctccttccctgtggtccgagttactggcagggtctctgcgttctgcctttgtgttgagcttctcctccacagcccacccacctgcaggggctttctcacgtgtggcgcgggtgtggaggcaggtctccatggattgtacggctttcccaaggcctgctccagactggtggcctttttatggaggttagcattcttttgttagtccactcacatattttcactcattactaaacatttatggaccattctaggaactgtgcttggtgatgagctgcagagacagaagacaccatcctatttttataagccttgtgggtctgtggaagagaatggaagatacacaaaggaagggagtcccaagctgaatgttctgatagggtcagtgctggccactgagcggggagggtggggagggactgtgcgttcctgcgcatgttaccctacactgaattttatttttttattattttattttaattttgagacagagtctcactgtgtggcacaggctggagtgcagtggcgtgatcttggctcactgcaacctcggcctctccagttcaagcagttctcctgcctcagcctcccaagtagctgggattataagtgtctgctcccacccctggctaatttctgtatttttagtagagatggggcttcgcatgttggccaggctggtctcgaactcctgacctcaagtgattcacccaccttggcctcccaaagtgccaggattacaggtgtgagccaccatgcctggatcctacactgaattttgaaacataagaaggagttatccagatgataagaggggaaggaaggtcacattgagaagagtcaaattcagaaggcctgacagagatgacatccctggaactgcagtagaggagtatggctagaaggcaggacaatgaggatgacaggccagaggtgaggttgcaagtgtggttggggccaagaccacaacacgtgttcaaggtatgtctaagaaggctcaagttcatgaatgggtgcatcaaagaaccacaccccagaaataagctaagtaacacctgcaacactgtcatcaaacgtgctgagccctgccttgcgccaggcagtgagctagtccttattttcacacctggctttcttgcctaagcaaattcagagtcaccctaacttgggtcatttgcatcacaaaattgccttcaaattagcacagagagggaaaaatcaacgcatacctcccaacataacatccccaaatttacctagcccagagttttaaaaaatttatatttttaaccttgatacccaagaaagcaggaaatctcacccagctggaagctctcctgtaaagaattcacaaaaatccacaccaaaacctctagatattcccatggagctgctagttctggaaacactatgggggaaattgcagggttttctattagtttgaaggaggtctacttcctaagacattcttctgctaccatctcttgcatgctcagttcattgattgatagagtaaatcattgatatttttccccattgcttcattcaacaaatttacattgcactctcctacatgccaggcattgttttggatgctggggatacaaagataagtgctctgaggcccctattctcagagtgctcagtccagtgagaaactagaaaagtctgcaggtaatgacaggcaaagagagatgcggtgaaatggccatgggagcacagccttgaagagacgcctgtgcaaggcacaggctccactgccagcgagggagaaagccctcctaggcccgaagcagcaaaagaaagcatctagaaaaaggaaataaagggctgtaggtgtatcaaaggtattccagtgccagttaaatttgagagagaaatcattttatttacgaaaatgtcaaggggaagaagatgcataacttctttaggaacgactcctgcctctgctagtatgtcaattccgagaggcctaaaataatttgggcttgaagatggatggaggtggagagcttggccttattgccaacactgtaaattagcagtaccaagagcagcctgtcccacttctggtctctggctacctcttcacccagctctggccacagtcaggtgatctctgatgagtgcattcaatcaccttccttttccatttggaacatgattgtgtgcatgctgtacataagcgatattgattgcaaataagttgttgactggaagacatgcctctgtggacatgtttgggtgggggatagaggggaaataaaattaaaaagagagtaagaaaacacctgtggcccccagttggaaacttctcaaatatttgaagctaacaatgttttggttgcctatttcttttttcttttttttctaggagctaaacgtcaatattgcatttattgctgaacaaactaaaatcataacaaatataataaaaggagagagttagcctcagctttctgcagagaatgattggcacttttgagccctggattggttgggcctttatcttagctgcgtcagctcataattaaacaataaaaggaggaattgttacttgcttggaatatatacagtcagttttctgtaaggtgggggcagtgtgtattttataagccctgttgctgtcccagttttctgtaagaagggaaatgtgggtattttataaactctcttcttgtctctgtcagttctaaaagactgagagatgacatgatagctgtcacaagaaatttctgcttaataacaatgaacactcagagctctttaggccctgaagaggaatgggaagatgatgagggaggaggaaataaaagcaagaaaatggtaggacaggaagattttttttttccgctctcaatcttgtctttgtttggctgaccatagagcagctatgtagaactatgtgtgtgtgtgtaagggggagagaagagagagagagagagagagagagagagagagagagagagtattgtaataacgtattgagcatgagctgcctgatctttgccaggtgataaactggcccactgtgatcttgcaggaaacatcaacagtctgagaattgttgtttcaggaactagaaagaatcctggaaatagttaagaaagacgattttccaatggccaataccttctcccagtggcttgtgagattaagatttggtattggaatttgtcccatctcgacttggaagaatgagacaccttggaagatgaggctgaccaggccatggagctgcccagaccccctgggagcccagagtccccatccttgcatctcatgatctatcatttaacagccctgtccaaagtgcttgctggagatcacagggctaggccacttctgctccttgcaagctccaaagaggaggtctcctatgcacccgaggaggatgagtcttcagagtttccagctgccttcttgtcacctggctctaccttaccttgacactcccaagtgtagacatgcctgattattctatccaaacccagccaggagatgggaagagacatcttgttagccagttgctctggtagcctgcattgcaagggcctggcttttacgcagtttcgcttcaagtcagtgcaactagctacctgtcttcctgtcacttttctttggccacctgggtctcagcagaggccctcccaagactgacaggttagcacggaaggtataatctgctagtcagatttcacatggctgcacagagaatcggtgcccttggcaggtaagtgaataaatatgggaagacatttgctattaactgcaaatggcaagcagcatcttagaaagctagttagtgaaacagggatgggagtgtgagagttgatgcttcttttagaccctatttgtctcccggcctcacactgccttcctcttgctcagactttccctcttgcagtatctcctaagtcactggaggaggcccgagaagaaagccacgacccccatttgtgtgactgagatgttttcccagcgtcagtctctcaacctccccagtttcagctgcactacttcagaatgggacctctcctggctttatctgtagtgcggactatgtgtaagatcactggcagtgagtgtttatgcgccttaattcatgtatgtgctgatagcttataccccatctctgtattctccatcagaaacccacaccccagcagggaaattctttgaagcctaaatacttaaccatttctttggctccagggaatgtttgaaagaaattagttctaagcaggggttttttttttttttcccattagtttcagagcagttttagggcaagaaaaataatcccccttccctcagtggatggataatgatgggaagtcacctcccttcccctgggattaacctagaagggctctggttgggaaaatgttacctggttctttggggaaggatgacggttttgtgccttatgttttggggttttctgggtgtccctaggtaaccatctgtgagagcatcttgggcttggagtttttgtcactgtgaacaccttctgtggactcaggtgaattctccagttggcaaaagagggaatgcaggcttcgctgactaatccctgaaccagctaaggacaaggccttagaaagtttcgtctacaataaagaagcttttatctgatgtcgaggaatctttaccagtagctgctgtcgtgaatacaagtgcacctttatggcccacagtaagcactgggggattttctgtgaaatccttgtcatttcttttacccattttcctaggaagtgagttgtgctcttgtatatgctcttcacactgtgcgaagtcagttacgtgtgtggcaaagaacttgccttggtttctaacttgttttacactttctttgcagtgtcttgatgaacagaagttcttatttggattaaagaaacacatatggtcaataaacatatgatgggatgttcaacctcattaatgatcagggaaatgcatatcaagggcacaagagataccaatctcacccactcggctgttaagagtatggaagtatgacaatatcgggtgttggagggagtgtggatctgcagaaggttttgtgcagtgctgatgggaaggagaaattgtacagccactttgtcatgatctcgtaaagttgatcattcaaatgctccatcatccatcaatcccactcttaggaagtcagacaagggcaactctctctcacgtataccagcagacatgtatgagaacggtcatttcagcactatttatataaagcaaaacttgggggcaatacaaatgttctctgacaggagactggatcaatatattgtggtgtgcctatttaatggaataataaacctcagtcaaaatgaatgaacaatagtcccatgcaacaatatgaattagttttagcagcagaattcaagtgcaaaaagtctcagaagaatgcatattgcatgataccctttgtagacggttaaaataaatccaaactgaaaattcttctttttttaaaaaaaatatatgtagcagtagtaaaactttgtttgaaaaaagggaaagcaagtcaatgatgaacataagattcgagaaagtgcttagttactttgggtagaggaagagaaaggatgcattgaagattgatgttgctactctagttttcttgtttgtttggtaatttaaagaatgtttattatagtactgaagagaaatacataaatacagcaataaaaaatcaaataaccagatttaaaaaaaatgggaaaaggacttgaatagacatttctccaaagatgatttacaaatggccaagaagcatatggaaagatgttaaacatcactaatcatcagagatttgcaaatcgaaatgatagtgaggtatcacctcacacccattacgatagccactatagagaaaagccagaatatagcaaatgtcggtaagagcgtggagaaattgggacccttgtgcactgttggtggtgttgtaaaatggtgcaactgctatggataacacaatgaaggttccttaaaaaattaaaaataggaccaccatctgatgcagcagttccacttctgagtagacatccagaaacattaaaagcagggtgtcgattcgcacacccacgttcacagccacactattcacaataaatagctaagaggtggaaataggctgggcacggtggttcaggcctgtaatcctagcactttcggaagccaaggcaggaagatcacttgaggtcaggagttcgagaccagtctggccaacatggagaaaccctgcgtctattaaaaatacaaaaattagctgggtgtggtggcacacacctgtagtctcagctcctcaggaggctgaggcaggaggatcacttgaacccatgaggcggaggttgcagtgagctaagactgcaccaatgcactccagcctgggtgacagaccaagactctgtctcaaaaaaaaaaaaaaaaaaaaaaaaaaaaggaggtggaaacaacccaagtattcatcaatgatgaatggataaacaaaatatagcatatacatacaatggaatattcttcagctttaaaaaggaaggaaaaccttccatatgctacaacatagatgaaccttgaagacattacgctaagtgaaacaagccagtcacaaaaggacaaatattgtatgacttcacatctatgagggtctaacatggtcagattcatagaaaaaacagaaagtaggatgttgattactagggacaggtgacccctccttggatctacccgctttgcaatgtgactctgcagctcttcccaccaacaggtggagactgctttcccatcccttggatctgagctggcctggtgacttgctttggcccatagcctgtggtggaagcgaggctgtgctggtgctgagccaagacctcaagaagcttgcatgctcctgctcacgcccttggaaaacagacatgtgaggccatcctagaccagccaccctctaggtgaccctccaggtgactgcagatagatgagtgagtgcagttaaattcagctgtgctgggccaggcactgtggctcacgcctgtaatcccagtactttgggaggcgaaggcaggcagactgcctgagatcaggagtttgagaccagcctgggcaacacagcgaaaccctgtctccagtaaaatacaaaaaaaattagccgggcgtggtggcgcgcacctgtaatcccagctactcaggaggctgaggcaggagaattgtttgaacctgggaggtagatgttgcagtgagctgagattgcgccattgtactccagcctgggtgacagagtgagactctgtctcaaacacaaacaaacaaacaaacaaaaaaacaacaaaaaaactggctatcaggagatgaagaatgcatctgaaagtcaacaaggagagaaagagactctgccggcatgccgtaaaagcgtgcaagtcatggcaggggaacacataagtgtgttacatctgtatgcacatgcatgtgagtgcctgtgaccacacacacacacacacacacacacccatagtcagaggaagcctcaaatcaggctgagtttccgaagggaaaatctcatttgtccaccagtgatagcgtatgtagccttctacattaatgtaaattgaggcaggattaccttctagtgataaagtcgcatctggtagcagagaaaaagtgagtggaaacggacacatttccaatcaggctctggcctgggctgcagccccactccgctgaacacctagatacacctttttaaaacccaggatccttcgggctcagcctcctagtccttgccccttccccagatcccacccctgtctgcccaccttgtcttctcgggccctcaaaacttaagccagaagtctgggcaggccagtagaggaaggagctggggcccaggcagccacaggttgaagaggcggagggaagcggcacagctcacagtcacactaggacaacttggaagttgaattggcaagttgcagcaggagatgggagcatgggctccatccctaagggagccacattcgttttttttcctttcaaagtcgtcaggcagtaaaagaaaattgcagggatggggaaataatgaaaaaggctctttgtttttcccccagtccgaactcctagctcatcaaaccttggaaatgctcactgcaaatggttgttcttgttttattgcttatttatgggaatctatttaaagtgaattgcacttttccattgtatcctagtgagcgtgcaccggagttgtgtctcccctggctgtggggctgtctggactggggattctgtctgattgtgtcagcatcacgctccgtgacatttaaaagtggggaaggaaaatactgcagaggaagcagggcgagcgtggagaatgattgctcaggcctccatcagctccaggcgggtgtggggaatgctgttctagggcaggtttgggggtgctgactaggccttcacacaaagaggaatctgctcttgtggatgaatgaatggcggtgacaaatcaaactttaatctggctctgctgtaagcattgtgaccttagggcaggtactgacttctatgagccaccttttttaaaaaaaattctctacagagaggtgaatactgggctgttgttaataatgatgatggaattcattatatatatgagagtgcttactcagtatcaggtagatgctcactaaatgtaaaactcccttataagggtggctggaatggggactggaagagacaggtaagtccccaacctatcttcattttcttaacctatgccttttgactcaaaaagaatgaaggctccctcactcctttgctttgattgggagatgagatgcgagtctcaatgcctagaatgctctatagcaggggtcagcaaactggctgaatcgggctgctgttctggtagctaaagcattatgggaacccatccctcacccccttctgtctgcgagccatctatgacagctttcctgctacagcggcagagcaggatagctatgaaagagaccgtggggcccacaaagccgaaagtatttactttttggccctttacagaaaaagtttgccaatccctgctctaattcattggtattttggggttctcttatctgtgtgatcagaaggtctgagcctcagagaaaggaagcagcaacttgtccaagatcacaaagttagtgtttgagttagaactgcaatcaggtttcccaattcctggcccagtgcttttccattgtttaactgtaccatttcacagagatcccaaagccattgggattagctttaccaaaaaaaaaaaaaaaaaaaaaaaaagagtctctaagtcacgtggcatctgagctccatgtgattggtaaagttggcattagtccctgccacatttcccaagtccccaccttctctgctcaccacaccgctgtctctccaggctcagcaaatacttctagagacaccggtgtgtccttgtcctgaaacctttgtgagtcagctgcattgactcctgctccaggatgacgagggccaattccttgatgaagggccatctgcctgtgtctggctgcctgtctgtgagctttcgtgtcttgggggctctgctgcattgcaagaaggagctgggacagagctctgagagaggggaaggaggcagggagagggagtttgattcctgaagaatcttccttttcccatgaagacaagcaagctgatggccagcgtagagccacagcctggaaaactttatttttaaatttatttttggtggggaaagagttgggttagctctaatttacggcaacctccccagttccctgacactgctgcctcctcatatgctttgctaagaaaacctggatgagtcgggcgaggtggcttatgcctgtaatcccagcactttgggaggctgaggcgggtggattacctgaggtcaggagttcaagaccagcctgaccaacatggtgaaaccccatctctactaaaaatacaaaaaaaattagcctgacatggtgacacgtgcctgtagtcccagctacttgggaggctgaggtatgagaattgcttgaacctgagtggcagaggttgcagtgagccaacatcccgccactccactccagcctgggccactgagcgagactctatctcaattaaaaaaaaaaaaaaaagcctggatggcctagtgcttccttattgcttaattaacccttctccctttctttgacccttctcctccttggttgccttgtgtggttgatggtgacatcatccatccaatttcttatcctgtaacttccaagttacccttaactcctgcctttgcccaatccccagccttctatgagataccacatgcagcctgcaaactcccacagctgtacgcaggcatgtggcctcttgcctcgacatctggccccaccgtccaacccacctttcagcctccaggcaggtcctcacctctgccatcctccacgtgatccccaaacgttgctgatcaacacaccacagctggaatccacagaggcgccacagtaccgaaagggtggctcaaaccacatcgcatggctcataaggcccttggcgagttgacatcaggctccctctctcccaaagccacaccgtcttcctgcaggcaccgccagtggacacaccgaacacccctcttgtccaaacacactgcagctccctacatacaaagggcaggagctagactgtggaatgaggttgactagcgcttacatccagacactactgtaccacttgctttccgggcagattatcttccctttctgagtctcagtttcttcatctgtattaatggagatgacctaagagctgccctgaggattaagtggtataatgcacttaaacatgacaaaaaaaatgcactaaataagtgtcatctccttcctttccagcctctgcctgcacaaacccactgttctttcgctcagggtgctctgccctgcgactcagcctccttcgggctgcggcttagcatgttcccctcagcctccttgcaaatgaaggcttagtcacttcctccgctggtcccccagacctgtgttcacctggctcacagccctccttaattacaattgtaattgtttatgtgcttgtttatgcgggagatgacaggactacaagaaggcgggacttcctctattgccctaggccctggggtgaactgcagccagcactggccttgccggctcactgcacagggtgggcacttagtccctgacttggacaagccactcaacccctaggaacctgttttcttatctagaacatgagggtaatagttcccagttgccaaagcttttcccacagaccctgactcagaggagatattcaatgaatgctggttctactctacctttccagggctaagtcctacgactgtgacacaactgatgctcagtggctctttgtttaatgaatgaatacatgaatagtgattagagatgaggccccaggacctatagctttagatccaaaagaggtcagaagatttagaccaaccctaataacctgaactcatgtaaaagtggctctttcctcccagtccaaaccacaaatcctaaatgctcattcagcctcacttgccggggactcagcttctcccggggcctccgggtgggtcccatgattgctctgatcacctccctattattggatattaatcaagtcctactcagaccacaaacaagcagccctgctcttgacagtcatctgaggatctttgttggtgatgaggagagtgggaggaagggagagtgaaggaagaagagagggaaagtgatgagaagagagagccagggaggctcagagactgagcaagtgccaagaagggaagatgacaacgctggtgaagtctgaacaaatgcaaagtcaagcacaataataatttgggcaaaatggcaaatggcacagctgaggaggaaatagcattgtgaatgtaaaaactcctaaatggagcgcagatgggagggaaaagtgtaatcttctggaaaagcctctaattgtctgcccacactaataatttcagcaaacgctccctctctccctcctgcgtataattacaccattccatctgtctatcagcaggttttttactgtgccttactgctaccacgttctcatgctcacggagagatgaggggtttttgaagatttaagaatccttctgacacatatcctgaagaaaaaacactcaggcagacaaatccctctcccaggcctgctaagactctattttaaaaagttgtataatctctccaaacgctattatgaagtccaaaggaggcagggccacatggaccctccaccttgggtgttctcatctgccggcttgtcttagtaggtcagctctggagagacgacaggtcaggggctgcagggagaaaggggctggcagagacaccggcccgtgcatcccgcaggtggcaagtcataagagcatctgctcagggctatccctttagagtgtcttaggtgtcaaggccagggttctgctgcgtgaggaggaagaggaatgcaaatgaaagagaagaagccagccgggagtggtgggggagtgtctgtggccatgtattagctcagctcagctggcctgaggagcgctgcccagcgcccaaatccagggctctgagtgactccaactgccattggcttctctccctgctctggcagtgagttccagagaagacaggtggcctcgtgcacagagcccagtaggaaaggctccaggtttcccacccaagtcactgcccttcgtgcaggaggtacagagcttcccatttgcttgctccacgggcaggagctgcgatcttaaggggctgggagctgcctgcaggttcttcatcaggaagttttcttttcatgtgaaaaatcacatcccagctcttctccctttcctttccaataagtgggtcctaagtagttactggaaggggtgccaggagagaggcaggacaggtcaaaaaggggaatgaaggccaatgcccccaagaggatcttgaaggctagaggtgtggtggtggcagtgggtgccacgaggtgtgacctattcaccagatgtggattgggccaaggaaatgtcacacagaggcgattttgacagagccagagcccctccatccagcttgtcctcacatagcctgatatcataaccgcatcttccccagaattgctgagtggatggggagaagagttgactcacatcacaattcattcgacaaatattgatagtgttcccacaaggtgcagtaaaggctgaatacaacacgtttccaattctctatggcagcaacatctaatagaaatataatgcgagctgcagctgcaattttaaattttctagtagccacactcagcgagtaaaaagaaatgtgaaatttcttcgaatagtatgttttattttagtaatatttcaaatattattaattcaatagattataattataaaattatttgttagctattttacctttttttaggtaatgtcttcaaagtctggtatatatttatatttccagcatacttcagtttgagctggccatgcttcaaatgctcactgccacatgtggctagtgatgagtgtatcagatggtatagagccagagcttattaaggagaaaaaattgtatgtataattataattctagtatgtgcattattattattatagtttaggcccgcgaagtaattcgctaaacactttcacatacattatctctgatcttagcaattttgtgagatgattagttattgatattttttatcagataaataaaaataaggccggacatggaggctcatgtgtgtaatcccaacactttgggaggctgaggtgggaggatcagttgagttctggggttcgagaccagcccgagcaacaaagtgagaccccatctttacaaaaaataaaaaaattcattgagcgtggtggctcatgcctgtggtcccagctacatgggaggttgaggcaggaggatggcttgattccaggaggttgaggctgcagtgaattatgcttgtgccactgcagctcagcctaggagacagagtaagactttgtcacaaaaaaaaaaaaaagagagagagagatattcagagaaccgaagtgacttgtgacttcagagcagtaacttgacatccttatttcctactttctgaaacaagtatatgtacacacacatttttctgtgtgactcagtatggcacattggaagaggcagcgtaccaccttattttcctcttcattacagctgctttcttcttaagaacactctgaagaacaggaccggaaaacgatgtgaggtccccacactgtgttccacatacaattattagattggtgcaaaagcaattgaggtttttgcaattacttttaatggcaaaactgcaattacttttgcactaacctaatatctccctttactaatctctgctgctgtccccagatcagctgaggccccacctttggccgatcctctgcctcctagcctttctggcggaccccattcttagaaggctggggagtgggcctcaggaagcagccggggctctgaggagcccaggcattgtcttttctgtgagactcatcccgctattcagcaggtgaaacctctccgcctgtcattctctccccaccccataatgtgcaacaggcctgactttgtgatgggcaaatatctctctgagatcttctttacaggcattcaccccccacaccctcctcagcagtcttgggctaatgagctcagttcctttaaacccagctcctgcctcagcccttctcagaaacttatatccggccatgtagacaaagctagaattaaggcttccagatttatttcatttaacaagaacccacaaagccagcccagtagcccattcatcccaaaatagcttctgaaagcctgaacatacgtcagtgtctctttgcagaaaccacactgcattgtcatgaaagggccatttgaacaaggtagctacaatgaaattatctcaatgcatttcaatcactttgcaacatcaaggttcatttctcagtaacagtctctttgacaataaatgaattgcgtgattggtgtgtgtttgcgtgtgtgcatgtgtgtgacaccccttcatgatgaattcctgggtatgccaatgttacaagtgattggtctttgcatccatctcttagcataaatccccagcatcaacgtgacatgttgagcagcaccgagccccctggattctctcagtcttggtgagagagggagtggggactgtgttcacgctgttacaaaaggacatctaagagggacagcagggaggaagctgggcagaaatgctccgaatcaatagctctttcttcttggtggcttggagcttgcaatctctcagcctgtgtcgagtcatcatgaaactgaagaatccttggaaagtcactgggttgggcacttttaaaagtagagtcttttctgttctgcttagaaactctcatggcatgctacagagaaaagaggagcagaggcccacagagctcccttcaccagagaagggagcgaggaggtcagagggtggaggaggtgggctgggatctcccagggcagcacctgggcggagttctggagccactcccagcctggggagaagccctgcccctactgtttgctaaaagtttggacaaatccttctctgccctgtacctcaggttttccatctgtaaagtgggaagacaaccatcccacagaggtgccatgaaagatttttagggagtacctaaaaggttctttaggtgctagtcaagtcccggggtctcgatgtgtcattaacttgctgtgtggtcttgagcaagttacttaagatttgttaggtctccttcctttctttataacagggtaataacctacctccctatttaacttatgagtaaagcagaatggctgtgagagtgggcctggagccaaagatacctgactgtaaatctgagctctgctccatcatcttgggtagtctgctaaggtttctgtctcctgtccaaaccttcatctgtaaacgggagcaaatcatctctaatttgtagacctgttgtgagaatttaatgataatgcatgtaaaatgcctagcaggggcctgtcacatagaatgtaccctattgatggtagctgcaggtatattacaaggttgtactgaaaaacaaatgaaagaaagcaatctttccttgaaaaatgcacagagctccacaaatctatgacatcatgatgattatgatgattgttgcaaatgtcacatcttcatgtggagtcgaggtgggcattagccacactgttcccattactcaaaccccagatgctccaatgacagagcctctgctgagaggctgacgtcagggagaggtggaggagggcagatctcccaacccttggcttccaccagcttcctctcaccgtggagccctaaggcctcagcagacacgctgacttcttttcagaacaaagcacagcaaaacaaaacacacagcggctgctgaatggaaaacacttgcactctagaaaggctggcaaattccctgcctcgtcccaccctgcacggacagggccctctctgcccagccacctcctggtgcaccccgctgtatctctgaccacactttaaatgtgcaccctaggaggtggatgctctgcagagagtgtgtgtgtctgatctgaggcctgtggtcccctgaagaaagaccaacaggactgggtgccatcctgtgcccaagttgttcccaggaggagaaagcctgtaggaggggagcaagctcccattctgcctccattccttgcaaggtcagccagctacatgctttcttctggctgggcccctgagggcaattgttgctttttcctcttgaggagtctttttattttcagagtggcagggaggatggtttatggtgagtatggacctaaatgagaagggtgagtagtagatggcgtattctctgggctgtgaatcctggtcaggtgggggtggctgggctggggcaggagacactgtaaagagccagtaggcctggattccttccagccgtgctgcttcctgccatttactccatctgacctacttcacaggctgggctgccatgagcggctgctgcaggctgtgcactgcacaaggccaaggcttaccatttgcatggtctgcggaggaatggtgctcctgagagctgttctctgcagcagctttgctcatggggcactggtgagcagcaaacagaatcatcgtcttcatcaccatcagcaggagcagtgactttaccaatgattgatcagctgttatgtgccaggctctgtgctaagtgctttacattttatcctcccctccaccctatatcaggtaagtactgttatatctcatccccattttataagtgagaacactgaggccaaaggaattaagtgatcggtcagaggtcagtcagatcgggagtgatggggctgtaatccaaatgctgggctggctgactcctaagttcacactttgtcttcattcatgatacaaaagagatgtctgttttcctgaggcccacgggcaggggaggcaggactcctaagcctgggccctctgactgcctgggccagtgtttccgtgccagaaaccctgtctcagagggcaggaaagagaatggggagcccttgcagaatgtggttggatccttctctcttggctctgtcatccttgccttgggatgtcctcccaacacaggccattaatctcactcaagggccagtgctggcagcggttatgctggggacatctacataccttgcattcctcccctttcacagaaaggaagaagaaatggaatttctgtcagattgcttgaactcactctctggaatcactgcgcccatcttttcagagatgttgctaccagaatcattccccccttctcttatttatatacactcacacaattagatataactatattcacacatagacacatattacaacttgaacttagcacctgctcttgatatgtatgcccagaaggctgtcacacaatcttgcacacacccacacatttgcacatgcccatccagctgagcaacatgtatttacacagcacacacatttgcatcatatctgttcatgtgcatgcatgtgcacagctgttccccttaactgcagaatgaagtgagcacagcagcacagaacaacagctggtaggaagcatgtttgtcggggtgtggggagtgcaggagagaggaggtggggtggggccgggaagaagtgagtactagcagaacagaggcttgcaaaagactgcagcaaccagccccagctggctgtaggggctcacagtcttgtcacttagaaggtctgtctgagagaccttggtggagtgcagcttcagcatttggggccacagctctgcaggctttttctctaaaaggctgccctatttgtgttgtgtgtccctgtacacgtgcgtatttggctcaggctgactttccatacacagacagggctctatttttggatgtcttggttctcatgagttgtggctaagtgaggaagtctgagtctctcctgatgcccacgcttccaggatggctcctggctgtctgcgttagcaggtcacttttgggctagctacctataccagtccaaaggcttgatacaggaaccacatcagaattggtgacaaaacaagctggggggctcctaaaggaagatactgggattctcaataggccatcacccaagggaagcagtattctcctcctgcgaccatgccatgggatgaaagcctctgccctgtatgtctggccaccttgctaaaaactgtcagccagctctaggcagctccagagctgtatgacaggagtgggaggactcttgggtcagaactgtatttgtgggtggtaaatttatatcttacccactgaatatagctttttatggctcaagacataggtttggttttcttaaaaaaaggttttcttaattcaaaaaatgtacacatttatagtaagaatacaaacagtacaaagatgtcagtccttttctactcgtgccaaaattataaacagtttatttgcatcattctgcaaattttatatatgtctttgtgatatggtttggaggtttgtcctcttcaaatctcatgttgaaatgtgatccccagtattgaaggtggggcctggtgggaggtgattgggtcatgaggtcggattcctcaggaatggtttggcactaacctcttggtgataagtgagttgttgatcagtttgttcacatgagatctggttgtttaaaagtctgagacctctccttccctctctcttgcaccttctctccccatgtgatgtacctgctcctgcttcaccttctgccatgattggaagcttcctgaggcctcaccagaagctgagaagatactggaaccgtgcttcctgtacagcctgcagaactgtgagccaattaaacctcttttctttataaattatcccacctcagatatttctttatagtaatgtaagaatggtctaacactacgtatgtgcaagtgtatatgtatatgtaatgtatacctatgtgtatgtgcataaatggaaaatgcactgtggtaaattacagatggctacaaacacttagccactcctcccagaaagaggtggaggctacctctcctattttagaactgccatggcactgtgacttgccttgaccactaaaatgttgagaaagtgatgctgcgtaacttctgggaaaaactttaagagatttgctgtttctgcttgcagtcacttagaatgctccttttcagaatctggcccctgtgctgtgagaagcctaccccacatggaaatatacacagaggaaaatggaggcagtggccaaaaacataagtcaagctcctagtcaacagccagtgctgattatcagccatgtgagtgaaccactagggccttctagcccagtcaagccttcagatgactgcagcccccgatgtcactatacggagcaggtgaaccactcaactgaacattgccaagccacagaaccatgaaagttagtacatggtgggttttatttccagtggctatattttgggatagtttgtcacatagaaatagagaactgaaacatgaagatatatttgattcatttaaataaatatttagtaattttctgattggctataccattttctttttaattaataccacacttaataggtaaatgtacagctatgtgtataatggaaagtgtactggggacatgcaaatatcgtttaagtacaattaggtttttatctagttatttgcaaaaatgcagcaatagacatcctgtgtgtggatatttgttcacatgtataaatatatgtctctaggttaaatttctaggaacaaaatgcttaataaatgacatgtaaatttaaaattttaatagacattgacaaattctcttccaaaggtaccatgccaccagtggtatgaatgtgcctgattccccacttccttgtacacaggacatggagatatgctcaaacctttcatcttcggttgtgtaataaatttttaaaaatcatttattttgcttttcttcaataacaattgaagttgttcatcttttgatatgtttatcagctatatttttctttttctgtaaacatcttttgcccatttttctactggttcataagagcttttttctgtattgaattttaataattctttttcctttttgaactgtaagaactcttagatgacaaatgaaagaaattagctctttatcagtcatttgtgctatacatttttttccacagattgttttttgactttttttttttttttaagagatggggtctcactgtacatacatcacacattttaagagatggaatgcaatggtgtgatcatagttcactgtaatctcaacctcctaggctcaagcaatcttcttggctcagcctctcaagcagctgggactacaggtgcatgccaccacattggctaatttttaaattttttgttgagatggggaccttgcccaggctggtcttgaactgctggcctcaggtgatcctcccgcctcagcctctcaaagtgtttggattgcagacataagacaccttgtccatggcttttttttttttttttttggcttttgactgtacatacatcacacatatatacatctgacacattttatttttgtctgattttatggtttcgtctttcatctaggcggaatttgtcttgctacaaggggtgaggaagggatcctgtctaattttttctccacaaatgtctagctagttccccatagctttcattgatcattgatttatcccccactgcttcaaaacactgcttggtcatatactaactgcccaggtatatatttgggcctatgtctatactctatgtcagtccattgttctctctgttcatatgccaatactgaaggctgcttcttagcctttccagtctgcatttcctctgagtctgctgttcgctgttggagccaggggctaaagtactcagcctgtactgtcagtcccggatagaatgcttccatttaaattctcatctaactcattctattccccctgtggattcttctcagcacttctttagaaagtctcctttccctgggtcatttctcccagactagaaaaattccttcccataatagctcttaagtgcttcctcttggtccttgtgatgagcttttttttttttggctttcctaggaatccttccactctgggccaaaacttcacccttcttgcctcccttgagaaagcagttatctttttgtgggccatccccatgcattcattctcctgcctgttcgctcgcttgcagtattacatggggtagcggggtcaagtcggtggagggtgaaacaggcgattggcaatactcccctccgcatccctgaagcaggtgatgatctccataggtcccagggtatccgtgccccgtttgatcagaaagaaacacacccaatcttcctcttccactgacttttcccgtgtgaaaggactccctggtcaggcggtattcatgccgcctggaaactcatctgcctgtgccgctgctttttcctggcagtttacaatgttatattgctaccaaagcgggcaaaatgaggatgtgaagtcgagcatctgagaaggctcagaaagtctgaataagcaatactggaataacaatgtactcctcaccaaggcatttagccagaaaagtgctcctgcttaggaattctatttgtttttctcttggaaaatggggaagtacatctgtaattcagctgtgaataccctattttctttgcaggggaagactggaaatagagtcctttatctcagatatcaaaccctggcccaggatacacaagaccaggagtcatcaccatcagtaacagtaacaacagcttcattaacaagttgctgttccgacgtgggctccggggtggggaaggaaggagggcgttcggctcaacgtccaggagaggcaccggcgaactcgagagccaagagcggcactcccacctgggcactccttgctgatggaccgggacctcctctcccatttctccggggcctccagggccctcccgcacattcagcatgatctctgaggagttcactagctttcctccctccgctctccagctcccgttcctaccaaatgcaccaatcatcactaagccaggtcaaaggccatgggatcagctgtgatctctcccttcctttttcattctcctctcctcatatccaaactgtcattaaactcagtgtttcttccttcaggctgtttcttgaattggtttcttctctatcccactattactgtcctgatccgtgctaatccaacagtttctgcccccaccccaggacagcttgtgttatcacggccaggtggatctttctagaacaccaagctcagcgtatcccttctgatcaacagagaaggagaggagagcctacactgtgctgggtcactgtgttacgctatgtgcttgtttcatttaataccgtcaacgaccatataaagtgtgtttgattatccttaagcaaaaaggtcaagaaattattagatcaatttcaagtcctcttcctggcattcagaactcgccccaaaatatggctgccttgactagttggctttatcatctcctctatcccaagatgacctttggggttccaatcagtcctatctcttccccgggagtaggggtggaggggcagcacccccgggcagaagatgcagccaaacaggaaagacagagttcacacctaactggctaaagtacaggcaaacacctgctaatgagtggtggtggcagtggtagggagtaggttgaactgtgtccccaacattcatatgccccaatacttcagaatgtgtctatatttggagatagggtctttaaaaaggtgattaagttaaaatgaggtcattagggtgcgtcctaatcctgcatgactggtgtccttataaaaagagaaaatttggacacagaggtacagagggaagaccatgtgaagatgagggaaggcagacatctataagccaaggggaggcctcgggagaaaccaaccctgtagacacctccatctcagacctcctgcctgcagaattgtgagaaaataagtttctgttgtttaagccacaagatcgtggtattttgttacagcagcccagggaaactaatacaggaggccgggcaggcattgtccaagggagctggagaggctgagcactggggcacgagggtaggtaatgatgtgagctaccttactgagcatcttctatacagcaagcaccaggctacgctgtgaacattctgcattcattatcactaatccttacacatgccctgccaggaagttactgtcacagccattttagagatataagatccaaagttcagggtggaaagaaatgtccctaggagacacacataatgagtatcaagtctggcattggaatcccaatctcctcctcactaagcccatgcttattctactattctgtcctgtgtccatcagtagatgggctggcatcagtggaccccagatctgtccacaggcagcagggccctgaccaacaggtggcttctcggagcagtgccttgtcttaggggggcatgttcactgaactcatgaggtcagaacacaggacttcacaaagctgaggagagaagggagatagctagctcagtgtggcaccccattcttcccattgagccctctcctcttcctgttgaagttcagcgtggttctggaagtacctgagtgggaagtagctttagcttcccacgactgttcaatagcattcaagtaacccttcatggcatgccgagattcctaatgagatgagaatacattctttaaagctccagttaacgtgtatgcagatgggagcttggaggactattttgctaaatgatgcaccctgtgaataaccatcacccccatatctactagggcaggcaccccttctctgtcctcagctggggacccctctcatcccacttggactcagagtccctggtgccccgaaggaaagcaaatcagcctcacttataattaagtgtctcaaataaagttttgttttaggctaaataagaaaagtgataccaagtcaaacagatcacaactgattattaagaacagatctactacagtttgacaactgccacaaacacaaatcttatttgggagttgctaaaactcagtaaatatcattttaataattaattaaactttaattaatgtcttgacagtagtctcaacctgataggcctcttcacaatgtgcaggctgtgatgaggatggtggctgctgggacggccaagggcagctaggtttcaggtgtcccctccttggggcaaggagaactaagttcactttcccccaagaaaaatctgtggtctacacaaatcaacctaaccactgaatcatcaaacactctgagaattcaggttaccaacagtgactgcaggagaatctaaagtgcttttgcatccttagagaaaaatctctgctccatctttttatggatccagtgggtggcagaaggaatggagttactgcaacatgacaatctccatcctgcctgatgcgcgagcacataaccgcctaagtttaaagagaattctggatataatttattatataagcctgtaatcccagcactttgggaggccaaggcaagtggatcacctgaggccaggagtttgagaccagcctggccaatatggtgaaccccccacctctactaaaaatacagaaattagctggggggtggtggctcatgcctataatcccagctacttgggaggctgaggcatgagaatcacttgaacccaggaggcagaggttgcatggaactgagatcgcgccactgcactccagcctgggcgacagagcaagactccgtctcaaaaaaacccaaaaaacaacaacaaaaaataatttattacatgagtagctcccaaatagcataattagtatcatgttagctgtaaaattaaacaaaaaagacttctgtccagttccctagaaattctaatttagtaggaatgagctaaaaggtctgatttagtaaggtgagaatttagtaggctcaggaatctatatttttaaccagttcccactgtgcgaggatgctgtgccagcaaagggcttcttcaagccacagagcctcccctcccagctgccctctctccactgagcctgaagcatgggcggcggtgggagccgcttcattataaaaagcagaacatccctaaaaacaggatattctagggacaccaaagagccgacactccattggaaacgcctcctctggggtccaggaaggccactccacagtggcgctgaactactgtttctcagcaaggtggtccgggccttctgccgtcagccagccacgccccactcccagtggtcctcttccgacatgaaagatgccaggaacaggaaaagcaaaacagcgcgcagcgactttcctactctagtagcattttctttctgtgtctctggtgagtcagagtttgtttgaatgtgaattatctgcaatcacgaaagtgacagtacagctggctgccgggcccgaaggaaatgtgtgctccagataagggcgagtgtgtgtgtgtgtgtgtgtgcgcgcgtgcatgcattttggggggctggggctgtcctcacttatcaaagcaattcccaaggcggcctctctgagtgaggcagggtctggcagggccgagcccctcagagccctctgccccgttggtgctgtgccggcgaaaggccacgcctcttcaatctggggcacccctgccgcctgctccacctcgcccgtccttgggttctggtcaatgttgggttgcccccttttcctagggatgtgggaggagaagagaaaatggaggtctatattgccacctcattctccgggtgcgggaaactttccctcagaggcaggacgcaggcaggtgaggatcacccgccacggcttttgtccactcatggtgtgagtctcaagaggagggaaagtgggtagggtctttaagtttggtactgtggccctctgaggttggcgacaacctgaaagctaccagcagagaaaagtaggtggagacagtgcttttggccacgacccgtttttgtcatcctcgttcctcctacaaaatgaaaaatggtccagaggccattcagatccccgcaccagtcactgaaaagaaaccagtttaggtgtccaaggctttttggtcatttactagacatttattgagtgccttcgaagctctggcgtggtgctaggtattaggtgctaggtgttaggtgttgagtgttgggtgctaggtgctaggcactgggtgctgggtgctaggttcctcatctcagggagctcaatctctcataggagtggcagataggtaaatagctataacaaagtgtgagaaacctgaaactgaggaagcacagggggctgtggaagcccacattgctgattcctaaccaagagcggaggagttggggctgtgaggatgaatggtctgagaaggccatttagggtacggactgatgctgggatgtgcagaaagggagaaaggaggctccatgcagaggtcacagcccatgcaaaggcctggaagccagagagagcctcatgcatttaggaagtagcggacaataggcagggtagcatcactgaagcaaagcaggtgggccaaggtggggaggggatgagggcagggctaggggcagggccccagatgtgaagcgccttttatgccattcttagaagtttggacgtcctcatggaggtaaaggggagccccaggatgcctcaaggtatgtaggaagatggggcaggaggccattgcagagacccaggtaagaaacgatgaaggcctgggacagggctgcgctgcctgaggtgatgaggagggaaagactccaggcttattaggaagtagacgcaacaggctctggtaactgacaggagtgtacattctgcagagggcgacagacattcaacaacaaatgacacaatcaactatgcaattaccatggtgataagtgtgctgagggagagtggagggtgtggggttccgtagggggatctgacctggccagaagtgggcgagacctccttgaagaggtgatgttcaacctgaggctgacgggcgaggaggaaatatccaggtgaggtgttgagtggggagcacggaacagcatctgaaaatgggttgcagggggagcacagtgcttggaggacctaaaagaccagtctggctagatagggcaggtcagctaaggactgcagaccaaatttgattccctgactgtttttgtaaaggaggttttgttggaacacagccacgccctctgcattcgtattgggtagagcagcttttgcatcacatagggccagggctggggaggggaaagggaggtgcccagggtgcaatactgaagaagaccctcactcccaggctggtgcacaagccacagcccggacagtcagtgcctccctcaattttgtacctagagcaccttacctgccttacacagttctggcctctctgccacaatacaatgacataatcaatggaggagttgcaacagagaccttctggttgcaaagcttaacgtatttactctctggctctttgtagaagcatgtagacccctggcttagagcagcataaagaggggagcgtgtggcccaggccgagccctgatactgttgcagctctggccacagccccttagcattcaactagacatgcagaagaaacctgtgctaatgcctgcgattctctgtgggacagcgggtgtgatggagtcacggagatgtgatggggggcatttgggaacatgctcattctgtcttgggcaaatggcatgtgctggagagtttccgccctgggaggcagccctctacacatgataggtatggggctggtggggataaatgccccaatttcctcacttctccttggggagaatgccacgtcccagagttgcacggtgggctgactgccagttgcacacagtggtatctacatgatgatgaatcctttactggcgtctttccttcctttcctactcacttcctccctcccctaccagggtttcctgggatcgccccctgaaacaaactacttgcatttgaatccttgtctctgggtctgctttgagggaagatgtgggatatccctgagctgcctgaggtgggggcttatgtaccaaatcccaccatagagaaggaggcccctgctgggtgatcagcggagttttacttacatgaactttcctcctgcttccccatcccaggcacccgaggcgtcaagccacagggtgaagactcaggcttcatctttttctcagattctaaactcacaccccacctttctgtgtggctgcatggctggggactccatcctcctaatgatcaggttcttgtgcaagcctgtgacactttcaccttgtgacaatgcccagacaactaatagagtctctgttttgccaccggataattgtttatttcctctttcaagggaactgtgtagaggaagaaatcagttgagaaaaacagtcttgagctactcaggctatccccatctattttgtgggggaagaaaactattcagcattttcaggttccttcctttcagatcttcccaaagatctcagtgcacaaccagggctggtctgggacagttgctgtgcttctgctctgccctggccagcctctgagggggtctccaaattaaaatgcaagttttaagtcagtgctctcctttcctggggattgttgacagctcaagaccacatgggctcatcactgtgatcttaaggaaagaaatgatcagggcaaatggctccaaatgaagatgaaaaagcttttacagtgacagggaagaaatattgcaggctgcttgagaaaatgcagtttgggaatataggagaacgtggaccattttgcaaatcaaaaacaagaggaaaagggactacagcacgtgaaacatactaaagagaagagcaaaaatgagattagaaataaaagaagggcaggcaaaaggaggaaagagaatgcgggggaggcaaacatcagagagactgcacaagagcaagagggaagacagagaatgttcaaacaccatccacgatgaacacggttgcagagaggccagtgttccaccgtcaagagcgcagaaaagcccttggtgctcctctgaagaatgcaagagcaatctgcagtgttattgactagtggaaaaatggctcctctctgacttagcacaggatgcaatttatcttcagagagtaccctccatacacccaatgttagttcttaggcatgaggttgggcaggagaagggcggaggaagaggtgtgggaaaagaggcagacagggaggtgagggggaatgtgggaggtgatgagaaagaaggaaaaagaagaaaggagatggagagagtgatagggagacaggaggggagaaggaggaacagataggagggagctatgaaagaaagagtaaggttagaataaagatttgggaaggagagggaggcggaggaagaaagaggaagggagggagctggagagcaagattttgaaactcttaaactaagaagagcaaagcagctaatatgtatggagcacctgctaggtgtcacgcattgagctaggtgtcatttcattattatttgatctcatgctaacaccaccttggtgttatctccctcatttttataggtgagggatgggtgctctgagtttcaataactttgcccagaaccacagcgttgaggctgtagggaggttaggattggagctcaggggacaaagcctgtttcagatgacacaggtcagccacatcccagggaaacaggaagggactgacttttatggatctctagctcccatctaagtgatactgatggagcacagaagattcctggggacactcactgtggcctgtgaaaacctgggcctccaaacaccagggggagctatcaccctggaagaaacagccaaatgcatctgaaaactggccatatcagtcaaagaaggtatttactagcctgagtgtgagtgtgagtgtgtgtgtgttggggggggggggaagtgtgggggagagtaacagctgattctttctagctgattttcattttatactggacctcatctagatgggatccacccattatttgcagtgggtgcctgttttgtttcctttcccctgcttgttggctgctgactcatttgccctggttacctgggaaggcgggaatgagcctagggcaggcatagagctcagcgcatccaagatgatttggtgcgtttttgacagatgaatgaccaatgggaggatgaacacgtgcttgaactggaagggttctggaagaagcatttgattcttcctcacccaggtcagatcaccatctcaaacatcactttaaaacaaagaacgccacaaagggagatttctttgccttccttagaccttcacgctggtccttaccttcaaggctgtcctcgctggactttagctgttgaacccactggcatcctttcggaagcctgaggttgggagttaggagagaagctaattattctatggtgtcttggatatgctaacaataacagctcccgtccaaggctgtcatgttatttaatgaaatagtggaagcgtgattatagtttataaactcaagtactttgacagtggtcactgctctgaaggtgccactgttgtacaagtggctatgtgaaccagcagtgatagaatgtcccagctgttggctatgccttaccctattaccctagatctattgactcagatgctttgaaagttctcgcggggaactgttccttgtagactctgctcaggcaggttggcgtggccaggcttgggaatggctgtcaccacacaccttgtcctccatcctcactcatctctgtcctcctgctggccagtcacccccacctagtggttctcgtctgttttaatgagttcagagtcattgccaaactaagtagtcagcttccatcagtgctattcttcatgttgagccacaacataaaacactttattgcaattacaaatagcaaaattattttctgccgagcctcagcatctgaacttaatggcatgctgtaatgccaccctgcgctgatgtgtggcatatctaatatccatctttcttagaaataacagtgttcagaaattagaagggactttagcagtgaaataattaatgtggataaccatcataaacggcacaaatggaacaaatacagatggtagtgagccgtgattgctaatatgctaacctgttttgacagaactctacattttttcattgggaggttcatggatagaagttaaaatatcccttgcctcatgacaagagctttgtctttctgggtaagagattcaatgatctcctacctgggcaaggtagcatcaccggaatttgcgctgagaggagggcttgcatcccagctctgggctctctcacacccttccatctcctgcagccacatttctgccctctgcctcaggctcaggcaggcgggcccacccagaactgcagccagacacccacctcttctgtgctatggctctgagggaggggcaggggctccctggctgggctcactcagtgggaagcagctctttgaagatcctagctgcatgcaggtgcaagttgcggaacccaactccaagaggctgcacggaaatgaaaaattgccatagaaagatgactcaccaaatcacagacactaagctattgagacaaatataaggacgagggtgtttgggggcactggaaacacttggctgtgcctgcttttggccctgctggcctttaagcagcattagcagcagaagggccatccaagtttctctggatgagtcagaggtcctcagagaaatgctggagggcaaactggggaaggaaggtagaaaggatctagctttaacttattaaggataagtgctgtgctttacacatattttatttactctcaataataatcatttgccgtgggcatggtaagttaatatttaagatggggaacctaagaattagacaataagtgatttgccaagttcaccaggggcagggaagctatgggcagagcggctagggattagggtcacaccaccccggccaggagccccattgatacgatacagggggcctcactgagtctttctgccccaggaagccaagccctcctctctgatgctgaatcccagcccccttctcccactcaagggcgttgatagaaacctttgtctcctttccctccagagtcatcattccccctttatttaatcatcttcttacaaatatgctgtaatatctctaacttttttaaaatggagaagcctttctcatgtttgttttcctcctgctatacctcctttgctgtgttctcttttacagaactcagaagagctgtctctcactgtctccttcatctagacaaacgcatttcccttcattccgacactcggtaacccacttattctggttttgtctcaaatctaaaaatacgccactgaaacggcttcttcctaaattaccaatgactccatgttgacaaatccaatggtcaactccttgttgacacaaatggccagctcttctgtttgaacgccttcttctcttagcctctgggagagcagtctcttacgggtctactcttactcacagctactccttctccatctcctttgctagttcctccccatctctattattcccaaatgttggaggacctcagggcttctccgagctgtctacattcactgcctaggtgatcttacttagtcccatggctttcattccacccgcatgctgaagtctacttccttgctgggcatttccatttgaacatctcttaggtttctaaaatgtaactcatccacagccaactcctgccttcaccacacagcccctcccgctagatcctgtcaaaatcatccctatctcagccaatggcaacttatccttccttttgcgacttctaaggccacaaccttagaagtcatccctgatgcctttctctaatactttatctttcaatcttttatccagaaaatgaccacttcttacaacctctgctgcccccaccctggtccaagacagcatcaccttgcatctgttgaggctcctgagagacgccctgcttcttccctgcttcagcctcttcttaacccagtggccacagccatccttacgcaatgtagcaatgtcagttggatctgatcgctcctctgtccaaacttctgatggcttagggtcagggtgtggtccctctgcctctgatttcagctcctactcatccccctttgactcatctgcttcagctgaactaacctcctttctcaagccaacctgcaggctccctcttcagcttcttggtccttactatttttcctgcctcttgactttgtcttatgtttcttcattgaacttattgcctgacacagcatatatttatttgtaaattgtctgagctcccacttgaatgtaaactctttgagggcaggggcttaatgtgtttgtccactactgtatctccagtgctcaaaatagtaggtgccaaataaatatttgctgaggggatgaatttagacctggtgagactctgcagtccttgcctgtcccaccagccctcacggcagtgtttgcatgcaggagatgccatgtttgcatggtggggctgtatctgcctggctccctagtgatatgaagttctaaattccaatgaaatctcaaatccctcaaagaaagattttaccactctggttaaaaatcagacctagag

SEQ ID NO: 614 - DNA, 504838 bp, Homo sapiens
aataaaacccattgtcatctaagtctagtcatggcatgtcttttttataggtggttccacataagtgacttttccaggtaaccgaagcttataattcagatgcccaaatgattttcattttaattacattgattagaaattatttaaaataataactcccttttttttgctttcttaagcatagtatctcaaacacaagattaccttttattgataatttattaatgtacaacttaattaaataagcttttatttagtactgtaccacatactaaacgctgggaacccaaacctaaagatttgagttccacctgctatgcagtgcttttattattgtgggagtgactctgggagatattgagctatatagaggttactttcctgcccaagtattcagtatcaaggaaaccataaatatgaatgacaacatatcttaaccatcaactatacctcttaaattatttaaaacactgggctgattctttaagcctgaggggaaaaaaataagttgaaatatactgtttgccataaacaagaaaattctgtagcccaaaacaacagtatggaagagctcagtggatcaataaatatttgtgtgtaaggcattatgcttggtactgaaagaaattcaaagatgattcctaccctcaaggagtagacagtctggtcagggacatagacacttacataattaactactataatacaatgtaggaagggtttaataccagaagggaggatgacaataacagccagcattactacactttctatgtgcttgatactgttcgaattgccttacctgagtgaatttatttaataaataagcttgcgaggtggatactaatactagctcctttttacagatgacaaaatggaaagagagagtggttaggtcacacaactcgtacatgacagtgagccactgagcaaattacttttgactgctgcaggatgcaagagggcctcctgggaaagttggcatttgtgctggatctagaagaataggtagctcttgaatttgtagaaggttgagggagagcattccaagtagaggaaaaaaacacaaagtctgggagatggggacttgtgaagcacatggcaaatgtattacccaaaatcctttcactgattttaattcagagagtggagtgtattttaaagaaaacccttcacaaaagaaagcaggaaagatcaaaaattgacatcctaacatcacaattaaaagaactagagaagcaagaactagaaaagaactagaaaagcaagagcaaacacattcaaaagctagcagaaagcaagaaataactaagatcagagcaaaactgaaggaaatagagacataaaaaatccttcaaaaaatcaatgaatccaggagctggttttttgaaaagatcaacaaaattgatagacgtctagcaagacgaataaagaagaaaagagagaagaatcaaatagaagcaataaaaaatgataaaggggatatcaccaccgatcccacagaaatacaaactaccatcagagaatactataaacacctctatgcaaataaactagaaaatctggaagaaatggataaattcctcgacccatacactctcccaagaataagccaggaagaagttgaatctctgaatagaccaataacaggctctgaaattgaggcaataattaatagcttaccaaccaaaaaaagtccagcaccagacggattcacagccgaattctaccagaggtacaaggagaagctggtaccatttcttctgaaaatattccaatcaatagaaaaagagggaatcctccctaactcattttatgaggccagcatcatcctgataccaaagcctggcagagacacaacaaaaaaacagaattttagaacaatatccctgatgaacatcgacgcaaaaatcctgaataaaatactggcaaaccgaacccagcagaacatcaaaaagcttatccaccatgatcaagtgggcttcatccctgggatgcaaggctggttcaatatacacaaatcaataaatgtaacccagcatataaacaaaaccaacgacaacaaccacatgattgtctcaatacatacagaaaaggcctttgacaaaatttaacagcccttcatgctaaaaactctcaataaattaggtattaatgggacatatctcaaaataataagagatatttatgacaaacccacagccaatatcataccaaatgggcaaaaactggaagcattccctttgaaaactggcacaagacagggatgccctctctcaccactcctattcaagatagtgttggaagttctggccagggcaatcaggcaggagaaagaaataaagggtattcaattaggaaaagaggaactcaaattgtccctgtttgcagatgacatgattgtatatctagaaaaccccatcgtctcagcccaaaatctcctcaagctgataagcaacttcagcaaagtctcaggatacaaaatcaatgtgcaaaaatcacaagcattcttatacagtaataacagacaaacagagagccaaatcatgagtgaactcccattcacaattgcttcaaagagaataaaatacctaggaatccaacttacaagggatgtgaaggacctcttcaaggagaactacaaaccactgctcaatgaagttaaagaggatacaaacaaatggaagaacattccatgctcatggataggaagaatcaatattgtgaaaatggccatactgcccaaggtaatttatagattcaatgccatccccatcaagctaccaatgactttcttcacagcattggaaaaaactactttaaacttcatctggaacaaaaaaaagagcccacattgccaagtcaatcctaagccaaaagaacaaagctggaggcatcacactacctgacttcaaactatactacaaggctacagtaaccaaaacagcatggtactggtaccaaaacagagatatagaccaatcgaacagaacagagccctcagaaataatgccacatatctacaactatctgatctttgacaaacctgacaaaaacaagcaatggggaaaggattccctatttaataaatggtgctgggaaaactggctagccatatgtagaaagctgaaactggatccctttcttataccttatactaaaattaattcaagatggattaaagacttaaatgtcagacctaaaaccataaaaaccctagaagaaaacctaggcattaccattcaggacataggcatggacaaggacttcatgtctaaaacaccaaaagcaatggcaacaaaagccaaaagggatctaattaaactaaacagcttctgcacagcaaaagaaactaccatcagagtgaacaggcatccttcagaatgggagaaaatttttgcaatctactcatctgacaaagggctaatatccagaatctacaatgaactcaaatttacaagagaaaaacaaacaaccccatcaaaaagtgggtgaaggatatgaacagacacttctcaaaagaagacatttatgcagccaaaagacacatgaaaaaatgctcatcatcactggccatcagagaaatgcaaatcaaagccacaatgagataccatctcacaccagttagaatggcgatcattaaaaagtcaggaaacaacaggtgctggagaggatgtggagaagtaggaacacttttacactgttggtgggactgtaaactagttcaaccattgtggaagtcagtgtggctattcttcagggatctagaactagaaatactgtttgacccagccatcccattactgggtatataccaaaaggattataaatcatgctgctataaagacacatgcacaagtatgtttattgcggcactattcacaatagcaaagacttggaacgaacccaaatgtccaacaatgatagactggattaagaaaatgtggcatatatacaccatggaatactatgcagccataaaaaaggatgagttcatgtcctttgtagggacatggataaagctggaaaccatcattctcagcaaactgtcacaaggacaaaaaaccaaacaccgcatgttctcactcataggtgggaattgaacaatgagaacacatggacgcaggaaggggaacatcacacactggggcctgttgtggagtggggggagggggggagggatagcattaggagctatacctaatgttaaatgacgagttaatgggtgcagcacaccaacatggcaaatgtagacatatgtaacaaatctgcacgttgtgcacatgtaccctaaaacttaaagtgtcataaagaaagaaagaaagcccttcaaaccttaacttgtcttttatcctttacattggtgattgccatattcatctgcctagctcctaagggagaattcagaatataatccaacaccccatcttcattcctaacccacaccatcaccactccccacatacccagatcatcgtcctcctctccattctcacaaccactgcctcagtttaaccactgcccttgtgacgtcccacctataccatgtggtagcctccagccttgagtctctaaacaatcgaatctagtctccacatcaatgctgagtatctttctaaaatgccatctggtcaaagtgctcccccacctacaggattaattcaaatttgttattgaggcataaaaatccacttgtgatctatcccctgcctacctttccaatcgcatcttctgacattttcccaaaggtatcctttattccagccacagtaaaatacttgttctctgacaataacatgttctctatagacagctttctaccctgaaaacctgtccccaccttatcccctaccctttcagcccttaattctactctgaaaattcctgttcaggtgatttagcctgcattatttttgtggaagtctttgatgacaacccaatgcaagttaggggatttttttccccctgggctcccatagcatattatttgagtccctattttacgatttcccacattacactgtattgtttcttcatgtctcattactctccagattgtaaactctttacagggaggtgccttgagactctctttacctgtatttcccactgctcactccatgtttgataaatgcattagtcattggattctgaatgctgggactatggacatagccagctctagcctatcttacctactctctcctttaaaggaaaccttattactttctctgctggacctgtttctaaatcaaattaagatagcaagataattatatattattgtcaatactacacataactttgtattatcatttttaaagctgcaagacagagaagctagcttaaagtgttcaaaatctggttattcccgactgaagaaggagatttatacatttaatttaaatccaaagtgtgctgaaccctcaaagactggcaatgatatcttcatttcaaagggaaggttatagttagaccataaaattgtttggtatttggattctcttcataatcctgccatataaatttacagactgatttgtttttacatatctttgtcatcctagttatttttatttttccaatggcatctgctttttgtttgcttctctccatccctaacttaaatccaatttactgacaccattggctgaacagctgcaggatgcctttgccctctctgcttttgttcttaggattgctctttcttctctgctgcaatccccagaccttactgggatgactccaaccctccagcactcaggtcctacttcttatattgccccaaagctgattaatggtggtttcttcttctggattggcaactgtggtttagtatgaatggaactacttaataataacagtggtggtagtagtaatatttattgaacatttgctatgtgccagatactctgctaaacaactatcatatagattgtcataattcactttcatagcactcctatgagagctagtgagtgaaagatctcaaattcaaacccacacccatctgattacaggataaagcagcagctccttagcagggcttgtgaagaaaaaaggtgagaaattctatctctgttcctctacctgattacaggttcccctccctgtcttctcacctcaccacctgcctccctgatggaccactgattgaaaggactgttaatgagatttttgctctctctcctctgcatctttaccttttcacagccaagcaggcagtggttcttccctgcattgttatggctggactgcccagtacacagtagtgtcataaaacacacgcatacacacacacagagggagagagagagagtgcaaatatgcaccaccaagattttaaaaacagctctgaagagatacttttcctgcacaatcaacatctcacttctgcttaactcctgtggtcttttctgttgaccccccttggttcctgatcccgggtacacctctgccaaataaatgcattaaaacaacaataacctctcattgctatcattttgcaaaagaaacaatattttaaacaccaaactagacatagtctcagattgagatatctcttaagcaaaataaatttacctttatgaaaaaatatatgctagactcatctcccaatactaaagccatgtagcctaccacgatctcaatctttagattgagaaacaaacctggaacaactcacagactctccagtgccaaccattctgcgagagtgatgtctgcacttccacgctccagattcaggagagatttgaagtagctcctcttcacaaaaaggtaggcatccttggcttgcatcacctccctattctttttactcattcgttgttcagagagttaaccgacccttttctgagctactccaggacattgtacagacttctgttcttattatagtatttttgggttacggtttgtctgcctcctccactgtattttgagctcctaagggcaagggttttgtctatctcattttggcttcctcagtgcctagcgcactttaggcactcaatctgttgaacagaactgacccctcacagaaaaaaaacaagctcactaaattaatgggaggaacagagctcaatgaagtgtttggcagaataattttgttaatgatttttaaaattttgtcagtaatttaagactgtaatcattttcaaacagttatttaatttttgagtcttattttcagtgaatgtaggttatataaattccatttctagatctttccttttcccactgatgtcccaaagcaaaggaataaagctagagaccagaggatcctaatagggtcattattctcatttgagaacaataaccttggaatctcaccaatcacaataccagctagagatctgttagtcattaatgataaagttcatgcaaagttaaaactatgtcttaatctctttgggaggccccattacttagtatgtaatcaaataatatatactaagtgagtgaatagattaattattttggcagaaaacttagtgttctagtttctaagaatagaacagtaatcctcagtatttttgttcagggaagttgggggcaggagagaggaagagatgggataagaatgagctgacagatatatttcatgctcagtggtctcacttgaaataaagacatcacttccatgttgtcttgtcctttgatgcgagtttctcaaagacatccagactgatcagagattgtctacactcagcagtccagtcttgatactttcttaatccatagtcaagaaacatgaaagatatgcaaattgtaaattgtctctcttccatcttctctctcctccctgagttctatctttctgcttaccataatgacttaataaattgattcttaattcaagttatagaattaaatattatgtctgaaataccactggatgcattttgaacttcccaccatgtactaggcactactctaggcattgggtatattgtgatgaagaaaacgaaggtcatccctaatttcatggagttttattctgataagaaagacagatagtgaccaggaaacaaacatgtacacagtttcacagaatgataaatgaagacagtaaagtggagaaatggaataaagatcactgaggaagtaggatacagccaccttacaaatatagtgaccaggaaaaatatttttgaggaggtctcagtgctaaaaagaggaataattcctccctactcaagccaacttgctcaacgacatttatcaatcagagtcattttcagttatagcctccttcaaagaagggtttatgtcaaagttcagtgacttataagagatgttctataagtggccattacctgattaatcttccttgcatatgcacttagaatcccgttaactggaaaaatcattgggttgctccaatgagcctctgacagttacacaagaaacttattcctcatcaaagatttacccaaactaccagagaccacctgacgatgtgttttactttctttcaccctaaatgctcttcacccactgggatattatctgttgacatgcaacatctgttgttcattttcgaacactaatccctgcggtgtgtcctttgggtgatcaagcttgctctaaagcttgctataaaatattcaagaagatttggactctcctatttttccactgacatttttacccctcctttgatttcaacttgattttatttttcctttgcttcccttcccactattttacttctttctttaagtagggcttttctgttcttctatgtgtacacactgctttgagcacatgctcttaaacttacaaagctcacacaattcaagcaagttatacttttagaaaaaaatcccttacactagcattattttattagaaaataaaactttttaaaaggtcaaacctattcttctgggaaaaacatgtttttcatatttagggtcaatcaaaatttatacttcagagacctgtcataaactcctaggtgttaggaacccctccttcatcactgactttgaagttaggagtttaaaccaaagataataaaaagaatcacacttatatttatacttgtccaataccttcattccaagacataataacaaccttcaagtaaattaaactctcaatcacttttttcacagataaatattatgatgaataagtagtagtatgttaatctgccagacacacaataaaaactgtgctaaaactaaaataacaggtctccatgaattatttctattatattttctcctccttctgcttccaagagtcctcccttgccctatctttcaatttgctctgaagtggctaattttgatatgaaagacttctgtcttccaatcatttcaatgacaatgcactgaaattgttaaacagtatgttactcgatattaaaactacgacagaatgggttcattgggaagtataatttgtttgacattttcatctttccagatgttacagaagtttcctttattcaccaagccaaagaactgggatacataaatagctttgaaattgacaggtaatttcaaaatagtttacaaaaatcaaattttttccctgattccttctccacgccttctctgaaaatttcaggagcaacatttcctatgagcaaagtgctcaaaaggtaacatgttcttcacttctggtacatttttaaaattccataaagtatgtcataagactcttcctaaatcttcaaaattcctggtcctatgaccaataaattaatcaaaagccatatgttatctagtgagtctccccaggacatgatagatgtccatgtggcctacaatctaaatactgggcagctcaggaattctgtggagggagagaggatggaatgagaagcagagacctattcacatcccagctccattcatatccatcctggtaactctgggcaaggcaagcctcctctacaggcctcaggttcaggcagagatggagtaaaataaggacttttgactctaatttcctttcttgctttaaaagtataacttattcatttgttgaaagtcaccactggaaagcaacaggcaaagtaatcgagaataaataagccacactgtgtgctctccagccccattttcactttaaactgtcccaccagtactcctcacacaaatcaagacagctgggttaactcgaaccttgtggggaaagcatttatatcaccacaggaaggggattcagagtactcagcctctactagattcattaaaatgggtacatagaccagagagcacatcaagttaagatttttctaacacagagatccagctctttcaaacattagagaatgcttccaattggaggaagacttaggtggcatttctcccctagtagaggagctgttccagaagcactttgatatgccaagagaattaattcaggtgaccagagcaaggggtttccacatgtgcaggtggtgaagcctattcatgaaacacttcccagcagcccaacccataaggaagtgctgcctccagatctgtttgagcactgctgcagtctggtttcctccttaatgtggaaaacctatgtttctgattattttcccaaaactggcatgaactagcagtgagtaacacattgcaaaagagctctgtgctgggcagccacacaagctacggcccttcagatccagtgtggcaacactaggaaagggtcgggccttctggctcccaccacagcccctctgccgaacagcgccgtggggccacctcacacaggcctttccacctgcccaccccacactggcttttctaagctgcctcttgctttgcaaggtctcccagcttcattcacactgcaaatttcattccattaccatgtcgaagcctcctcccagattattaatcaagatgtgaaataagataaaacctaatccgcagtccctcagctacgaatgctcaaagccaggctcattaaacatatctgtcaacaatggattacaccagccttaggccccaaattgattggaagtcaggaggaggcagtggggtgggtttggggggaagcatttggttgcacaatatattcaaaagaaggaattccttttaaggtgtggccaattaaatctgttcagagataagtataggctatacagttttatagattcttttctccagttgttaatggcagccgaagtgatgggaacacagaactggtaattcatgtaccatgtgtgtgaaaagctgaaaatcattatgaatggaagtaaagcaatatgccatcttggaagcaaacccagtgaattcttgcatggattcaaatgctatttccttgtgtcaaaaaaaaaaagagagaaaaaaatattgaattctgtttaagtgtttaaagtcacatttcactaaggttcttatctatcatcctgtcattagcatcctcaccaccatccccatcctgagatactttgtatttatattgggcttttcaagttcaaagcacaaagcagacataccaggcaattaatcactttgaggaatgtgagttgggtggaatgccttcccagcaaatgtattcctaacgtgtcactggaggatccagtcaatgggagtgttcctggcccacaatttgatgtcgtaagttggcagtttgtcagatttcaaatatactttttcacctaccaaactgacagccctatttactgaatcaaaggaaaagtgattttaccaatcttttaacattaagaattactcttctccatttgggtgttttgggtagtagccacattttatacacatcagaaggaacaaaaagcatgggagaagtaaaattaaataaatatattagttgttttacaatgagaaagtgagcaatagggaaaaaaatcaaatctgaagagatttataatgggaaacagatgtggacatgaaagtgatttgaagtaaccaacaggctccagacatcttccaagaatatgtttcatatacataaacatttaacagcacaataactaggccaaaattgcccaatttcaaaacttcacctgcgttcctaagtttgctttttgttccttgagattaaataggacaagcagagtttcccatatttgagctgtttattaacaattatttatgatggacaatgaaatgaggcatatctgttttgcttttctgtcctggtaggttttatattctgcttccaattcccatacccccgtgctgttctatttgaatttccaatgcagcagaggaaatggcttctaaaatattaaaatcctgttttcattgactttctttacgctttgtgaccacatttctattcagatcaggttgcacagcttttaacttctccaagtctaaacttaaagttagagcaacttcatggtactccttaagtggatatctcttataacaagggagaacgcagtctggaaacttcagagcatccaggccaatgggatgactcttaaaaaaaaaaaaaaaagagatttttattccagttttctgattttttgaaatggtcttgaactacaactgcattttgaaacaggggctcctttggagcaagacaccaatctggtaaagtttccaagagaacaaacttgcctgggttcacatggctgaaaaagaaagtctcagccatgtccccagtactcaccctatgatttctctcctgacctccaatcttgcattctctaaatctcaattttctacacaggaattcttcttattgttctcatattatcccttttgcatattgcttggcctccctgaaggccaagaaatgcagtcaaggaaaatgaagctggccattctctatgagacaatcaggttctaaagcctcagctcagtctccaaagaaaaattatctgtgaagttgaacttggggcctccagagtctgcccccaggaatcctgattgcctttccctaagtaacaaccctcactgtaatattacagttctaataattaatgcctctatgctgttttatagttcacaaagcattttcatatcttcacaagagttctgtgacagaaggtggcaggttttgtgttagctatagtttacagatgaggaaactttcattcagagaggttctatgaattgtctaagatcacaaagataattagtagagaagctagggctctacatcaggacttctaatttccaatcctattttccttcctacatactgcttgtgttcctatcatttcatttcctgaaagcagggtcattctcagaagtttttgttttcctggcgcctccctttcctctcaagtacaagtagttgacagaaggtttgggaaatccattcagactacggtcaaacaccctgtgggcggatgtggtctgtctaaactccatcccaattcatttcacttggatctaaagtaagtctcggtcatgttacagatggtttttaatttaacaattacttatgaagcaccttcttttcaggcactaagctctgaggagataacaatcgataagactgacccctcgccagccattgaggagctcacagtctaaattagacatataattacagtcaaatagaacaagtcatacaaaagagggcactcagggcactgaacagaaatgatcatggaaggcttcctggaaaaggtggcatctaaattaaggcctgaaagatgaggtagccaagtgaagagatggggaaaactatttcagttaaaatatatatgtatatttcacaggcgagttgttgttttatggatatagagttgcagtttgacaagatgaaaaagttcttgagatcagttgcacaacaatgtggagacatataacattactgaactatatgtattttaactcaattagaaataaaatgtatgcattttttttggcatgtaaaatgaggctaagaccagtcccacttaatgtaaatcccgggccaccattcctgaaccttttactgattttacatcattccctggtgagaaatttcagtcccgttattgattaactctgataagagacaatcctaagtaaaaggagtattaattctggtttttccgaacttcagcctcctgaagagcttacctcctttatagacctccagagctcctccagacctgcccagatcaaccatgttaaagcacaagcaagggaacttttctttcagctgaggccaggctaaggcaagggagagaggatccaggcatgatgatttaaaatggtgccaatcaaacaaactcatgtaaataaattatcttgtggtaagaaatccatgccttgcaggttcatctattcctaggattttgtgggttttaaaaaattggtttaaataatgttccttctgagcatccctagtttgaattggcaaggggaataggatattccatttgtagtggtagcagcttctgaatctctggagggctgggaaaccccgacagagtagaagcagtgaggaagggggccctgggcctagtgtgattgctgctgcttcccacacagggtcaaatcatactagtccagcacaccaggcatattcccattttctcagaacactaggaagaactgtcagcattgggactttcaaagctggaaattctgtgaggaaaatgtgagcaacaggaggaaaagggttacccaagagccatctcacctggtttctccctgtgtccctccttccctacccttccccatttacttactccagaaaattgtacactcctcataggccaatgagtgaccgacttgtccattttctattgctataatggaatatcacagaatgggtaatttataaagaaaaggagtttatttagctcatgattctgtaagctgggaagtccaacagcatgatactggcatcttgcaagggtgttcatgctgtgtcataacataacagaaagtgaaagggcaagcaagtgagtgccaaagagagcacaagagagagccaatctcacttttataacaactcactccttcaagaactaactcccatgataaaagcattaatccattcatgagagctctgccctcatgactcaatcacctcctataggccacacctcttaatactgttatattagcaatcatgtttccaacacatgaacttttggaggacacattcaaactacagcagtaatcatataggttctgaggtacaccaagcctgaaactgcaaggtaagcaatactaaaaacctacctgagattcttttgttttttcaacccattacttcaaatacttatcatgtactccttctgtctacctgaaaactgtaccctctgaccaacatctcctcattccctccacccagtctctggtaagcaccaatctgctctctgcttctgtaagttctattgttttagattcaaaatataagttagaacatgtggtatttgtctttctgtatatggcttattgtacttaacataatgtcctctaagttcatttatgttgttgtgaatgacagaagttcccacttttttaaaggataaatagcactcccttgtgttatatgccaaattttctttatccgttcatctgatgatggacatttaggttgatttcacaacttagctattgtgaataatgttacagtgaacacaggcatatagatacctctttgacatactgatttcaaatcctttgaatatatacacagaagtgaaatggctgaataatatgttaattctagttttagttttttgagaaacctccatacagtttttccatgtctaacttatattcacactcacaatgtacaagggttctcttttttccatatccttgccaacacttgttatatttcacttcttgataatagcgatcctgaaaggtgtgaggtgatatcttattgtggttttaatttgcatttctccaatgattaatgatgttgagaattttttcatatatctgtcggccatttgtatgacatcttttaagaaatgcttattcagcgcttttgtttttttttaaatcgggttatttgttttattgctattgagttgtttgagctccttatatattttggatattaaccccttatcagctgtatggtttgcaagtattttctccaagtccataggttgcctcttcactctattaattgtttcctttgctgtgcagaagctttttagtttgatgtaattctatttgtctatttttgtttttcttgcctgagcttttgtggtcaaacccaaaaaatcattgcctagaccaatgttgtatatattttcctttatgctttcttccagtatttttacagtttcaagtctgatgtttaactctttaatatattttgagttgatttttgtatatggtatgaggtaagggtctaatttcatttctctgcctgtagatatccagttttcccagcaccctttattgaagtgactgtccttttctcgtagtttattcttgataccattggcaaaaataagttaaccataaatgcatgggttcattttgggctctctcttctgttacattggtcagtgtgtctattttcatgcctatatcttgctttttaaattactatacctttgtaatatagtttgaagtcaggtagtctactgcctccagctttgttctttttgctcaagattgccttagctctttgggagctttcatagttccatatgaattttaggattgttttttctatatctgtgaaaagtagcattggaattttgatagggatttcattgaatctgtagatcactttggctagtatggatatttttaaacattaattctttcaatccatggacacaaaatatctttccatttatttgtgtcatcttcaatttttttaatcaaagttttatatttttcagtttacagatctttcatctccttggttgaatttattcctaagtatcttttgcagctattgctttcttcatttcttttttggatagtttgttgttagtgcatagaaatgctactgatttttgctttattttatatgctgcaactttattcatttattagttctaacttttttgtggagttgttaggatttcctatatataagatcatgtcatcagcaaattgcaattatttcaattattcctttccaatttgggtgcctttttttccttgcctaattgttctggcaaggacttccaatattatgttgaatagatgtgataagaatgggtgtcgtcttgttcctgatcttagaagaaaaactttaaacttttcacccttaagtatgatgttagccgtgtacttgtcacatatgacctttattatatttagatatattccttcaatacctaattgttgaggtttttatcatgaaagaatgttgaatttgtcaaatgcattttttccatttaatgagatgatcatatggttggtttttttccttcattctatcattgtggtgtatcacatttctagatgtgtatatggtgaaccatccttgcatctctggggaaaatcatggtgaatgattgttttaatatgtggttggatttggtttgctagtattttgttgaggactatctgagattcttaagttctataaaatacttatctcagaaaaaagtcatagtcagctgtgaactccagcaaacacatcagaatctttcaaagggtccccaaaggtttcaggatgatgatccaaccatcataacatggcactgttaaatatgctgctataacaaaaaagccaaaatactgtgattcatagcagacagatgtttttcacctaacattacagaaggaaattggcaaccgacatcacttttgctcatatctcataagccataactagtcttaaaactagactggaaactgtaatctctagctggatatccctacgttcagctaaaacttggagagtttagttccaaaatgaaagaggggaaaacaggtgttgagagacaactcagggtctacgttttctcccacctctgtctgtacatgctatactcagaatgcctctggcttggataattccctatatccttaggacatagttccagcatcaccttctctgggacacaagcccctactctgcactctcagaggatctgtgcttctttgtctaccccaccacttatctcactcttattgtaattgtctatctgtcagctttcctaccagaccagggttcacaagaatgggcaccatatatgttctttatttttatattcacagagcccaggctagctcatggtttctaatgggtgtataataatgactgtagaatgaaggaaaaaaatacaagagcagaaatgatctgaaaatcctaattaggcttctgtttcagataatccaagaattgtctatattatttcttaaaagtaagaattttaattttttaccagcctaaatatgactggttcctagtcttgtccatatttcatattaattctaatgctcctgcaaaggcagagattttttctcaaaaatactattaaaataacgcaggcaacaaagtgtggccattaaattaaggaggaagtgggttacttagaatttggaaaagcagattcgctataaaaatatcttatgcatgctagtttaccaccaaaaaaaaaccctattttatatatataataaaataaaatcaatctctgctattcaaattggaatctcctattgcactgcagtgtagcattcaatgcaacagtggggaaaacaccaatgtttgtagagcagatgaaatcctctagttgggcattattgtaacaggaagacatgagtggatggagagctccaccttgggtaactcaaatcccccacagagccatggagaaagaacacctggtctgcttcttctcaccccatctgccctgcacctgagcactcagctattgttacttctctgtttcaccaacagaagcaaggataacttgtcccatcaataaacaagctaacaactcaacaggcttttttttctaaactactaacttcactgtaaactaaactaaagaactacggaacaagaagagttgtcagacttcaggaaaaccacttcccaggggtgaattttcgttgaaagagtcacgtggcctgaaaactgttgggaaattcaatcctgatcaaacgaagctccttccccaaatctaaacccaggagtgtctcaactagaacaggaaacttacaacaggagtaatattaaatactgaaatttctatcacatgggtagcaatgcaggaatttcacattgaaacctaatatccaaatacacaaaatctcatttacaatagcatcgaaatgactaaaatacttaggatcacatttaaccaataagatttgcacactgaaagctataaaacattgatgaaagaaattgaacacacaaataaagttatcctattttcattgattggaaaaattaaaattgataaaatgtccacactacccaaagtgatctacagattcatgcaatctctaccaaaattccaatggcatttttcatagatgtagaaaaaaatcccaaaattttcatggaaccacaaaagacctcaaatagccaaaacaatcttgaatttaaaaacaaagctggtggcatcacatttcctgattcaaattgtattacaaatctatagtaatcaaaacagataaatagatcaatgtgtctcttttcaatagaatagagagcccaaaaataaatccatgcatttatggtcaactaatctttgacaagggcactaaggatatataatggagaaaggataggtttttaaatagatggtactggggaaactgtatatccaaacacaaaaaaaatgaaactggactcttattttataccatatacaaaaattaaatccaaatggattttgattaaaaaacttaaatgtaagacctgaaaccataaaattcctagaaaaaaacatggagaaaagctctttgacgttggtctgggcaatgatcttttgaatatgacccaaaaaagcactggcaacaaaagcaaaaacaacaagtgagactacatcaaactaaaaagcttctgcacagaaaaggggaaaaaaatcaacaaaatgaaaaggcaacctataaaatgtgagaaaatatttgcaaaccatatatctaatcaggagttaatatccaaaatatataaggaactcatacaattcattagcaaaaaatataacccaattaaaaagtgggaaaataacccgaatagacatttttccaaagaagacacagaaatgttcaataagtatatgaaaaggtactcaacatcactaactatcagggaaatacaaatcaaaaccacaatgagataaccaccacgagatatcatttcataccgaataggatagttattatcaaagagacaaaatataacaagtgttggtgagggtttggaggaaagggaattctagtacactgctggtgggaatataaattggtatagccattatggaaaatattatggaggttccttaaaaaattaaaaactgagctaccatatgatccagcaatcccagttctgggaatatatccaaaggaaatgaaatcagtatctcaaagagatctctgcattcccatgttcactgcagcattattcacaaagctaagatactgaaacaatctaagtgtctgtcaatcgatgaatggataaagaaaatgtggtgtgtgtgtgtgtgtgtgtaaatacacaatagaatattattcagccattaaaaaggaaatcttgccattttcaacaacatagataaacctgcagaacattatgttaagtaaaataagccagacacagacaaacactgtatgatctgacttacatgtggaatctaaaaaagttgaactcatagaagcagaatagaacagaatagaatggtagttgccagagagtaggggttgaggtagaatggagggatgttcatcaaagggtacaaatttttagctgtaagatgaataagttctggggatctaatgtacagtatgttgactattgttaataatatttattgtatactttaaatttgttaagacagtagatcttaagtgttctcaccacacacacacacacacacacacacacacacacaatgtaaggtgatagatgtattaattagtttatgacaacatttccatgatttatatggatatcaaatcatcagttaccccataaatatgtataattcttatctgtcaattatacctcagtgaagcatgagggaaaaaaaagaaatattgccaagtagcttctcaaaaggtcatgcaaatttgcatttctattggcagtgtgtgacagtagccatctcatcatttctttgtcaatgctgcatttttaacaaagcttccaggtacttcaaaacatttttggaaatgagcaggaatatttccatattaataaaaatcaactctcctatctcccactttcaaatttctagtcatacagcaaagttgcattcataccctaaagctgataatgcagctatagaaaattttgatgactaacaaatcttatataataatagatgttttcccaaattcctgttcttaataaagatcttttccctttggtgataccacttatatttgatacctctagcatgttaaataatttaatagaattttttaaatgtgctggtagttggaattgcaatgtttgggggatgatttttctctaagattgaattttggaggcaagctctaaacaattatgtaagcaactggagagcattctcaatgattttataagctatcatattggctcagatatgataatttacaaagcggcctgagaccatttttgtctttagctacaaaggggtttctctaatatcctgattgagctttcctttgatacttcacaattgtctatagcttcactccaccaccccaacagacctccagaactctttatcaaaacaataacctacctatggggggcagagagagaaattattaatgatattttaagttggactcacatcaaacaaatttaccggcagaagaaacaaatacaagataatgactcatcctacctcaacctttttttttttttgagtttttacttatttattttttgtgcagcatttccacttttccagtaagaatgaaatatatatgcaagtacacgttatgaaatatagtatactgcactccattgaatggttatagaataaaagattcaagttaaaagaagcctcacaaatttctagcccaatcttcttattttgcaaataaaatccgtaaaaaggaaatgatatgacctgtctgtggtcccagagtaacacatggaagagaaaaaatatcaaccaagggcttttgctccacagtcagatttagtcaccatgcatcaattttgacttctcagcaagctcttaaaaggatagtctacctataaaggcaaatagtaaataacagttggtatcatttactttattaaacactttcaatgtgccaggctctttgcataggttttcccactttatctttacaacttcctcatagcatgtggcaacagaggaaagcaatcattaggtgatttgctcaaggtcacacagttaggaaacaatatacacaaggactgggacctagagtgtgctactcaaagtgtggtccatagactatctgattagaaatcccaaatttcaggccccatcccagacctaatgttcatagtcttccctttaaaaagatcccccagtgattcacacacacattcaaatttgagcagcactggaaaatccaaagcctgttttttttaaccatttcacagtactgcctctaacctctggaaaagtcaaagatactattaaaaactaccgtgtggacatcacataagtaagaattaaatacagcccactgccttaagaacttttaaagatcaacattcaactctaggaggaaaactacaaacaaccaatatccgaaaactgcagaatagtccatgtttagatctaccaaaggtcatgtttacatcaattccaacaagagcaaaattttaatccacaaacacataaagattctgatattgttattaatgggaatctcacaaatatgtgaaaaccaggaaaactagcaagttcttgtgagatacttccattctctctatcttgtgagatacttcattctctctatctcttccatcctctctatctcaatttcgtctctccagattggaggaaggcaaggagtcacacatatttgaaaaagaattttaaaaccataatgttacttccaagaaaaattatcacaaatataatatattgagatagtgttctcattaggtaataaagactaaaaaaaaaataaaactgacagcaagttggatacagaagtcccaaccactgcccataggaacacaccccagttagtcttcttgccataatttctccaaaaaaacaacttgacatttttgaatccataaataacacatggaatctgtaaagtacaacataaataataggccaaaattatttaccagaacttacagtgaaaacgctacagagagggaaagaaaaggcactaaactgtacaattaatgttacaaagttacattagcacataaataatttcagtggcaagtcataggattcacatgcatattttattacactgtaagaaataatttttcaatttgaccctgatccttctgtgtactttgaagtctgcaaatcagcagtatagcctgtaagtttaaagaaatttagaaagaattgtgaagttaaaaggtacttttgatgtttgttctttttctcccatcacaacggcatttgatacaaccaaagaaaagtggaaaatgttaatgcccaagaaatttccattgcaggcatattcatttaaccctttatgaccacggcctgtcataggtcaaaggttaacacaagttctcagtgttcttagttcccaggccctgtcaccctcctcctctttttaataactctcaatactatcactgaacctccttcctgcatactgttgcaatcagctcccaacttctcttcctgtcttttcccccctcattttacacagtgtttcaggctgaatcttctgaagcacagctcagatcacagtactcccctgctcaaaaaccttcagtggctcccctttatctgccaaaggaaattcacgcaacctaactctcagggccttttataatatggtcccaactacctttccaatttatttcccatggttcctacatacaaaccttaattgcaggtcatactgaatctttgctatttgccacctcacaactttttcctttcttgactttgcttatagcaaggttgatatagagcacagacctgagagctagactggcatgtttgaatcccagattgacctcttggtagctgtgtggctttgggcaagtcatttagactctctgtgcatcaattttctcatatgcaaaatggtgacagtacccatcttacaggagtgttaggaggaacacttgagttaataaagtataggctgagtgtaaacatatgaggtttgctgtcattgctactattactgttttcctcctaaattctcaactgcttaccctcactccccgttctctctcaaatgtgaatgtttttctcctcctatctctgtgttcaaatccacccttcaagatccagctcaaatgagaccttttccatgaattcatctcaattgctcttaaggaatgcctggcattttaataggcaatgaaaatgatttgttaaagaatatgatttagcactgaccattctgtatggtaaatgccagattacaggtctttctcctcgactgaactcagccgaggtcagccacagctgtacctccagcgctggcccaataagcatcagtccctagcatccctaaataaatgcccattcatgaataaataaataaagttgaattcctctagcatcatatttgcacttacttcatgtccattttctcttattatattaattagggtatatatacatatagagagagagcgagaaattactaacatattatattaatcggtaagatccatatttgacttacctttatatttctggtgaccagcactaactcatatatagtagatgcttaatttaaaagaaaggtggcaaggccgggcacggtggctcacgtctataatcccagcactttgggaggccgaggcaggtggatcacgaggtcaggagatggagaccatcctggctaacacggtgaaaccctgcctctattaaaaaatacaaaaaattagccgggtgtggtggcagccgcctgtggtcccagctactcgggaggctgaggcaggagaatggcgtgaacccaggagcggagcttgcagtgagccgagatcgcgccactgcactccagcctgggcgacagagcaagactccgtctaaaaaaaaaaaaaggaaaaagaaaaaaaagaaaaaaagaaaaaagaaaggtggcagagagaaatgaagtagagaaaggaagggaggagggactatgtcaaacactattgctaatgtattgcgtgaagaattccccttttgctgattcccactgtcagaatgcctctatccagaccaacagaaaattcattatgccataaaaattaactttattatgcaagatttctccagattccaaagcatatgccagccacattgccaaggatttttttacaagcctccatcccaacttattatctccttataaaaagaaacaaggggtagagagtatgtctccacaaaatggaaaaaccctcaaagaggtgtttttttttctgttcctttaccttgtgggcaattcttatggtgtgtaactgtcccatggctcaaggttagagcagggatttctctttctcccatccctactatgtaattcaaacattctgcatactccttcatctggaatgcttctggcagccagctaaacaagattgttctgggatttccaaggctcagagaaaactatgccagccagcaaggtgaaggatgtgggagagaaggctcctcaattctactccattcagaatacctctctccagcagggatgaccctgagatgctgctaccccttccagacactattacaaagtcagaaggcagaggctgagaatatacccaagacctttcaacagagttctcatcacagcctcctcagggactccaagaacaaactccagttggtactgccaaatacaggacagtcaagaggactttcaaggaagacaagaagaaaacatgctgcttgtttcaacattagcacctgacatgtagccaaagcatcataaagaaaagtagtagaagacttcaagaatatgtctacaatgaaaattggtagacagagagtactatagtgataatgaacatagaatatggtgccaggcctacctggtcataatccactctgcctcttacttacaatataactgtggcatttacctaaactctgtgagcctctgtgagttattatgatttcataaaataatgtttatagtatgctatgcatagagcaaacaccaaataagtgatagctaccaataagaagaccaatataaaacaatgattcttagaagacagctatcttgttcacagccataaaatgttatccttgcgaaatcaagatttgttatcatttattctgcccaatctgccaaaataggatatttttattcactgatcaagcatttattcaagcaaattaatcaaacataaaaaaattttgaataataaaacataatatgtagattcaaaataaaatctgatacttaaatgagtatttctaaagactatgcaggtgaatctttttaaatttttcataaagttatctctaaaattattttcttactaacttaccattgctttttatcataaatgtcaggggataggagaaacaatatgccagtctgggccaggcatggtagctcatgcttgtaatcccagcactttgggaggctaaggcaggagaactgcttgaggccaggagttgaagaccagcctgggcaacagaataagacccatctctacaaaaaatttaaagattagctgggtatggtggtgaatgcctgcagtcctaagctacttgggcagctggggctggaggatctaagagtttcaggctacagtgagttatgattgtgccactgcactccagcctgggtgacagagcaagaccttgtctctaaagaatgaacaaatgaatgaatatttttaaatgcgagtctgaacattttttatctaagtcaattaaaatactagtcattgaaatcaaacaattgaacactaactgatgatatagcatctcttaacagttcacattttccgtgtagcagcaaccaaggaacttttctctgctattggctaccctagttttcttctacccttcttgagccatggaatttttcccgtagtccccaactttacccccactgcttctatctttgtggctttgccctcttttatcgcctaataaggctggatagcactttgattcctcaccgtctaacacacggcactttaattttgaggatagagaatggctaacatcaagtattcctataatttattaggcttactgtattgtatgctgtggtcacttaaaaagaggactacaatactatatataacacactcagaaatgttgtataaagaccctttttgaattcataaatcttttcttatacagccagattatcataaaatgtatgtgtgggtcgagcgcagtggctcacgcctgtaatcccagcacttcgggaggccaaggcaggtggatcaccaggtcaggagatcgagaccatcctggctaacacagtgaaaccccgtctctactaaaaaatacaaaaaaatttgccaggcgtggtggcgggcgcctgtaatcccagctactgaggaggctgaggcaggagaatggcgtgaacccgggaggcagagcttgcagtgagccgagattgcgccactgcactccagcctgagggacagagcaagactccatctcaaaaaaaaaaaaaaatgtatttgtgatgtgcaaatgaaagagcatttcctgtgtctagtcagtggtattcccaatctctgcctgcccttaaaaaaagtctgcactgaaaacaatcaacaaaaataaatgttcctcattagcaaataattctttgtttttcagtgagcaatgctaccaaaatgacaagttaagattcttgaattgttcagtccttacatttcagtaaatgcatcaaatagatggtttaacttagagggttattccagcaattagcctgagttcctcaaaataataaaaaattatgaaaattcaattatttttatatacttgctaaaatagagggaaagggccatgctcaccctgaaactaagttctcccttttaaggggaggatgataacattagtcaccagcttacaaaacttatcagaagatttgaaatgatctaaaggggtcctccaagaccatccagaaaagggacactatttatttgaacaattactcagtcacattttactgtaaaagttacatcacaggctctatatattggcctgcacaggattcccttgtatgcccaatgaaacaaaaacaacccagcttctgctgctgctattataattggctctttagtcttccctcccagttagcacatcttcccatgaaagatattgaacctacttgaagttgtctaaaatcctttagaaaaatacggattttggtggaagcaacctgccaataatattgagcaagctaaataaagaaaaagagctaagcaaggttggcccgtatccaagcattgaatgcactgtcgatgtggcaaggcatcatcaagttcaaaagatcatctcctcagtcgcagaaaagctaggttcaaagtgaatgttccaaggaagctaatttcatgtttgcatttaatctccatattaaagaaacatcagacaagtggtatttagaggaactctacagctaaatccaagttctgggactcaaactatgtttaccttttgggagaatagccattcgggagaatgaacaataaatacagatatatttttacaaaggatattacatttctctacactttgcactcccagaagaagaaaataagaggattctgtttcctgacataccatactagccaaattcatcagtcattggagattattctattcgatacatatttctttagggactgcctggctctctttcccttctggaattccaaatgtgccagactgcagcatcttcttctcatcaaagtataaaacattcccggacaggtaaaatagtccctgtcacatgacttttaccttagatatttgtatttcctatgtaattttaatgtacctataaatcaaaagcatctactagaagcgaaaagtggacctgggttttgctgatattttgtggtgctagatttggggactgttactgcatgtctaaacattttacatcttcaaggtggcttgtatgtcgtctgaatcttactaaactgacaatggccaccataggactagatttttatgcagaaaattttgacactaacagcaaaatgacttttattgaaacaggcattcacactgaaaaatggggattgcaccaggaaaaattcttgagcaaagctttctaatacatacagttacttgagtcaattaagcctacccaatattctgctttccagtctctaggtttatccacctaccaggtctagccaacttcaaaagcctggtccgatggccattcccagggtgtaagccaagagtaggccttgctgggtatgactcagtaggaagccattactatagcagcatataatattttcacatacaagcagaagaaaagagaacagattttgtttaatgatttttcccaagtttttaggaagagggaaaaaagtaaatataatttttattcagccatacaggaaagggaaacatttaccctaaaaccaaagaaagaaaaacaaaaggtggaacctagcctttataccttatccttttccacaaagaattgagacattttacagataagagtagagaacactgtagaggaaaattttaatgaagtgacaagttgtaccaggaataaagaatataatttaacccacatagccactgtggctaagcaccatgcttcttcccaactgaattaaaagaggtacaggatagtcaagtaattctcaatatcagtgaataggaaatatactagtacttcagtggaagcaaatatttccctgccactaatctttaagaaaattgtatgtgagacttcttgtgagtactctaactgaggtgatagagaaggtttctgatgacatcctcaaggcaaatgtgacaatagatagattttataggtatatcaatcatggttctccaaagaaataaatccaatgggagatatactttcaaggaattggttcatgccattgtggagtcaaaatttgcaaggcagtactgcagactggaaactcgagtaagagttcatgatgtagctgtgagtctgaaatttgtaaggcagaccagaaggctggaaacccaggcagaatttctgtgttatagtcttggggaagatttcatttttctccaggaaacctcagtttttcgcttttaaggccttcaactgattgaaagaggctcacccacgttatccagagtaatctcctttacttacattcaactgattgtaaatattaatcacatctacaaaatgccttcacagaaacatctacactagtgtttgaccaaacaactgggcaccagagcctagccaagctgacacataaaattaactatcacaataggcctatatagcttctaacaacatctcataaaatttgagggcacaccagcagaaagcagttgcataagaagtcaaggtaatttgagctgccaccataaaggattgcttaaataaattataatatatctatgcaatgaaacactatgtaatctgtaaatggcataatctcaagtaatgtttaataacaaaagaaaacatttccgatttagtaataagtaaaagaaacagaatttctaagtatatataacatgagcataatctctatcattataaaataaataagttactaatacatagaattaagaaagagaatctctgaatcccataactgagtgttttatattttatgttttaaataattggtgtaaattacttttataattgaaaaatttctttttaaaaaatcaccagtttgagattataaaatttaagatcctaatactgactcgtgctgaacagcacatttaactcagccattcagagcctaggttttctacaagtgttcttagatctagattagacatgaataaatagtagccttaaacaatagccttaatgttctttaccatatatgatctccaaaattattcagtttcaattgttttcaaagctggagttacccatcacagtaaaagaaattgccaatattgttctgaggaaatgtctggtcttgagtaggcctccaagaagcactttgatcctttagctactgactgggattcagcaaggccacttagacaagttgcagcatatccagggctaggataaatgagtactctttcctatgctctacaggctcttcctggggaggtgggtgactagatggtcttctccctttccacagatctgctatcctccctcccatgtggtactttatggtgtgagggtctttttaggcctaggctcctcccttatggaaggccagcctcccaggaaggaatggcacccacgaatcagggtttacatttactccctgtcatccagaccctggcacagatggaggtaggcaacctccactggagctaaggccttttgctgattttttctgattcataggactctatggactccacagcagagagactcccagaagtaactttggcaagtgatggcacactataaattataataacccatccatttggattgatttgagcctgtccacaaagcacattcaccctcaaaatgtcttcccctctgatctgccccattagctgaaattctcatcaggattcacttgtttgggtgaagatactatctccaggataaccatgttaaaatgcaaacatatgactcacaaggggaaacatgttaatttatcagaatcttctgtactttggagaggcaaaagtaggaagtggagtggtctccaaaactgaccaagactttagaactccatttatgtgcatccctagcagatccattttaaaaagccccacgccaatgatagatttcccattggttctcctgtgatagagagtgactttgaaaggataaatattatttttctcccccaaaagctccagcaactctggaaagatatcaccagggttcacaattttacccttgcaagaagtaagtttcacctagatttgacaccttggaaatcctccacccggtctgttttttcagacggtcaactagtgttgggtccttttcaaggagtaagatgcatgcctcctgccattttacaatgttctcctgtactggattccaggaatcccagagggcacagaaagggcaccattgagcagtgcagctccattgtctccaaagactcacaaagaagcaactcagtgagttttctggactcagtaactgctcactgcatttcaaaatgttctgggtgaaggcaggttctaccacatgcccttcaagtttgactgtttttacattgtggaacagacctaattttgccatggatagaaacaatctgcagaaaatatcaagtgaactgggtttcttaacatgagatcatgccaggaatggaagcagttatttcctgtctaaaaggagcccaaggccttcaagacttcaagggcaccatctcaatcttcttaaaaactgagctgcttgaggccaaaggaaaaccaaagtacatttccagtggtacaagatgatcatgatacctacgaggataactataggtaaagaaggacatcctagccatgccttttatcaaatgaggtagtatatgcataaaaagtacttaagaaatgagtgcggtaattgtctaagagccttagccttagtcaaaagtcacactgtctgaacattagatatggctaatgtaagggaagaattttgctgccattatctttaagagaattactttgagactatccttgggcttttcccccagctcctttttttgcagggggtgggtaatgaagtgtgctatagtttgggtgtttttcttctccaaatctcatgttgaaatctgatccccaatgttggaggtggggcttaatgggagatgtttgtgtcaggggggcagatccttcatgaatagctcagtgccatcctcaaagtaatgagtgagttcttgctttattagttcccaaaacagccgattgttaaaaagagcctgacacctccttcctgtctatctggcttcctctctcttgccatgtgatctctgcacacacaggttcacgctccccttccaccattagtggaagcagtctgaggctgtcaccagaagcagatgttgccatgtttcttgtgcagcctgcagaactgtgagccaaataaacctcttctttagaaattatccagccttagttattcctttatagcaacatgtgttagtccgttttgcatggctataaagcaatacctgagactaggcaagttattttaaaaagaggtttatttggcttatggttctgcaggctgtacaagcatggcactggcatctgctcagcttctggtgatgcatcaggaagcttttactcatggcagaagttgaagggagagccagtatgtcacatagtgagagaggaagcaagggagatgccaggctcttttaaacaactagctcttgtgttaactactgtggggagggcaccaagccattcatgagggatctgccccatgacccaaatacctcccccaggccccacctccaacattgaggatgacatttcaacatgagattcagaggggacaaatatccaaatcatatcacaacacaaaacagactaagacaaagcacgactactcaattgtgtcatcattggagatactcaaaatatggaaaagggtaaatagggaggattcaagcaaaaggcttgtattagtccgttctcacactactatgacaaaatacctgagactggctaatttataaaggaaagaggtttaattgactcacagtgctgcatggctgggtaggcctcaggaaacctacaatcatggtggaaagcaaaggagaagtaggcgccttcttcacatggtggaaggatgcagtgagtacaagcaggagaaatgccagacacttataaaaccatcgcatctcatgagactcactcattgtcatgagaccaacatgggggaaactgcccccatgatccaattacctctacctggtcccacccttgacatgtggggattatggggattataattcaaggtgagattaggtggagacacagccaaaccatatcattctgcccctgggccctccaagatctcatgtcctcacatttcaaaacacaatcatgccctacccaatagtcccccaaagtcttaactcatttcaatattaattcagaagtccacagtccaaagtctcatctgacacaaggcaagtcccttctacccatgagcctgttaaatcaaaaacaagttagttacttccaagatacaatgaaagtacaggcattggataaatgttccctttccaaatgagagaaattggccaaaacaaaggggctacaggccccatgcaagtctgaaaccaggtggggcagtcattaaattttaaaagctccaaaatgatctcctttgactctatgccttacatccaggtcacgctgatgcaagaggtgtgttcccatggtcttggacatctctgcccctgttgctttgcagggtacagccccactccaggttgctttcacagggtgttattgagtgtctgcagcttttccaggtgcacggtgcaagctgttggtggatctgggagacagtggccctcttctcacagctccattaggcagtatcccagtggggactccatgtggaggctccaaccccacatttcccttctgtactgccctaccagaggttctccatgagtgctccacccctgaagcaaacttctacctggacatccaggcatttccatacatcctctgaaatctaggcagaggttctcaaacctcaattcttgacttctatgcacccactggcacaacaccacgggtaagctgcaaggcttgggacttgtaccctctgaagcaacagcctgagttgtacattggccacttgtagccatggctgggatgcagggcaccaagttctgagactacacaaagcagcaaggccctgggcctgggcctggcccacaaaaccatttttcccttcctaggcctccaggcctgtgatgggaggggctgcaatgaagacctctgacatgccctagagacattttccccatcatcttggtgattaacatttgactcctcattatgcaaatttctgcagctggcttgaatttcttctcagaaaattgattttccttttctattccattgtcagcctgcaaattttctaaacttttatgttctgcatcccttttaaatataggttccaattctaaaccatctcttcgtgaatgcataaaactgaatgcttttaacagcacccatgtcacttcttgaatgctttgctgcttagatttcttccaccagataccctaaatcatctctttgaagttcaaagttccacagatctctaggacagagggaaaatgctaccaatctctttgctaaaacacagcaagagtcaccttcactccagttctcagcaagttcctcatctccatctgagaccacctcaggttggacttcattgtccataacactatcagcattttggtcaaagccattcagcaactctctaggaagttccaaactttcccacatttttctgccttcttttgagccctccaaactgtttcaacctctgcctgttacccagttgcaaatttgcttccacatttttgcgtatctgtatagcagcaccccactcctggtacaaatttattgtattaatccattctcacattgctgtgaagaaatgccagagactgggtaatttataaatgaaagaggtttaatcgactcacagttctgcatgaccggggagggctcaggaaacttagaatcatggtggaaagcaaaagagaagcaggcaccttcttcacaggtggcaggatgaagtgagtgcaagcagggaaaatgccagacacttatgaaaccatcagctctcataagactcactcattatcatgagtacagtatgggggaaactgccaccatgatccaatcacccccacttggtctttccctttatatatgggaattatggggatcataattcaaggtgggacttggttggagacacagagcccaactgtatcaaggctcaacaagatgatgtcctttcagaacacaaagttttatgagtccagccaaagggaagtgcgcagctggaatgtggtaaagatgagaaacatcaccttcttaatcagtaagctgaagaaatcctgggttacagtctgtgaaactgtgatatatgtataatatatatatcttcttccagtttcctggcacatagttcctaaaacccttggaatctcttatgtcaaaagcatcgtttggtatgctaataagaagactagtgagtggggctgtgggatagcctcaggatgggagcctcagaggaagcaaccttgtgattagagaattggaattttcagttctacctcaggggctgcaggataaatttatcactaatggccaatgatttaatcattggcctacataatgaagtctccacaaaaaaagagagagagagtttgcagctagctgaacacatggagagtggcaagcctggggagggcacggaagcttcatgcctcttcctccatacattgctctacgcatctcttccatcgggctgttcctgagttgtagccttttataataaattagagatagtaagtaaaacactttcctgagttctgtgagccactctagcaaattattgaacccaagaagggagttgcgagactttcaatagaagcacaggttaacaacctagactttcagttgacgtctgaagtagggggcagtcttgtgagactgagcccttaacctgtgagatctgtgctaacttcagttagtgatagaattaaattgaactgtaggacaaccagctggtgttggaaaattgcttggtgtgggaaaaagccacacatctggtataaaggtgaagtattgagagtagtgagaaaagagaaagtaggagaaaacagtttctttcttcctatttttaacatagtccaataacgtgattttaagaaaataatgcaaacactccatgtcctagctttctcacttctaaacagaagtgttgctttcctagtcagtttgacttttgtaaagactaatcttaattcttaataaactcttagggttgcttagaaataagcactatataaataaaagacattgtacacctgacattttaaagtatacctaggaccctgagtatttcaccatatcagttcgagacattctatgaatttgtgcccattgtgaacttgttataagctggttacctcctttacacagacattctatcaacttttcttttttgtcctattaatcgtccattgtctcatttttcctaaaattgcctgtgcagcctccttccagaggcatattccatcaaggtttttcttgtagccatgctgaacactcagttattttaaataatttagatacataattttaaatatattatagttttgctccagaataaatgagatttaaatctctttctttgttccccaaataagagttcaaaagctagatggtcttttggaggctcaccaacacctaacggtacttatttctgtctcacaaaataaaactttggcatcagtcttctggacatgccacacaaagccacatttggtggataacccctgcatgacagatagtgaaagggcatgttcctccctgcccaagggagcccaggattatcctgcctaattgcctacaatgtgtggatctcattagaagaacttgccagtgctatacatagtaaagaatgtatgtctgataatatttcagttaggtttggaccaaggccaggagtctctctggcagactaaaaccactttaccaacacttcacttttagcaagaagactcatgataaggaaacataaacaagacatctgggtcacatccccccacttcctctcccactcttctacttcttttcaagggtttagaaatgttccccaacaattagtcatgccttttcttctacctcagtctctctcctgatatttttcactaagaaagtttgcttcaagggctttaaaaattcagggtcaatttttagaatttttttttaaagatttgaataccagcaaaacttcatcggtttaaccctacaaatcctcccctaacataaaacagcgtcttttaaaaagaaaattttatttagaaaatactttattaatgaaattaaagcctgcataatataaataatagcaatgcttgatttaaaatagtttccagaaaaatgaataaaaatcaagttttctatgtattattttgttttgttccttaatatgctcaagatttgggatttaccaaagctaacaagagacaaagccaccaaattttgagcctggtttgcaattctactttagccagtattaagtggagagccacgactcatatgaataatagacccataaagaattagaactagacattacataagaagacatcctaacaaccctcttactttagggatggagacgttaagcatcttagaagcaatcccacaagggagaagcaggctctggtgccagacgctgctcctttgggtgttcactagacttatatgaccatgagcaaaatgcagaacatctgtaagcctcagcctcctcatcagcaggatgggctgatcatcatgcatatctcatgtgggtcagaaggaatgaacaagttaacaaactaaaacactaagcctggtacagaatagaagccaaataaatgttagattccaccattactataagaggcagtgttgaaggaagaaccagaataaggggaaaaagtaaataggtttttttctgattatcttcctccaagaattggccatgagtggagtaatgagaacattattcaaaacatacagtccagaaaaatatgtagtgtaatattaaaattttgatgtaaaactgagcttcaccacatattagagagataataggcctagtggttaaaagcaaggactcttgagttagacagccggattcaaatcccatctctgccagtttctggcaatgtatccttaaacaagttgcctaacatctccattcctcatttatctcctctgtaaaaggggataatcatagtacctatttcatgaggtggttgtgaaaatgaatcaagttaatatttggaaagcatctagcacagtgtctgtagcagtgttgtaaattattagctattatcattatattacagggccatcttgcacaccatccaagatatttttgtactggaagcacccaaagaaacttgtgctactaattttacttctaatgctacccagaatcattgactctgatgatgggattatactgaggtaccagcatcagatccattgctcaaattctatccttaaaaataattagaagtagatatttttgtacactgaaatttttaaaaatgcgtaactctgacaagcactagattactcaaatataacagtgtggaaatagaattttgactcatccatatctttgaagtcagtgctagtcagcttctctcctggctctgagacaatcttgatagactgtacagcagagaggactttctatttactggaacatgatcaccatttttggttttgttactgcaaaatcatatcatttttagagcttgaagggagtgataacctaacccaatcattttgtagatgaggaaacccagtttagaaaggtaaagtagctggtcaactttacattttttacataagcagctggtgaataatgaagacagtggagggtagtattttaagaaaatttgccttccatctcttgtcatcagagagagttccaacttcacactatcaatataattaacaggatccatattttataaataagtagcttaaatagtagcaatatttcacccagttgaacttcaaattacttcagatcaaagtaatgcatctttttggatatcagactcttgcttaaaaatttatgtactttaaaattcctattacagagaacataaacagtacattgaatttgatcggccagtgaaaagttaatctcaaggggtaaatgttttacctttcagggcattggagaactaaataatgagcaatttactaaattccatcctggtcctgaaatcatctgtctatgtcatacggattagtagcttactcttactcctgaagggtcacctttataaggtagaggatcttctgaagatagtcatcacaacacaacacctatgcattcaccatgattcggatataccaaccattgctttcttttttttttaacctaaggttcagagttgagtgggttatatctcttagttcatggtatatcacgatccaatttcataaggtatatgtcatgttttattatctttattgctttccccctttctcttcctaactcccacttcccactcacatctcccctccctctgctcacatctcccctccccttaaccactgccaggcatccactctaatgtttataaacataagtgtatttaggtatagtgattgttcattttaggtatcagcttgactggattaagggatattcagacaggtagtaaagcattatttctagacatgtctgtgagggttttccgtaagagattgatatttgaatcagtggactaaggaagatctatccatgtcactttaggcacatctagataattaattctgaatggtataaagattttatatatatttatatattatatatatataatatgtagatatatagaaatctatgcaccattcatagatttctttcatctcaagtgcctgcaagatgaaacatttattatatatatgtatatatacctatgtaccattctgaattaattatctagatgtacataaagcaacatggctagatcttggagatatatatctatagacagagatgatagatagatagatagatagatagatagatagatagatagatagacagacagacagagtatgcatctgtgtgtgttgcacaattaactactcctttccaccagtgatggacacttaatttcttccaactttctgccttcccaaatagagcaccaataaatatactaatacatgttccttatagtcttgtgtcagagtggctctagggtgtacacccagcagtgggaatactgggtgtccatgtatatgacctggtttctctaaggactgccagattcctccccacaatttctgttctagctcagacttccactaacagtgcaagagagtttcccaacttcctcaccaacagttggtattatctgactttctgatgttcatctaatgagtgttagagtattattggtcctattctagttcaccagttctctgaaatgtttgagactcctcctttttgttcaggaagatttctagattctatgcatgctttgcccaggccctgggcaactagaaatgttaacttagaatcatctacgtagattcttccctcaaaaactgctctagcgtttccatttagtgtagagtcatgtggcccttataggctttcattctccattttagaagacaggggaattccaaggtctcctaaaacctttctggatgtttctacttaccctatgggaattttcatcacaatgcatggagtcagtacactagtcctgagttcttgcccttctccctccctccttctcttctttccttcctcccattttctccttcccctttgccacctaaaatttgaagttttttcaacttctcccttttgattgacaagacctatctcccgtctttatccttcccctctgtcaggtggcattcttccgtttttccctaggacaataacaaaggaaaggtgggaggttaggggcagactgaattacaagtggaaagtatactggaaaatactgtctgcatgtacttaacattcaatattatattagtttgttctcacactgctataaagaaatacctgtgactaggtaatttataaagaaaagaggtttaattggctcacagttctgtaggctataaaggaagcatagcaccttctgcttccggggagacctcaggaaacttacaatcctggtagaaagtgaggaagcaggcacatcttacatggcccaagcaagagcaagagagagagcaaaggggaggtgctgcacacttttaaacaaacagatctcatgagaactcactcactatcatgaggacagcaccaggagatggtgctaaaccattcatgaaggaccaccccatgatccaatcaccttccacatgccccatctccaacactgggattacatgtcaacatgagatttggtggggacatagattgaaatcatatcatatatgaataacactttaacctttccaaagcacgtttacgtaccatttgactctttcaaaaacctgtatagagaagttattaccatttgtagacaaaaacagaagccaagactaagaaaaatgaaagacttttgtgcaatattaagatagcccacagataacctattttagaagattttatgtgtcttttacaactttcctcacaaggatatcaggaagcctttttagaacagcaaaatctccccattttctcttttatagatttggtcatctgagcttaaaggagattctggcagaaaaatgaagactattttgtctctgctttgaagcagcaacttgaggttgctcttaagcatttacaaaaacctgagttcttattccatgactggcaatactctttaaactataattattacactaatattagcaaccaaacagttagctactcatttttcagtctacattgtgcttattaaattataccttactttgacatcgattgtggatttgattagttatgtggggcaatcattttaaacgtttaattttctggatgtagacttacacacacagtttaatcaagtaattgtgcctatttctcagtaatttaaacttcacatttttgctttcttaaaatctgaaaagtagcgtactttttctacctatttctataaccaaaaaaaaaaaaagttaaattcacttagaaaacacttttctctttcccaagtgagcattttctgctagatggtcaacaaagatcatctctgcttgaagggaggtgatttgggttagtgaaaagagacagatcttgttacgaaccctgtctctgtacaacctaccagctgtgtggcctttaggcaagctatttgatatggtttggctgtgtccccacccaaatctcgtcttaaattgtagcccccataattcccacacgttgtgggagggaccaggtgggaggtaacctcatgggggcagatctttcctatgctgttctcatgcgagtgaataagtctcatgagatctgatggttttataaagggtagttaccctacacaagctctcttgcctaccaccatgtaagacatggctttgttcctcctttaccttccaccatgattgtgaggcctccccagccatgtgaaactgagtccattaaacctctttttctttataaattacccagtcttgagtatgtctttattagcagcatgagaacgaactaatacactattttattcccaacctcagttttcactctataatatgggaataatacctatgctcaaggcctaatgtgaggaataaataaagttatgtatttacaatgcctggcatccagaaagcactaaaaatgatagttttcttttttatttttctcttagaaaaataaacagatttatgataggcattactagtagtataccagaaaatctacagtaaaaatactgcagagatagaattacttcacctttggactgaatgacagaatcaggcatttgcatgccttgttgtccaagcatgcggcttagttttgccctttgcacacaataggaatctcacatgctggataaaaatgcattactaaacaaatgtacactctacgtaagcctaaacataagtgattaatacacagcaaatgtcgttcagatgaattgtttcaatcaaataaaaatatatctggagcaaagcctcattcctctttatgctctgggtgtttcttgcctacacaaaataccttttgaagtcaaagagggtgcctcatatggatgtcttataggatgggatacctaaggagagaagaattatgagattaaatactagacctgtgtgtgttttgttttgttttaaggaattagcaggtattccatgcaaacattgtttcttacagggctgagaaccgggttttatagttaccctaaagagcaaaacccaaagactccacataagtattatgcaatgcccctttatctgcaggtggtcttcctcaatgtgaccttactttattcaaacatattaaactgttttagaattgtttttgtccataacttatataatatatcctctcagaaaaaaaaaatcctacattgagtagacaaaaaatagcatctcactttcattccaagaaaataggagtagacaaatccgggttagtaattaacaaaaataaaagcttccctcaacagctgttcacacccctgccccattctagagagcacaggcagaacaggcccaagaggaaagataaaacagcttaagctggatttaaaatagtgtgcagcaatgtttaaggctttttctctctccagccagaaagcagttggcagaaaagggaaacaaacccaacatatatagtcaagcacaaatgtgtttattgaaggtcctcagaacattccactacacccctgggaagccctactaaagcatgatgagccataaagcctatgctcagaacactactagttttcccaactgggctacatcttttcagcttctcagctctgggcaggtgggtgagcagcttactacaaatctgccttgaattacccatagatttgtaaccaaatccaggctgggctataccatagctatatgacaacatattaagttacacctaatgaacggggcttcccttttatatatgatccgagtgtttcgcaatttagatccaggagattgctgagtgtataacaaaatgtagtgagtgggcagaaaacaacggtcagaatccaaaatgaatattaggacagggtggctgaggtgactggaagatatacatcagtagaataaaggagtgatatggatgagaaagaagagatgaaaggatattgtcatagtgattatacctgaaagaaaatcttttaaataagagttttcaaatgttactttcaaggccaaaaaggatgaaaattatcccaatagctataatttatcactgccatgtgccaggtgcttttctaagacgcattacatatattaatgtactttgtccccacaacaaccctgtgaaaggaaaaccattattatcataccacttctacagacaaggaaactgaggcacagagaagtgaaggtcacacagctagtaaatagcagaaccagctaaagacgcagttagttgtgcccagagcccactttcttgaagacttcacacactgcctttcaataagcaaagctagggacctacaattcttggcttagcccatgtattaataacacatgcctgtgtctgggtctcttagttacacaaggaagcaaggaccccagggtcgcatggtggtcctccctaaactcccagcttctgaacatcaccccatcaccacacacaggaggaaacaagctctttttcaggccgaggtgggtataaggtatggtttatgaaaaggtcctatttggtcctttctgtttgacccactattaagcttccataaagcttcctagtaaaagaaaagcttccataatgagaaattccccatgagggcaaacctgtcattctctcaggccagatcgtcatggaaacttttatgaagaggagcccaacactcaggtcttcaggcagcaaaagactccatgcagttgttccattgtaaaattataccaatttattcattgcaacaagtgaggcaatggcacgagtttcttttactgatgaacagaattaaaacataatgagaggaacacagtcagaatttaattcgtccaacctcacgccactcagctagcccacgtcctgcagtcttccaacagcccaaacaatgcatttgaaaaataggaatcattggaccagaattataaaataattttgagttggaaaaaatgcattactctttaaaataatactcagacatcttagtaaaaataataatagtcttatattctaaaacagagtcagcaaactatagcacttgcaccaaatctggcttgcaactcaaagctaaacatgatttttgcatttttacatggttttaaaaaacaatcaaaggaagaatgggatattaagacatgttaaaattctatgaaatgtaatacataatgcatgtaatacatactgttttattcgaacatagacacgctcattcatttacttattgtctctggctgcttgcacgctacaaaggctcacagtctaaaatatttactatctggctctttatagaaaaagtttgtggacccctttctaaagtgataaatgataaatatattgccctgacaaatttctcactgacgaattgtggaattgtggtttttaattattagaaaatagtgaagaattttgtgacttatctcagtaattaatttctaaaaaaccaattctaaatagacattgcagcttattactcattctaacggtaagttgcaagtccttaattgttccaaggggtgtgttttctcttacactaaaatgatgtatgactgatacaaaccaggaaatttcttcaaacgcctgagtgaaacaaagcagaaaacatcccatgcacatgcatattcacttggcaggaacattttcctgcttagcttgaaaccaaaacaatgaaagctagtaaagacagagcacgtggacttctgttactgcctcttgcttattccagaatccttaatccacagaaattttttgtgtagcttttcattaagcatttcaaaaggaaaacaggggaatggacttcttttgaaaatgtatgatttgttgttctttatgaccaccctttgacagtggctaagtcgtgtatttatatttctcttttaaaaaaggaatatgtcacaggattttactgtctttctgaccttttatatttcttgtgctcaatatatacttgtaatgtcctgcagtctgcagatccactctgattctcatccatgctgttcccaaaacacatgcctctagaattcttccaaatgtggcattgtcatttacttcgaaagttgctccctaagcaaaggctggaaaaatataaaacggactcaccaattattattattcaggcaactcctaggactttataaatgtgctgtaataaattaactttgttatctccctgagttacgtagaagttttagttgtattcaaatgctaaactaagccccacattcttcatggggggtagtggcaagaaagaagtcctccactgagggcctgggaatatgtggtgcagtctcaggtcctctgtgtacgcactctataaactgtggaaaagtatggaaacattgccatagtttgaacatgtatgaacaaaatatgaattaggaccttggataatatgttctactcttatgtcaaattcacattgttcaaatatgctctaccgttttgcagaattctatggagacatctttcttgtgatcttaatcagaaaataatttatgactcatagatcccaaagactcctttagacaagtttgggaagctgtgctgaagctcaatcaacatctttaaaagctgttctaaaacatagttacgaggaaatgcaatatatttttcccaaacaaaataaaaaatttttgtctctcccattcaaccacttcaagggatatttactttagtccagaaatatattagttaatttttataagcagtttttaaaagaaataggcctgtaagaaaatttatttagccaacaaaaatttttcctggttctacttgaggtactaatgccactgtttgcctttgctagtcgttaccagctctatctgagtcaaagaagagaaatatctctctaccacaaatcccaaaaggaataaaaagtggggagaggcagaacatatttaattaggcctaggcctgttgcctgattttcattaggcccctgcctgactctgatttggcccactataagtccttttaggccactgggcatgaaggccagtgcttattttcatggctgtttcaattcatcaagaaaatcctttgaaagatgaaagacactccacattttttcacctgttgttctttcttatgtgcctgtcacttcactcgccaaactcgcttcaagccaaaccaaatgctttccaaacctctacagtatgcctttgaagatcttaagttaagtattttcttatgctgaccagtatagcttccaaataaggaataaaaaaataacgtagttcttaagttattttttttaaaaataccagaaatgtaaaaacacattccagtaagtggataaaagcaaaattccacttccccaagtttagaagtcttgagccaaatacacctgatgttcattaccacacccacagcacattgctaatgtatgacaaagttccagcaaagaccatatgctgtttttattattgccacttcacaagttttcccaggctcactagaaaaagtattctacaagaccagcccactgagtgggctcatcttactacactgatgaaatttagtctgttatttacctgattagcaataaatatctctctttattgccaacaacacagcaattagggccctaatctgtcaccactaccttcaagttttggctttcatcaaaagaaaaggaatttgccaagaaggaaaagcacagctctaccttcaagctaaaaatagttctgtcttctagacaatatacactttcacacggctccagcaaaccttgcttcaagcagcctacaaaggatatatcaggagaagtacacaatagtccctagttttaggtactggtttagccaaaagatgcaaacaggcaaaagctgatacagaaaagccaacccgggtgatataagaggaaatgaaatctctaatccattgatactttttgaggggatcaaaaatagataaaacaaaaccactgcacatatagtcaatgtatctaaatttccagaaactttttataagcctgtctaccaaaggctttattaaaaagttgttatgaaggttacattacatatttattcttaggcagaaaaccaactaaaaaacaaagaacaaagtagaggcaattccctaggtggatcctatttagcatcgccatagactatctaaaagatgacagtgatgattgccattaccattataattacttattataattatttcatgtcctatatgctataccaagcactttatgtacataatcattaggtaggtaatattatctttattttacagaagaatctgaggttctgagatgttaggtaacttgtccaaagacacactgttagcaagtgatgccaaactgagggtaatcaattaaactaattcaccagtaaattcatttttctgaagttttcacaatgacgaagtcatttatttatttatttatgagacagggtctcactctgtcatccaggctggagtgcattggcacaatcacggctcattgcagcctcgacctcccaggctcaagcaatcctcccacctcagcatccctagtagctgggacaacaggtgcataccaccatgcctggcaattttttttttttttttttttttgtagaaatgatgtctccctgtattgcccaagctggtcacaaactcctggactcaagcaatcctctctcctcagcctcccaaagtgcttggattacaggagtaagccaccatacctggctgacagagtcatttagatatctgttaatgtttttttttaatcacatgaatttatttatataaggcctagcaaataagaaagaagtaatggttcccttacctcaaggggactagaaatttgtcagggatcagttcaattctttctcactcttgatgtgtatcaaatgtgagaaaagttaattcattcaatggatatctagtataagtacctactatggaccaggcagtatatgtatatcctaaacttgattgtggaaaagaaattaaatgatttgtccatatctaccagaatgctccatctgcagctcaagtttgcccagttctcatcagcctatgggaacaaataaggtcgcattaatcagctaacccagatttcatggctttccgtgggatgcagccatcaatcaagtactgtccaagtagctctggtaaatccctgggtgcatctcacctgtgataatgaacaagacttgtcagataccatgtggcttccaattcctcttgcccttttccaaccctctccatggacattgttggaactggaagataagccctttctctttagattgtattacattctgttagagagatctccaagtaatcttactggtacttccagtgtccaacagtttgagcaaaataactcatttagtattcatttatagctttaccctcaactctctgaaagactgagacacgatctaaagggaggccagaaatggagacaaacctgagtcatagacaccacaccattctcagaatagcctccctcctctgattaacaaggcttgttactggatctagctgtcacccctaacttcctcaccccttataataattatctcccaggatgatcttaaatccttttacaaacagacttctgacaggctctgcccaccagtaattataacatgttcagaacatggctgaacatcagtgggagccactgtgtaggtttattgccatgttcaaacacccactccccaacacatacaccctttactaagaaacaaacactttgagggtgaaagggggtgctaaagatgaaattaaattatccttgcattctgatatggcttatttgggagctttgatgggcagtcaggatagagcatactttctgggtagatagaccaccaagagacaatgatcagggtcaatacaagaacagcctgtgtagaattacaaggataaattaagttcaggcagattggctctaaatggagttttagtggatgaacaggaattatccacaaaaagcacaaagcattacagatctattttcatggccactaacagagtataactttagggagtgtaagtccaacttcctcatatctgaaaacaacagtcttctgacacagacagttggtgcctcacccatattccctgacccactcctatagcattggttgcctattgctttggcagacagtccacttcacaaaccaatgagttcctacctcaaccatttgtgtctctttgactctggacttcctctgcctgaagagcatgtgctgcccatatccaggtaggccataaatagtggggagttaattcctccagacacaaacttcaacccataaaagatggaaaatggtaaataaatgccctagcttccttaccccttgtagcaactacagtttcttagagggtctccagcaggattgagtcccaggtacccatggtggtaaccactcctgaatgcactctctgttgagttttcacatgtctccagcccataatcctactccttcatggtgcttccagggaccccttcaaaaataaactacttgcccccaaatccttgtttcagggtctgattcagagagaatccaaactaagacatttttttttctataagaattctctcaaatatgaattaacccactgtgcttctccacaataaaacaaagagttttaaagaaaggaaaactaatttcagaagcttgagaaccttacctgtacccaacttcatcatctaaaaagtgacttaagttcaaggctaaaagaaacacaaaagcttccaggcaggttcccattgcagagaagaaagcttgagtttctcagggcaggtaaagggagagaaagaggaacctcttcttctcaattttatcctcactttgaatgcaatgcaaacaaaagacacaaaataaaggtcacctctgagaagagcattacaaacaaatctgagaacataattcgacttttcaaaatcaaactatagggcagggccaagatggccaactagaagcagtggcgatccaagtttcccatcaaaaagaaccaaaacagcatctgaatcctgtatagcaactgaggtatccaggttctgtcatcaggactgactaggcagctggcgtgacccacagagaggaaggaagagcagtgtggtgcagcagcccaccttagagccacatggggaagggcaacccccatccccagccaaagaaggcggtgagtgagtatgctacccagcctgggaaaccatgctttttccatggaaccgtgcaacccacacattggaagatcacactcgtaagcccatcaccagggccttggatcccaatcatggagtcatgcagattctcaacacccacttggctggaatctggctaagcctggcgagttcctggagggaggggcagccatcaccacagctgcaggggcctgttgtctaggccacctgagctccttgggggaagcgtggcagccatcactgcagctgctagccacctaacacactaagctccagagggggtaagggcagcacccatcactatagctccaggctgtgttttcccctgctggagccagggaggctggatagcttggtcccaagaggtattaccccaagcccagcacatcagctgtggcaaaccacagccagactgcttcttcagtatagaccctgacccatccctcctgactgggtggggccaccctacaggaactccagccaggggctcaggggtagaactctgatctccctgggcctgagcccctatggggagggtggccataatctccatggaccaacagacttagtctttcctcctactagctctgaagaatctgggcgtccagatgcatgggtttccccccagagcagcacaccccctccaccaaaggatagccaaagtacttcattaaatgggtcctgtttcccatgccaagtgggtgagaccccccaaaagaggttgtcagatgccctatacagaagcattcctactggcatcaggtgggtgccactcaaggtcagagatcccagaggaaacagcagacatccatctttgctgttctccaatctcctcaagtgacgtttctaggcatgggagcatattaatagggcctgaagtgaacccccagcaaaccacagtagccctacagaagagggacctgactatagaaagaaaaacaaaaaagcagaaagcaacacaacagcatcaacaaaaaaagtccccacaaaaacctcatccaggccgggcgcggtggctcacgcctgtaatcccagcactttgggaggccgaggcgggcggatcatgaggtcaggagattgagaccatcctggctaacacagtgaaaccccgtctctactaaaaaatacaaaaaattagccaggcgtggtggcgggcacctgtagtcccagctacgtgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaacacctcatccaagggtcagcagcctcaaagattgaaactagaaaaactcatgatgatgagaaagaatttaaaaaaaaaaaaaccaccactgaaaaacccaaaggccagagtgactcttctcctccaaatgatcgtgacacctttacagtaagggcaaagaactggacagaggatgagatggacaaattgacagaagtaggctacagaaggtgggaaataacaaacttcactgagctaaaggagcttgttctaagccaatgcaaagaagctaagaatgatgataaaaggttacaggagctactaactagaaaaaccagtttagaaaggaacataaatgacttaatggaactaaaaaacacagcatgagaacttcatgaagcacacacaagatagctgaatcaatcaaggagaagacagaatatcagagattgaagattatcttgctaaaataaggcaggcagacaagattagagaaaaaagaatgaaaaggaatgaacaaaacctccgagaactatgggactatgtaaaaagactgaacctatgactgagtggagtacctgaaagagatggggagaatggaagcaagttggaaaacacacttaagaatattatccaggagaacttctccaacatagcaagacaggccaacattcaaatttaggaaatatagagaaccctactaagatactctatgagatgatcaaccctaagacacataatcatcagattctccaagttgaggtgaaggaaaaaatgttaagagcagctagagaaaaaggtcaggttacctaccaagggaagcccatcagactaacagcagatctctcagcagaaaccctacaagctagaagagatttggggccaatatacaagattcttaaagaaaagaattttcaacccagaatatcatatccagcaaaactaagcttcataagtgaaggagaaataaaatccttttcagacaagcaaatgctgagggaattcgtcaccaccaggcctgccttgcaagggcccctgaaggaagcactaaatatggaaaggaaaactggtactaaccactgcaaaaacacaccaaaatataaaggccaatgacactatgaagaaactgcatcaactagtgtgcaaaataaccagctagcattatgatgacaggatcaaattcataagtaacaatattaactttaaatctaaatgggctaaatgccccaattaaaagacacagaatggcaaattggataaggagtcaagacccatcggtgtgctgtattcaagagacccataacccatacaaagacacaaataggctcaaaataaagggatggaggaatatttactaagcaaatggaaagcaaaagaaagcaggggttgcaatcctagtttctgacaaaacagactttaaaccaacaaatatcaaaaaagacaaaagtggccaggcacggtggcacaagcctgtaatcccaacactttgggaggctgaggcaggtggatcacaaggtcaggagatcgagaccatcctggctaacacggtgaaaccccatctctattaaaaacacaaaaaaattagccaggcgtggtggcaggagcctgtagtcccagctactcggcaggctgaggcaggagaatggcatgaacccggggggcaaagcttgcagtgagctgagattgcaccactgcactccagcctgggtgacagagtgagactccatctcaaaaaaaaaaaaaaaaaaaaaaaaaaaaaaaaaaaaaaaagacaaaagcattaaataatagtaaagggatcaattcaacaagaggagctaactatcctaagtatatatgcacccaatacaggagcatccagattaataaaacaagttcatagatacctacaaagagacttagactcccacacaataatagtgggagactttaacaccccactgtcaatattagacaaatcaatgaggcagaaaattaacaagaatattcagaaattgaactcaactctggatcaagtggccctaataaatatctacagaactctccccctccaaacaaaagactatacattcttctcagtgccacatggcacttactctaaaatcgaccacataattggaagtaaaacacccctcagcaaatgaaaaaaggaaggaaatcataacaaacagtctctcagaccacagtgcaatccaattagaactcaagattaagaaattccctcaaaaccacacaactacatggaaattgaacaacctgctcctgaatgactcctgtgtaaataatgaaatttaggcagaaatcaagaatttctttgaaaccaaaaagaacaaagagacaacaaaccagaatctctgggatacagctaaagcagtgataagagggaaatttaggccaggcacggtggctcatgcctataattccagcactttgggaggctgaggtgggtggatcaggaagtcaggagttcgagaccagcctggccaagatggtgaaaccctgtctctactaaaaaataccatctcacaccagttagaatggcaatcattaaaaagtcaggaaacaacaggtgctggagaggatgtggagaaacaggaaaacttttacactgttggtgggactgtaaactagttcaaccattgtggaagtcagtgtggcgattcctcagggatgtagaactagaaataccatttgacccagccatcccattactgggtatatactcaaaggactataaaacttgctgctataaagacacatgcacacatatgtttattgtggcattattcacaatagctaagacttggaaccaacccaaatgtccaacaatgatagactggattaagaaaatgtggcacatatacaccatggaatactatgcagccataaaaaatgatgagttcacgtcctttgtagggacatggatgaaattggaaatcatcattctcagtaaactatcgcaagaacaaaaaaccaaacactgcatattctcactcataggtgggaattgaacaatgagataacatggacacaggaaggggaatatcacactctggggactgttgtggggtggggggaggggggagggatagcattgggagatatacctaatgctagatgacgagttagtgggtgcagcgcaccagcacggcacatgtatacatatgtaactaacctgcacaatgtgcacatgtaccctaaaacttaaagtataataaaaaaaaaaaaatatatatatatatatagtgccttaaaaaaagaaaacaaaaatacaaaaattagctgggcatgatggcacgtgtctgtaatcctaaccactcaggaggctgaggcaggagaatcccttgaacctgggagacagaggttgcagtgagctgagattgtgccactgcattcgagcctgggtgacagagtgagactctgtctcaaaaaaaaaaaaaaagaggcaaatttatagcactaaatgcccacatcagaaagctagaaagatgacaaattgacaccctgacatcacaattaaaagaactagagaagcaagagcaaacaaatccaaaaggtagcagaagacaagagataactaagatcagagcagaactgaaggagatagagacacaaaaaatgcttcaaaaaatcaataaatccaggagctggtttcttgaaaaaattaataggccactcactagactaatagagaagagaagaatcaaatagacacaataaaatctgatatatgggatatcaccattgaccccagagaaatacaaactaccatcagagaataccataaacacctctatgcaaataaactagaaaatctagaagaaatggataaattcctggacacatacaccctcccaagactaaaccaggaagaagtcaaagccctgagtagaccactaacaagttctgaaattgaggcagtaataacctaccaaccaaaaaaagcccatgaccagatggattcacagctgaattctaccagagatacaaagaagagctggtaccatttcttctgaaactattccaaacaattgaaaaggagcgactcttttatgagtcactcattttatgaggccagcatcatcctgataccaaaagctggcagagacacaacaacaaaaaagaaaacttcaggccaatatccctgataaacatcgatgctaaaatcctcaataaaataccagcaaactgaatatggcagtgcatcaaaaagtttatccaccaagatcaactcagcttcatccctgggatgcaaggctggttcaacatatgcaattcagtaaacgtaatccaccacataaacagaaccaatgacaaaaaccacatgattatctcaatataagcagaaaaggccttcaataaaatttaacatccgttcaggttaaaaactctcaataaactaggtattaatgggacatatctcaaaataataagacaaacaaatatttatgagaaacccacagccaatatcatatggaatgcgaaaaagctggaagcattccctttgaaaaccagcacaagacaaggatgccctctctcaccactcctattcaatgtagtattgaaagttctgtccagggcaatcaggcaagagaaagaaataaagcatattcaaatcagaagagaggaagtcaaactgtctctgtttgcagacaagatgatcctatgtttagaaaaccccatcatctcaactcaaaagctccttaagctgataagcagcatcggcaaagtctcaggatacaaaatcaatgtgcaaaagacacaatcatttctacacaccaacaatagacaagcagagagccaaatcatgtatgaactcccattcacaattgctacaaagaataaaatacctaggaattcagctaacaaggaacatgaaggacctcttcaagaactacaaaccattgctcaaggaaataagagaggacacaaacaaatggaaaagcaatccatgctcttggataggaagaatcgatatcatgaaaatggccctactgcccaaggtaatttatagattcaatgctattcccatcaaactccattgacattcttcagagtattagaaaaaattacttaaaattcatatgaaaccaaaaaagagcccatatagccaagaaaatcctaagcaaaaagaataaagctggaggcatcacattacctgacttcaaactatactacaaggctccagtaaccaaaacagcatgggactgataccaaaacagacatatagatcaatggaacagaatagagtcctcagaaataaggccacacacctacaattatctggtctttgacaaacctgacaaaaacaagcaatggggaaaagattccctatttaataaatggtgctaggaaaactagctagctatatgcagaaaactgaagctggaccccttccttacactttatacaaaaattacctcaagatgaattaaagacttaaatgtaaaacctaaacccataaaaaccctacaagaaaacctaggcaatatcattcaggacataggtttaggcaaagacttcatgacaaaaactccaaaagcaattgcaacgaaagctaaaattgacaaacaggatctaattaaactaaagggcttctgcacagcaaaataaactatcatcagagtgaacaggcaacctacagaatggaagaaaatttttgcaatctacccatctgacaaggggctaatatcgagaatttacaaggaacttaaacaaatttacaagaaataaaaaaacaacctcatcaaaaagtgggcaaatgacatgaacagacacttctcagaaaaagacataaatgcagccaacaaatatgtgaaaaaaagctcaacatcactgatcattagaaaaatgcaaatcaaaactacaatgagataccatcacatgccagtcagaatggcaattactaaaaagtcaagaaacaacagatgctgtcaaggctgtggagaaataggaatgcttttaccctgttggtgggaatgtaaattagttcaaccattgtggaagacagtgtggtgattcctcaaggatctagacccagaaataccatttgacccattactaagtatatacccaaaggaatataaatcattatcttataaagatacatgcacacatacgtttattgtggcactattcacaatagcaaagacatggaaccaacccaaatgcctatcaatgatagactaaataaagaaaatgtggtacatatacacaatggaatactgtgcagccataaaaaggaatgtgatcatgtcctttgcagagaaatgggtgaagctgacagccatcatcctcagcaaactaacacagaaacagaaaaccaaacaccacatattctcactcataagtgggagttgaacaatgagaacatatggacacagggagggtaacagcacacaccaggacctgtcagcctggggcaaggggagggagaccatcaggacaaatagctaatgcatgcagggctcaaaacctaggtaatgggttgttagatgcagcaaaccaccatggcacatgtatacctatgtaacaaacctgcacgttctgcacatgtactctggaacttaaagtaaaaattaaaaaaaaaaaaaactatagcagtgtttcactcattgaatgtagtaactacacctttttaaaaagtcatttttgcagaccctgctacctgtcagcccatcatatgtcctgctccttgctccagccactaccaatctgaggttctcaccatggacattcccattcctagggagagatgcagatccctagccagcttctgaaggaggcaaggacctaattgtccagctgatccaggaagaggacaggagtgagcaggcagcttgggcagccccttaccttagaggagtttgggggaatgaggcacagggctgggagtgggactcaggtttttggcctatccggggaagacctaagttttatgatgcctgaagtttgtacaatttggtagactttaagaaaaataatagttctgtaaatagaagtcctacatggatctcaccgggctaaaatcaagaggccacaagatggctaactagagacatgagacacctgccctcttcagaaagaataaaaactgtgaatagacaatcatacctcaaacaggacatctaagagagaacactagaatccaacatagagctcaaaaaaaatacctgaggcacagaaggggaaggaagcaagcagctggctcaaccaagatcaaccaatagcaaggggattggtattgtggggaaaaggtaagtgagaaagcttcagttgtccacatccttgccacagactattgttatctgaaccacaggagagtttctctacccacacgaaccctgacactagcatgagcagtgatctggagacccctgcaagagcattgcacccgacagggaactcacactgtgtcattcaaaccctgctgagacatgatcagctatggcagggacccatttggggagtagctatcatggaacagcatcttgctctgggaaaacagcccctatctctccacatcctgggagctcccaccgacattccccaggatccactcagaaggctgccgcagcacagcactggctagacccaaagttactacaaggtctctagtactctagttcacaagaagtactgttccccagggaaaaagacagtgtcatgtagcaaaaggcagcccctgggacaaaggaaaccagagaatgcactttgcagagcctgagaactccctaccttgggctgtgtgaagagaccctgcccctagcagtggcacaaactctgtgctcagctttgcaggcaaggagtgacatcctttttaccagtggagcagcctctgggctcaggctcttgcacagaggacatgaatgctcctctccctccacacacccattcctactgctgctggaggcttggccaaggcagagctggaaggttacctgtctaggatggtgagtggtgactctgaccccaaccccccatggcagcttggctctcatgcctgggcttgtgcatgaaggcagggtccttccctccctctgcgtggcgctacacaactgctgcaacaaagagaagaagagcttgagagtggcatgtctggggatgttgggagcagccctgcactgcagccagcaccaacatcagcttgcactgctcaggacacagagggtcagcccaccactaccaccatgatagcccataccaccctggtttcccagggacccaagaatctgttaacccacccagcccaccactgccactactggcttccaagcaagccacctgaaggcccaccataggcccactgcgaactgccaacacaggtgccagcatacaccaccctgggcaaaaagacaggcatcttcagcctactactaccattactgaagcctaaagcctagcccacatggcttaccagtctccagcacaacttcatcaaagcctccactaataaatgcaccctaactctccatgtaaatgcaagaaagcactaacactgttgatagtcaaggaaatcatacagagaatacagtattgcacatacccagaatcaaagccgatgcgccttgccttaccaacaccacagattcatcttcaggaaaaagtcttccgctatgaaagcaaatagaaaaacagaagtgactgttacagcagatgtgcaaatatcaatgtaaggatacaggacacatgaaaaagcaaggaaatatgatacctgaaagggaacataataattgtccagaaattgatctcaattaaaaataaaacttcaaaattctagataaagaattcaaaatattaattttcaagaagtcagtgaaacgaaagagaattttgaaaaacaatgcaaagaaatcaggaaaacaattcaggattaaatgagaaaattatcaaaaagataggtatcgactttttttaaacagaactaaatagaaattcaagaagaaatataaaatacatttgaaagcttaaacaacagactagattatgcagaagaaagaatcttagaacttgagcacaggttttttttaaataacccagtcggacaaaaataaagaaacaaatattttaaaaatgagcaaggcctttatgacatttggtacaacataaagtgatgaaatatatgaattatgagtgtcccaagaataagtaggaacaatgaaaggattacaaaatatatttaccaaaagaatagatgaaaactttccaagtctagcaagaaatttagatattcagataaaggaggctaaatgatctcaaggaagatataatgcaacaaggccttctccaaagcacattataatcagactgtccaaataaaaagcaaatcttaaaacaggaagagaaaacacctagacagctataagggaatccctatgagactaacagcaaatttctcagcagaaacctcacagaccagaagagaatgggatagtatattcaaagtgctgaaagaaaagaaaaactggcagccaagaatactatatccaccaagtaatccttcataagtgaaggagaaatacaattttttaattgtttgatagagttttattacattatcagtaatactataaaatgtacatttgatacaaattaatgttcaatatctgtaagtttttggtgcattttattatagagtgacacctatttactttgggtaatttaaattattcatgcagggttgggattctggttattctgttcatgaataaggatataaaatgtggtatattagaaatattatattttcaaggactttttttctatttaaaaaatttctttttttttaattttactttaagttctagggtacacgtacacaacatgcagatttgttatatatgtatacatgtgccttgttggtgtgctgcacccattaactcatcatttacattagatacatctcctaatgctatccctccccccttcccccaccccacaacaggccccggtgtgtgacattccccttcctgtgtccaagtgttctcattgttcaattcccaattatgagtgagaagatgcggtgtttggttttttgtccttgcgatagtttgctgcgaatgatggtttccagcttcatccatgtccctgcaaaggacatgaactcatcattttttatggctgcatagtattccgtggtgtatatgtgccacattttcttaatccagtctatcattgatagacatttgggttggttccaagtctttgctattgtgaatagtgccgcaataaacatacgtgtgcatgtgtctttatagcagcatgatttataatcctttgggtatatacccagtaatgggatggctggatcaaatggtatttctattcctagatcctttatttatcagacaagcaaatgctgaggaaattgattatcactaaactgtttctatgagaaatgctcaagggaatcctaaacctggaagtgaaaggatgacatttaccatcatgaaaacacacaaaattataaaactcactagtaaagcagtcacacaaagaagggaaagagaaaggactcaaacggtatcactatagaaattcaccagaccacgatgacaaacaataagagaaaaacaaaagagcaaagaatatataaaacaaccagaaaacagctaacaacatgacaggaagaaagctgcacatatcaacaataaccttgaacataagcagattaaattatccacataaaagacatagaatagctgaatagacttttttaaatgatgcaaccatattctgcttaccagcatatatgcctatcagcatagatactgaaaagcccaccttaccagtaaagacacatatagactgagaaagtaaaggaatgggaaaagatgttccatgcaaacaaaaaccaaaagcaagcagggatatctggacttatatcaagcaaggctgactttaagtcaagaacaagagaaaacaaaaagaagggaattacatgaagataaaaggatcaatgcagcaagaatatataacaattctaaatatatatgtgctcaacactggagaactagtttcataaaacaaatattactagatctatatacagatatagactgcaatataatagtgagggacttcaacaccccattttcagcattaggcagattacctagacagaaaatcaacaaaaaaatttaatttaaactagactttagaacaaatgaacctaacagacattttcagagcattctatccaacagctgcagaatacacattcttctcatcagcacatggaactttaccaaaatagaccatatgttaggccacaaaacaagtctcaacatatttttaaaaatcaaactcatatcaagtatcttcccaggtcacaatggagtaaaactagaaattaacccccagaggaactttggaaactatataaatacacggaaattaaacaacatgcttctgaataacctctgggtcaaagaataaattaagatgcaaattttaaaaaattcttgaaacaaatgaaaatacaaatacaacatactgaaacctgcggaatacagcaaaagcagtgctaaaaggaaagtttatagtaataaatgcctacatcaaaaaagtagaaagatgacaaattaacaatctaacaagacacctcaagaaactagaaaagtaaaaacaaaccaagctcaaaataactaagaccagggaagaactaaatgaaatagagacttgaaaaaaaggatcaatgaaatgaaaagttggcccttcaaaaagataaaaacaattgataaaccactagctagattaatcaagaaaaggagaaagaagacccaaataaacaaaataagacacaaaaaaggggcagtacaattgatatgacagaaattttaaaaaatcatcacggactatgataaacaactatacactgacaaactgaaaaacctagaaaaaaaaaagaataaattcctggaaacatacaatctaccaagattgaatcaggaagacatgtaaaacctaaacagaccaataatgagtattattattgaatcagtaacaaaaaaggcttccaatagagaaaatcccaagacaggatggatccacagccaaattcacccaaatgtgcaaagaagaactaatatcaaccctcatgaatctattccagaaaagccaaagaggagagaattctccctaattcattctatgaggctagcatcacactaataccaaaaacagataaggagaaaaaagaaaaaaagaaaagaaaagagaaagagagaaagaaagaaagaaagaaagaaagaaagaaagaaagaaagaaagagagagagaggaaggaaggaaggaaggaaggaaggaaagaaagaaagaaagaaagaaagaaagagaaagaaagaaagaaagaaagaaagaaagaaagaaagaaagaaagaaagaaagaaagaaagaaagaaagaaaggcagacaaaaaagagggaggctggaaggaggaagaaggaaggaaagaaggaaggaagaaagagatgggaaggaggaagaaggaaggaaagaaggaaggaaggaagggagggaaggagggaggagacaaggatgtccactttcattattcttatttatgatagtattggaagccatagccagagcaatcaggcaagataaatgaataaaaggcatccaaattagaaaataggaaatcaaattatccctctgtgctgatgatacgatctgatacctagaaaaaccttaagactccaccaaaaagctcagatttggtaaatgaattcattaagttgcagtatacaagattaatgtacaaaaatcagtagcatttctatacaccaataatgatctagctgagaagaaaatcgacaaggcaattccatttacaatagctacaaaaaaaatacctagtaataaatttaaccaaggaggtgagcaatctctgcaaggaaaactacaaaacaatgatgaaagaaatttaagaccagacacagtggctcatgcctgtaatctcagcacttttagaggcagaggaaggaggatcacttgagcctaggagttcaagactatcctgggcaacatagcaagaccctgtctctacaaaaacaattcttaattagctgagcatggtggcatacaagctacttgggaggcttgggcagaaggactgcctaaacccaggaggtcaaagctgcagtcagcagtgattgtgccactgcaatccagcctgggtgtcaaatcaggagttaaaaaaagaaaaacaaaagaaaaaaaaagaaatcaaagaggacaccaaaaaacaaaacaaaacaaaaaatcccatgttcatgaattgaaggaattaatattatttaaaatgaccatattgcccaaagcaatctacagattcagtgcaatccctatcaaaataccaatgccattcttcacagaattagaatgtgactagactcctaagattcatgtggaacaaaaggaaaaaaaaaatgctgaatagccaaagcaatcctaagcaaaaagaataaatttgaaggcatcacattacctgacttcaaaatatactataaggctatggtaactaaaacagcctggtattggtataaaattagacatatggaccaatggagcagaataaagaactcagaaataaacccacatatgttcaaacaactgatctttgacaaagctgacaagaaattacactggggaaaggaaatcttgttcaataaatggtgctgagaaagttcgatagccacattcagaagaataaaactggaccgctatatctctcactatatacaaaaaacaactcaaaatggattaaaggcttaaacataagaccccaaactataaaactgctagcagaaaaacctaggggaaaactctcctggacattgatctaggcaaaaaaatcatgactaagaccttaaaagcacaggcaacaaaaacaaaaatgacaaatggggcttaattaaactaaaatgcttctgcacagcaaaagaaataatcaacagagtgaacagacaacctgttgaatgagagaaaatatttgcaaactatttatcagacaggtgactaatacccaaaatatacaaggaactcaaaacagcaggaaaaaacaatcccattaaaaagtgggcaaaggacatgaatagacatctctcaaaagaagacatatggccaacaggtatattaaaaaatgctcaacatcagtaatcattagggaaatgtaagtcaacaccacaagaagacatcatcctactccagtcagaatgtctattactaaaaagacaaaaaataacagatgttggtgaggatgcagagaaaagggaactcttatacacagttggtgggaatgtaaactagtccagccactatgaaaaacagtatggagagttctcaaaatactgaaaatagaattaccactacatccaacaatcccactactagttatctactcaaaggaaaagggtatcaaagggtacctgcactcacgagtttattatagcactattcataatagaaaggcatggaatcaatttaaatgtccctcagtggatgaatgaataaagaaaatgtggtatttatacaccatggagtactattcagtcataaaaaaatgaaatcatgtcgtttgcagtaacaagaatggaactgatggtaattatcttaaatgaaatagataaatatcacatatatttatacacataaatacttatccaaaaagctaaatatcacatgttcttgcttatatgtaggatctaaaaaatttgataacatggggatagagagtggaaaaatagataacagatgctaggaagagtgattcggggtaaaggggaaggatgaagagaagtgggttaaagggtacagggtacaaatatagagtaagattgtaggaataaaagcaatgtttgatagctgagtagggtgattctacttaataaaaatgttttctacttgggtgatgaacaccctaaataccctgacttgatcagtatgcattatatatatgtaacaaaatttcacatataccccataaaggtgtacaaataaaaataataaaattttaaaactcataattattcaacattgaatgtttgtgagacaaggattcccgagccagggatgtgggaaaatgggggaaaagaaaggaaatgtactacaaaagtcaaagatgaataatttacaatcctggcttccaataagtcagaggctgtagaggaaaaagtaatcataacaaataattaatttaatgaagtgttgttactgagtgctagtgccatggagaaggaagcaacaccaactttcagcaaatatttattgaatgaatgaactaactctattaatggaaggtatatttgtggtgaattttttacagattagcaggtcttcgcctgaagaaaggatgaaggaacatttcgggtaaaaggaataacatacaactagaaaagatccagagtatatgatcagtctagaaaatcaacgattctcaaattgggtagtacattggagttaccttggaaatgtaaaaaaaaaaaaaaaaagtgtggcctggatcacaccccccaaaattttgacttaattggtatggggagaggcctgagtacttgtgtattttatacttccccaggtgcttttaatatgcagcaaagtttaggaaccactagtggaccatcctgcaaatttccttaattctggtttgttgactttcctgccacaatactcattaaatctttaagtaagtcacaaaattagagcatgacaagttccaacaaattcactggggctctttttgtcctgtgttgtctattatctcctctacagacattagatgactctaaattagccccatgatgatgatgggcagccataaaatttgaacaaaaggggtgattgggtcttctcagtcgagtcccataacccatcatgtgcccatactctactagaggatcttacagtggcataaaggtatggattctacccttctctcattccagtccatcccctcagctcccatatttctgaggcttttattgtaacaaggtattatacattgtatggagggatatccttcccgtttgccatagagtgtattaaacagttcccctggagaccaaacaagttaaaaaaaaaaaacacagaatagaaagaactaggttgttgtcaaatagtacagaaattattagttgcactgtccacatagagatcagaatacttctctccacacgatttctcctttgtgcctttatggagagattaaggagggttgatggtttacacctgctgggtttatgtctggtggcaggaaagactcacagaaaaagatttcttcctaagggagacttagacagggttctttctgtttttaacacgtaccattcatttaacttaaggacatagtctttctttttatgtcactatgacattccaacacaggacaaaggggaaagagcattattccatgtgacatttgaaaacctaacctttatcagctgctcctgaaggccatttctcccacatctgggagttaactgtacaaggtcaggagccctggcacactgttggagcatgcagcaaaatcaggagctgggactgcctttctggcatcctcattatggtttttttcctttcattcattcatcccatttctgagtacctacagcaatgtttccaaatctgcctgatgataaaatctccaaagatcttgttaaaaaaaaaaaaaaaacaggtttccagttcccaccacagtcttccatgttgaaagacaaattgaggccaggagcggtagctcacacctgtaatcccactttgggaggccaaagtgagaggactgctggagcccagaagttgaagaccagcctgagcaacatagggagatcccgtctctacaaatatatttttttaatagccaggtgtgtggcccatgcttgtggtccctgttacttgggagactgaggtaggaggattgcctgagcctgggaggttgaggctgcagtgagctgtgattgcatcactgcactccagcctgggtgacagagtgagaccctgtctcaaaaaaaaaaaaaaaaaaaaagataaactgaggcacattaaaatattacaatttatttgagcatttagtgattcctgaattgggcagctccagaccacaagcagttaaagggctccaccaaaggggcaggaggagaaagctttttagggtgaatgcatgaagcaaggcaaataaaatattttttttattatactttaagttttagggtacgtgtgcacaatgtgcaggttagttacatatgtatacatgtgccatgctggtgcgctgcacccactaactcatcatctagcattaggtatatctcccaatgctatccctcccccctccccacaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttttattggttaaagtggatcagtagccttatttggatgattccagtagaaagtcccactagaggtcagttggcagtttctgattggttgttttcctgttaacactgagttgggtttcagtttgtttagtagaaacccagagcaatggagccaccccagtgtaatggcctccgcatgaattattttaacaccctgaatcagaatctccagggggaagtccatgggaatctgcatttttaacaagcacctacattatttttactatatacatagtttgaaatggttggtcactacccttggtgaactccatgaatcactgttctgtgaatctagttcaaaaaggtcctttctagttgtagtcccagatgaaatgatgttttctctatcagtatttttcagatctccatgttcatgttccctgttatgtcaagcccacccacaattccttaaaaagtcagttagcaacaatgcatatttatccatttaagtcatcacctttctttcttgtattgtaatgctgacagtccaacatcccattaaatgtgagtaccagcataggtttttccagtgtaacattattttctaacaaaataaaactttcaacaccagttatgtgggtgaggttagctggagtcctgtggagcgagatggaattctgacaaaggtcctgaagttcttacaattttgaaaacctctttctctacattaactggccataacttccaggaaattcaggtggagctcctgttttgcagacccacagtcctcctagtcatgctttatgtatctactcctaggcatggaaatttagagtgcaaataatttgtgtcaattgtgttgggtggcaacagatagtgactttactcagcaaggagacatttcaacatatctgtctcttaaaggctgccagctgtgggaaacaatcaagggctagcatcacacaggcaggaaggtgaaccagggaatgtgctaggagagaatagaatgcatatccagtgtctgctttcctctcataaactgtggtttcggcaagtgcaagtattgtaatttgctgtctttttttttctcccaaaggccattttgtcttatctgatgttgaaacacttccacatagctgtgaacaccaaaacataaaaaaaagagaaatcacttggaaatttgttcgttgtctcttgctatgcttgacatttccacactgataaggtacagttaaatattgactttttggttaagttcagattaggtgtcttgtccatgagcattgattgcaaaccattatccttcttcttcttcagggcactaagttgtcttacaaaaatagaaaggacaaaagaagaaaaaattgttagctgaaatattgtcattaattacctgaaggtctttcccaagctgtgataaaaattgtcattgacttttgagatatgggggtattttgttgaagacagtgttggtaaatgttagaacatattaaaaattggattttatatttgtagattatttacatatatcttcaagttcatctaacaaagaaaatgccaccctattatcaataagtgcacaaactaggtaactggcagacttttattatttaccagttaaacatttatcagtgccatactaaaatcaatcgatgaagattgatgcactcaatttagccagagaacatccaatatcgcagattaagcttcctcttaccattctgctagaaatagaacaattaagagaacctacaacacagattatttcacctcactaaacccctcatgagtttctgcattgtctcccaatggagactgtaaattcctgaaagcaggatgatctctgattgatttcccaagaggcatcattttttgtcttctgtcattccttatcactccaccaacttagataattaaatcctatttggaatgcttttcaagtcaaatgctcagtcaaatcaacagatcctgcagggctgtggagaaacaaggtatggtctctgttcccaaggagtttataatttatttaaaaacaaggtaatacagagttactaaaataatggtagcaaaggaaaaatcagagttcagtgggaaaaatctcacactgtggactagaatggtgatgtcagccttcatggatagatatgccccgaccttgaaagaattaactagaggaaggacaaaagcattctaaattttctgtgagacaggacattcttattacagtattttgtccaccattccccaagattaaagtattttatatatatacttggccctctgtatctatgggttctgtatccatgggtactgcattcatgtattcaacaaactatgaattttaaaaattcagggaagaaaatgatggttgtgtctgcattgaacatgtaaagacttttttcttgtcattattccctaaacaatataacgacaacttacacaccatttacatttcactaggtattataagtaatacaaaggtgatttaaagtatagagtgggatgtgcatagcttatatgaaaatacaccatttaatataagggacttgagcatccatggattctgatatccataggggatcctggaaacaaatctctcactgatactgagggacaactgtaaaagaaattttgttttaggacccaagtgactagcttgatttttcctctttttaagaaaaaagaaaactagacatctttgctattgctttcataaggcagctaaaatctgaaatatataaaagtacatatatgaaacatatgatattgctgacatttgtctatttttgaactaaagaagctgtaatttcacatgattcaaccatacacatatatacttgcataagcatatatacacaaacacacaaatatgagtacatatttaatataaaacttcttacctttatttgagcaaaatttgctacctgtgctaattttcagttgcattaacatctaacaagcaagtaataaattctcaaaaaagccatttctatcagcacaattagtatgtattaactataaagtctgttttcagtatctatagaatgtccttgacttgccaaaaataatatttgatgactcaagttgtgaatcatgaaacagaatttgattcatagttggataggcacttacattaaatcttcacccctgggaatccacacccaagtctaccagaaatcaagaatgaaagaaattggagatcttgagtcatctccaccctgaatatgtgatccaggtgacaaaagcacaaatgaacaaatgagtgtttcagcaaataaaccaaaaatgaaataacatttacaataccactgtgtaccccacctaacacagcaagcatctgtgcacaccatcagggggacttaggacaggccctccctacttccagccaccaccacaggtacctgcacatgtcatccagaggcctggggatcaactcatccccgttgccactgctggaatccacacacaccgtctgagggcctgagggcaaactcaccctgcccaccagcactgccactacttctggggcccagcacattatccaagagttgagagatcaactcctgccatccaccactggcacccatgcacgctttacagtagcctgagaataggcccaccacaccactacagctgcccatgtactctgtccagtggcctgaagatagacccatccttctattgctggtgactatgcctgcctcccaaaaactcaagtactggcccactcagcctgctgctgccaccattgctggcacccacctgcatgtaccacatggggtcctggaaactggcccacccagccctctcatgccactactgtcacctgtgcatgatattcaagggcctgagtattagctcaccactgccgctactatcactgacccaacacacactgccaaggggcctgaggacccacccacctgcctggcccactactagcacccaagcaagctgcctgggaccccaaggaccagcccacctagacacaccaccactggcacctggtacatcacctgggggccatggatctgcacacccaacctgccacttccaccactggtacccaagactgaaccacttggaatccccacccccagcaaagctttgccacagcctctactaacaatcacagcctaagtcactgaagaactgacaaacaccactaacactgattacaaatgaagaaatcatatagaaatgataatgctgtgccaacccacaatcaaagccaaatcaccatgcccaactaacaatatagatacatctacaggaaaaagtctttacctaagaaaaccaatccataaaattggtagagacaactgttataccagatatgcagatatcaacatcttgtatccttatataagaaacatgaaaaagcaaggaaatcttctatccttatacaagaaacatgaaaaaacatgaaaaagcaaggaaacaagacacctccaaaggaacacaataattaaccagtaacagataccaaaaaaatggacatttatgaaatgcctgaaaaataatttaaaataatgatactaaagaaactcagggaaaaacaagagaacatagataaataatacaaagaaatcaggagaaaacaattcctgatctgaacaaaacattcaacaaagagatagatatgctcaaaaagaactaatgagaaatactggaactgaagaactcaatgaataaaatttaaaaatacaattgagaacttcaacaatatactagatcaagcagaagaaggaatatctaaacttgaagacaggtcctcgaaataacaaagtcagatcccaccccaaaaaaaagaaaagaataaagaataaaaaagaatgaagaaagccacatataaacagcataaagtgaccaaatattcaaattgagggagttccaaaagaagagatgggcaaaggcatagaaaacctatttaacaggtcttgaagagatatagacatccaaatacaaaaatctcaaatatcctcaaatagattcaaccccaaaaggtcttctgaaagtacttcatagtcaaactgtcaaaacctaaagacaaagagagaattataaaaacagcaagagaaaagtatcaggtaacatgtaagggaatccatatcacactaacagtggatttctcagctgacacctcacaggtcaagaaagaatgggatgatattcaatgtactgtaagaaaaaaagtcagacaataatattataaccagcaaagctatccttcaaaaatgaagaagaaattaagtctcccagacaaacaaaaactgaggaaatttgtcacaactagactagccctacaagaaatgcttcagggagtcctgtatctggaagcaaaaaataatatctaccattatgaaacacaattctaaacatataagcacacaacactttaacatcaaatatataaagcaaatattattagatctataggtagagatagaccccaatatgataatagttagggacttcaacatccaactctcagcattagacaaatcatctagacagaagatcaacaaagaaacattggatttaaacttcactttagaccaaatggaccttacagaacatttcaccccacagctgcagaatatatatctcctcagcagcacatggaacatcctccagaatagaccatatgttagaccacaaaacaaatctcaacaagttttaaaaactgaactcatatcaagcattttttcagaccacaatggaataaaactagaaatcaatagcaagaggaaccttgaatgctgtatatatacatggaaactacacaacttgctcctgaatgactaatggcccaatgaagaaattaagaaggaagtcaaaaaatttattgaaatgaatgaaagtggaaacacagcataccaaaacttatggtattggtacaacaaaagcagtgctgacagggaagttaacagaaataaatgcctacataaaaaaaaaagcagatttgaaataaacaacctagaggtgcacctcaaagaactagaaaaatcaggagaaatcaaacccaaaattagtagaagaaaagaaataataaagattcaagcagaactaaacaaatggagactaaaaaaaataaaggatcaatgaaacaaaaagtcgttttttaaaaaaacaaacaaaactgacaaaacttttcttagactaggaaaaaaaaaggaagacccaaattaatgaaaccagaatagaaaaaggagacattacaagtgataccacagagatacaactaaagtacactaacaaattggaaatcctagaggaaatggtaagttcctggacacatacaacctaccaagtttgaatcatggaaaaacataaaacctgaacagactaataatgagtaacaagattgaatcagtaatacagagcctcccaataaagaaaagctgaggattgaattgctttactgctgaattctaccaaactataaagaaaaatacataccatttcttctcttactatttcaaaaaatagaagaggagggattttttcctaactcattacaaggctaacattaccctgatcctgaaatcagacaaggacacaacgacaacaataacaaaaactacaggccaatatctctactactgaacatagatgcaaaaatcctcaatgaaatactagcaaactgaatccaacagcacatcaaaaagatactacaccatgatcaagtgggatttatcccagggatacaaggatgttcaagatacacaaatcaataaatatgatatatcacatcaacagaatgaaggacaaaaaccatatgatcattcctatagatgcaaaagtacatgtgataaaattcagcagcctggccgggcacagtggctcacgcctgtaatcccagcattttgggaggctgaggtgggcggatcacaaggtcaggagatcgagaccatcctgactaacacggtgaaaccccatctctactaaaaatacaaaacattagccggttgtggtggtgggcacctgtagtcgcagctactcgggaggccgaggcaggagaatggtgtgaacccaggaggcggagcttgcagtgagccgagatcgcgccactgcactccagcctggggcacagagcgagactccgtctcaaaaacaaacaaaaaaaatattcagcagcccatcatgataataactaacaacaaattaggcatagaacgaatataccttaacataataaaggccacatatgacagtcccaaaactgacatcatactgaatggggaaacactgaaaactttttctctaagaactggaacaagacaaaggtgcccattttcatcactcctactcaacatagtactggaagtcctagccagagcaatcaggcaagagaaataaataaaaggcatccaaattagataataggaatatgctcttatgcctagaaaaaattaaaggctccaccaaaaaaactctcagatttagtaaatgaattcaataaagttgcaggatgcaaaatcaatgtacaaaaaatcagtagcatttctacataccaataatgacctagctgagaaggaaatcaagaaggcaatctcatttacaacagctacaaaaaaagcatatagtaacacatttagccaaggaggtgaaagatatttacaaggaaaactacaaaacactgacaaaagaaattgaagaggacatcaaaaaatgggaaaacgtcccatgctcatggatcagaattaacatcattaaaatgaccatattgcccaaagcaatctacagattcagtgcaatccctatcaaaataccaatgtcattcttcacagaattagaaagatcaatcctaaaattcttatggaaccacaaaagaacccaaatgccaatgcaatcccgacaaaacaaacaaagctggaggcatcacaccatctgacttcaaaatatactacaaagctagagtaaccaaaacaacatggtaccggcagaaaaccagacacattgaccaatgaaacagaatagaaaacccagaaataaagccacatatttacaaccaaatgatttttgacaaagatgccaagaacacacattcagaaaaggacagcctcttcaaatatgagaaaattggatacccatatacagaaaaatgaagtgggacccctatgtctcaccatatacaaaaattgactcaaaatgtattaaagacttacaagtaagatccaaaactataaaagacatggggaaatgctcaggacattggtctaagtaaagattttgtggctaatactttaaaagcacagggagcaaaaacaaaaatagacaaatgggactacataaaactacaaagtttctgcacagcaaagaaaatgatcaacagattaaagagacaactttctgaatgggagaaaatatttgcaaactatacatgtgacaaaggattaatattcagaatatacaaggaactcaaacaactctatgacaaaaacaaaaaaacaaaacaaataatcccattaagaagcaggcaaaggatttaaatagacatttctcaaaagatgacataaaaatggccaacagatgtatatttttttaaatgctcaatatcactaatcagggaaatgcaaagcgaaacctcagtgaaataccatctcatctcacacacaatggcttttatcaaaaagacaaaaaataacagatgctagtgaggatgcagagaaaagaggactcttatacgctcttgtgagaatgtaaattataccaaccattatggaaaacagcatggagatttctcaaaaacagaaataaataaataaaactaataaactaccatataatccagcaatctcactactgaatatttttccaaagaaaaggaaatcagtatataaaaagaatacctgcaccccatgcttactgcagcactatttataatatccaagatatggaatcaatctaagtgtccatcaccagataaatggataaataaaatgtggagctgagcttggtggtttatgccttgtaatcccagcaccttatgaggcctagatgggaggatcacttcagcccacgagtgtaagaccagccagagcaatatagtgagaccttgtctctacaaaagaaaatttttttaattatccaagcatgatggcacatgcctgtagttccagctacttgggaggctgaggtgggagggtggcttgagcccaggaggtcagggctgcagtgagccatgatcatgccactgcactccagcctgggtgacagagcaagacccttcctcaaaaaaaaaaaaaaaaaaaaaaaagatatgcatacacaggggaatactattctgccataaaaaataatgaaatcttgttatttgcagcaacaaagatagagctggaggttactatattaagtgaaataagccaagctcagaaaggcagatataagatgttctcatccatatgtgagagctaaaaaagttaatctcctgacggtagagagtagaatgaggcctggcatagtggctcatgcctgtaattccagcactttgggaggtcaagtcaggtgaatcacttgaggtcagaaaagaccggcctggccaacatggtgaaacaccatctctactaaaaatacaaaaattagcctggcatggtgggtgcctgtaatctcagctacttgggaggctgaggcacgagaatcacttgaacccatgaggcagaagttgcagtgagctgagatcatgccactgcactgcagcctgggcaagaaagcaagaccccatctccaaaaaaaaaaaaaaaaaaaaagagtagaatgatggttaccaaaggctgggaagggtttgaggctagggtggtaatgaaaagaggttggttaatgggtatacaaatgatagaaggaatgaattctagtgttcaaaagcacaatagggtgactatagttaacaataatttattgtatatttcagaacagctagaagggttgaaatgtcttcaacataaagaaatgataaatgtctgaactgatggatatcataaataccctgatttaattattacatactgtatgcatgtatcaaattattacatatgccccataactatgtacaattattatgtaataagtaagaaaagaagactacttgcatatctggacctgagagggaaggcaagcacaaggaagtctggcaatgaggtgagagcatcatagaacaaaggacagcacagcaaattttacctggtcttctctataattaagaggaacccatcttaaacttcaaacggggtacagtttcaaagtaggcaaaccaaggaaaaagactccaaagaattctttaaaatgtagctcggccaactgggttactatgtgccctaaaaaagtcagtctattccagaaaccatgttagatttcatgatcctccttgaacttagatatagaacttatagatttagatcagaatttctcaaactcatgtttgttaacccatttggaggtatttgcatgttctctattgaaatatatcattgagaatttattaacttagggtattcagtttgctgataatctagagtaaacatattctgggtaatctgggtagctacgtggtaacaaaatgccacctcacaggtccagtttgcctttgtgtttgcagtcagattgttgccaaggagtcccactttaattgactccagctatttagcaattaacagaggtagagtcagaggtgaataaaacttttgcttcaaatgacttcacagtgcactggaggaatgcaagtgtttcattatttcgaacagaaaagagtactgagaaaattgcatcttttcttagcacccagtgggaaaggcggaccaaacccaagagaacctgagccatagtcactaacactatgtttcatattaaagtacttatgttaatttacagtttgttaattttgcagaggagatagttggatgtaatttgtacatttgttttgataagagctacaagctattagagcagaaagcataagtttgtgcttactttcagtttgtacatatttaaggagtatttgaatttaaaggattatatcaacaatagaatagtaaaagaatttttaaggggttcaatacatgtgaacagttttaatcatgtgaaagatgttcctcatcattcatgagacacgaaaattaaaattacaatgagattttctttctttaacaccttataaaaaatggcaaaccttttcacatatacacttcctatcacctgccctgtttttctttctccagagcacgtgtcattaacataattgtattttgcttatttatcacatttattgcctacctttttttccattgtactttcccccagaattttttttttttttttttttttttttgagacagagtctcgctctgtcagccaggctgtagtgcagtggtatgatctcagctcactgcaacctctgtctcccgggctctagcagttctgcctcagcctcccgagtagctgggattacaggtgtgtgccatcatgcccagctaatttttgtatttttggtagagaagggatttcaccatgttgaccaggctggtcttgaactcctgacctcaggtaatctgcccacctccgcctcccaaagtgctggaattacaggtgtgagccaccagccaccttcccccagaatttaagcttcataaaaatagaattctgaccaccttatccactgtagcctcctcagttgcctataatgatgtgcagcacataagagtcactgtattatttgcagagggaaggaagggaggaagggaggaaggaaggaagggaggaaggaaggaagggaggaaggaaggaagggaggaaggaaggaaggaaggaagggaagggaagggaagggaagggaagggagggagggagggagggagatgatccagcaattcccctttgaggcacagaccctgccgaaactctgtcatagagacatgcacgaagcagtaccatttgcagcagaagaaaattggaaaaaccctaaatgtcctcaataaaggaatgaataattgcatcctgtgtttatacaagggaacttaaaaattaacatgaattaaattgattgacatggctaaaaatcaaaaactttgctgggagaaaaaggtaaattacaaaatacatgtgcagtaatgtataaatgcccagatagacaagttctcctccgagtaaggacaagctgaagagagggaggagatggagggaatggtaaggacaaatggagaactttgattctatctgtcgtttttattactctagaattttttacctaagaaaatatggcaaaaagtaatacttgctaaatctgagtagtgggtacatgggtgcgtgttctatgtttctctgtatttttctgttaaaagtgtttcttaatttttaaagcactcaatataagtaaaaatggctgtttcttttcctgcattaataagtagcccccctctataataatgataatgatagtgatgatgatcatgatgatgatgatgatggttttctctcttcctatcctctttttctaagtccttttattaacatctactattttatttctctttatatcatgcttctttcccccaaaaaaattgatatggcttaaaacaatagatatgagttacaatctaacatttcttttaaagtaaaatgtacataagatagctattaaagtaaatagtaatgctacaattgagctttaaatttttctccaagcttcttgaagctggaatgacaaacatacacaaccaagcaattatgtagctctcattatttaaaaggataccttgagaaagacaaagtttttcctggaattaaattctcaaagaaatctcttctgtatgatttcatttccaggacactaacatggacaatttcctccagagcatttttgctaaaatctaaagttgacttcatatgctttttcttgcaaccacttttttaaaaagctgaagacatagcatcttagtacagttctaggaaaggcattcattctttagaagctaaagtaacatatgcctttagtcatccaactaaatccaaagataaaatatgaaaataggcaggaagcatgtctcttacataattgtcccttaatataattttctttagacaagctattgatagatagaaaccaaacattcatcaattaaaaattatagtcacataccaggacctgccgctaagttactgagcaagggtgggtagctttattaagtatcatttgcctcctttagaaataactagaaaaagaaaattgtaaaataaatacctgattcatcataagttctaactggcaagattctatgttttcttttagatttgtctattctttaagcctaaaagaaaagctacacagagtcctaagtccagattttgtgggccagggattatgcctgccagaggatgctgcggtttactagcagcatttttgtactttttctttttttttttttttttttttttttttttttttttttttttttttttgagacagagtctcactctgtcacccaggctggagtgcagtggcgcgatctcagctcactgcaagctccgccctccgggttcacgccattctcctgcctcagcctcccgagtagctgggactacaggcacccgccaccatgcccggctaatttttctgtatttttagtagagatggggtttcactgtgttagccaggatgatctcgatctcctgacctcgtgacccgccagcctcggcctcccaggtacatatttttaaatgcctgtagtgtaagcatacatttctgggattcaggtttgggttagtcccaataaaagactgtaattgaaggctcacttatccattgactatttctgttactaccaataaaataagggaatgacaactaatatccaacaacactgaacataaggtagaaaatcaagtaaagctagaaagagcttgtgataataataatcacttccatttatatcaccctttcacccttttatgcatggtctcatctaatcctcacaagaaccctgagagatggataactgtaacaaaatttaacagtaatcataacaaaattttaacagtggtactgaagcttagggcaacttgatgacttgacccaaatcagaaagctgatctatagtatgggtcaggacctgaacccatgagttgtggctgcaaacccagctaccttgtagttccaggataaccatgcactctgtagttagagatccaaggtacactattgttacctcttctctttgaaggacaaagctttgtgatcttcattccatcttcacatggttgggagggtcatgcatggatgtctctctgtagatcttcaccacaccaaccctctctgatagagtaacaaagctttcttcagaatcatatcatctcttaaatgtggtaaccaaccatacagagggaatgaatgttgtttggggaagattttttttcaaggttctttaataaattgaagttgcaattaataaaatcagaaacatgagcagacatacatctaaaagctgacaggccatcatatcctgagtgataggtgaaagagatagtcttcctaggttgaggttcataatttttaataggtttacaagcagattcacaaggattctattcaaacaaaagttatgtttctttacttttgagtttgtttctcctacatttgtactcagtgctatgggataaaatcaatttcttcaaatatggaatttagcttcgtgcttatttaataattaatggtaatctaaaaatcatagagcttttcagaccggagtttgttgtattttcagcctccctcgtctaaagctactctcagtggaggaaggaaccagaggaatggctgccctcgctaaatcagtgtgagaaggtctgggaacacactgcacaatgtaacagaacattcttttccacaagtgtcagaatcacttatcttcaaatactagatcaacgcagctagagaactgggggaacttggagcccaaaaatataatacatagcttgcttaattttaaaccaatattttcctccacttacccaaatgcataaggcatactattttctgccccccaaaattcattttgttttatttcactctctcaaactgacaaacaggcattatacctgatacagactatattttaatagcgtctaacctctcctggttaaacaagtgtctgtttcaaatccgtcatcatatatgtgactcctgcacataatgttgctctaaaaaaggaatgtcctggtatcagcaaaatacataaccccatagatattaaaacaaccacccaactgcaatcagttatatggagtcttcacttctttttaaaaaaggatatttaatcactgaaataagacccaggtaccacactacacacttagttgggacttaaagtgcctgagttttatgagaatggcaaagctagtgtgaaaaactacagcacaacagaaggaagaaatctctctgctggaaggggacacttttgtgtccacatctcatagcctaagtttaatatcagcatgactcatttttaaaactccacctttctcagtgataatttatgttttaatttttaatttttgtgagcacatagtaggtgtatatatttatgagttacatgagatattttgatacaggcatgcaatgtgtaatcacaccaggataaattgggtatccatcatctcaagtgtttatcttttatattacaaacaatctgatccaatatatacaagagtataatccaattatagtcttttagttatctttaagtgtgcagttacattatttttactatagtcaccctgttgtactagcaaatactaagacttattcattccttctaaatattttttgtacccattaactatctctactttctccaccctcaccccctgcaacacccttcccagcctctagtaatcatccttctactctctttctccaagagtttaattaatttttaactcccacaaatgagtgagaacatgtgacgttcgtctatctgtgtctggcttatttcacttaagataatgacctctacacaaggagaagttggtaccattccttctgaaactattccaatcaaaagaaaaagaggaaatcctccctaactcattttatgaggccagcatcatcctgataccaaagcctggcagagacacaacaaaaaaacagaattttagaccaatatccttgatgaacagcgatgcaaaaatcttcaataaaatactggcaaaccgaatccagcaacacatcaaaaagcttatccaccatgatcaagtgggcttcatccctgggatgcaaggctggttcaatatacgcaaatcaataaacatcacccagcatgtaacagaaccaacaacaaaaaccacacgattatctcaatagatgcagaaaaggccattgacaaaattcaacaacgcttcatgctaaaagccctcaataaattaggtattgatgggatgtatctcaaaatactaagagctttttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcatttaggaaaagaagaagtcaaattgtccctatttgcagatgacatgattgtatgtctagaaaaccccattgtctcagcccaaaatctccttaagctgataggcaacttcagcaaagcctcaggatacaaaatcaatgtgcaaaaatcacaagcattcttatacagcaataacagacaaacagagagccaaatcatgagtgaattcccattcacaattgcttcaaaaagaataaaatacctaggaatccaacttacaagggacgtgaaggacctcttcaaggagaactacaaaccactgctcaatgaaataaaagaagatacaaacaaatggaagaacattccatgctcatgggtaggaagaatcaatattgtgaaaatggccatactgcccaaggtaatttatagattcaatactatccccatcaagctaccaatgactttcttcacagaattggaaaaaactactttaaagttcatatggaatcaaaaaagagcccacattgccaagtcaatcctaagccaaaagaacaaagctggaggcatcatgctacctgacttcaaactatactataaggctacagtaaccaaaacagcatggtactggtaccaaaacagagatatagaccaacggaacagaacagagccctcagaaataatgccacatatctacaactatctgatctttgacaaacctgacaaaaacgagcaatggggaaaggattccctatttaataaatggtgctgggaaaactggctagccatatgtagaaagctgaaactggatcccttccttacaaaaattaattgaagatggattaaaaacttaaatgttagacctaaaaccataaaaaccctagaagaaaacctaggcaacaccattcaggacataggcatgggcaaggacttcatgtctaaaacaccaaaagcaatggcaacaaaagccaaaattgacaaatgggatctaatttaactgaagagcttctgcacagcaaaagaaactaccatcagagttaacaggcaacctacagaatgggagaaaatttttgcaatctactcatctgacaaagggctaatatccagaatctacaatgaactcaaacaaatttacaagaaaaaaacaaacaaccccatcaacaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacacgtgctggagaggatgtggagaaacaggaacacttttacactgttggtgggactgtaaactagttcaaccattgtggaagtcaatgtggcgattcctcagggatctagaactagaaataccatttgacccagccatctcattactgggtatataccaaaaggattataaatcacgctgctataaagacacatgcacacgtatgtttattgtggcactattcacaatagcaaagacttggaaccaacccaaatgtccaacaatgatagactggattaagaaaatgtggcacatatacaccatggaatactacgcagccataaaaaatgatgagttcatgtcctttgtagggacatggatgaagctggaaaccatcattctcagcaaactatcacaaggacaaaaaaccaaacaccacatgttctcactcataggtgggaattgaacaatgagaacacatggacacaggaaggggaacatcacacaccggggcctgttgtggggtggggggaggggggagggatagcattaggagatatacgtaacgttaaatgatgagttaatgggtgtagcacaccaacatggcacatgtatgcatatgtaacaaacctgcacattgtgcacatgtaccctaaaacttaaagtataattaaaaaaagaatgttacagaaaaaaagataatgacctctagttccatccatgttgttgcaaatcaccagatctcattcttttttatgactgaatagtactccattgtgtatatgtgccacattttctttatccattcatgtgttgtggaacttaggttgtttcaaaatcttggttattatgaatagtgctgtaataaacataagagtgcagatatctctttgatatcctcctttcctttctttggggtgtgcccttgcagtgggattgctggatcatatggtagctctatttttagtcttttggtgaacctcgaaactattctccatagtgattgtactaatttacattccaaacaacagtgcacaagggttcccttttctccacatccttggcagcatttgttattgcctgactttgggatataagctgttttaactggggtgagatgatagctcattgtagttttgatttgcatttctctgatgatcaatgatgtggtacaccttttcatatacctgtctgcaatttgtatttcttcttttcagaaatgtctgttcaaatcttttgcccatttttaaattggattattagattttttcctatagagttgtttgagatccttatatattctggttattaacttatcggttaggtagtttgcaaatatcttctcctattctgtggattgtctctgcgcttcaacgactgtttcctttgctgtgcagaagctttttaacttgatgtgatcccatttgtccatttttgctttggttgcctgtgcttgtggggtattattcaagaactctttgcccaatctagtgtcctggagagtttccccgaagttttctttcagtagtttcatagtttgaggtcttaaattttagtctttaatctattttgacttgatttttgtatatggcgagagatagtggtcttgtttcatccttctgtatgtggatatccagttttcctggcatcatttattgaagagactgtcctttccccaatgtatgctcttagaacctttgtcaaaaatgagttcactgtagatgtaagaatttatctatggtttctctattctgttccactgatctacatgtctgattttatgccagtaccatgctgtttgggttactatagctctgtagtgtaatttaaactgaggtaatgcaattccttcagttttgttctttttgcttaggatatctgtggtcattctgggtcttttgtgatagcatgtaagttttaggattgtttttactatttctgtgaataatgtcattggcattttgatagtgattgcattaaatctatagattgctttgggtagtatggacattttgacaatattgattcttctaaccatgaacatggaatattttcccatttttttgtgtgtcctcttcaatttcttgcatcaatgttttacagttttcattgtaaagatccttcacttctctggttaattcctaggtattttattttacatgtagctattgtaaataggattggtttcttaatttctttttcagattgtttgtggttggcatatagaaatgctactggctttttatgttgattttgtatcctgcaattgtactgaatttgtttatcattctactattttttagtggagcctaggtttttccaaatataagatcatatcatctgcaaataaggataatttggcttcttccattccaattttggatgtcctttacttctttctctagtctgattgctctagctcggacttccagtactatgttgaataacagtggtgaaagtggtcatccttattgtgttgatctgaagtgaaggctttcagttttttcccattcagtatgatactagctggagtctgtcatatacggcttttattatgttgaggtatgccttctatacccagttgtttgaggagttttgacttgaagggatgttgaattttatcaaatgttttttcagcatcaactgaaatgatcatatagtttttgtccttcattcttttgatacaacgtatcacattaattgatttgcatatgtggaatcatccttatgtccctgggaaaaatcccacttgcttgtgatgaatgatctttttaatgtgttgtttaatttggtttgctagtattttgttgaggattttcccatcaatgttcatcaggaatatttgcctgtagtattgtgtgtgtgcgcgtgtgtgtgtgtgtgtgtgtgtttgtgtgtgtgtgtgtctggttcaggtatcagggtaatactggccttgtagaatgagtttggaagtattccctcctcctcaatctttgtcagaatagtctgagtaggattggcagtagttctttaaacatttggaagaatacagtagtgaagtcatcaggtcctaggtttttttttatgggagacattttattatggctttaatcttattacctgttactggtctgtcaaggctttggatttcataattcgatcttggtaggttgtaagtgtgtaggaatttatccatttcttctagattttccaatttgttggcatatagttgctcatagtagccactaatgggcctttgaatttctgcagtatcggttgtaatgtctcttgtttcatttttgatttttttatttgggtcttctatatctttttcttggttagtctggctaaaggtttgtaaattttgtttagcttttcagaaaaccaacttttgtttcattgatcttttgtattattttcatttcaaattcattcatttctgctctgatctttattatttcttttcttctattaattttgggtttggtttgctcttgcttttctagttctttaagatgcagtgttagattgtttatttgaagtttatcctctttttgatggaaagagtttttctcttcctctttgataagggacttatggctataaacttcttagtactccttttgttgtgtcccataggtttggttatgtcatgtttccattatcatttgtgtctggaaatttttccattttcttcttaatttcttcattgactcactggttattcaggagcatattgtttaatttccatgtgtttgcagtacccaaagttcctcttgttattgatctctggttttattccattatggtcagagaaaatgcttgatattatttcaactttttgaatgttttaagacttgttttgtgaactaacatatggtctatccttgaaaatgatccatgtgctgaggaaaagaatttgtactcagcatctgttggatgaaatgttctgtaaatatctattaggtccatctgtacagactaaacccattgtttccttgctgagtttctgtctggaatatttgtccaatgctggaagtagggtattgaagtctccagctattattgtattagggcctatctgtctctttctagctttagtaatatttgctttatacatctgggtgcaccagtgttgggtgcatatatattttaaattgttatatactcttgctgaatggacccctttatcattttacacttactttctttgtttcttcttataatttttgtcttgaaatctattttgtctgatataaatatagtgactcctggtcctttttggtttccattggcatggaataactttttctatcgctttattttcagtctatgtatatctttatagatgaagtgtgtttcttgtaggcaatagatcattggttcttggttttttatccattcagccactctatgtcttttgactggcaagtttagtccatttacattcaatgttgttataaataagtaaagatttactcctgccattttgttatttgttttttgtttattttgtgagcttctcatccttctttccttccttcctgccttccttctcatgaagttaattttctctggtggtatgatttaatttattgctttttattttttgtgtatttataatatgtcttgatttgaggttaccatgcggcttgcaattactatcttataacccattattttaagctaagaacaacttaacactatttgcataaacaaacaaacaagcaaaaagaaaactaataaaaactctacccctcaactttatccccccgcttcttaactttttgttgtttctatttatatcttattgtagtgtctacatcttgaaaagtttttgtggttattattttcgattggttcatcttttagtatttctacttgagtagtttacacaccacagttacagtgtataactgtatgaactactcttatcttacccaccaaagtctatggtgtgtaaacacagactttataatagtctgtggggttttttctgtacttactattaccagtgacttttgtaccttcagatgattttttattgctcattaatgtccttttctttctgattgaagtactccctttagcatttcttgaaggacacgtctggtgttcatgaaatccctcagcttttgtttgtctaggaaagtctttattttctccttcgtgtttgaaggatattttcaccagatatagtattttagggtaaaaggtcttttccttcagcactttaaatatgtcatgccactctctcttgacctgtaagacttccactgaaaagtctggtgccagatgtattggaatcccattgtaagctatttgcctctgttctcttcctgcttttaggatcctttctttatccttgactttagggagtttgcttattaaatcccttgaggtagtcttccttaggtaaatttgcttggtgttctataaacttcttgtacttggctattgatatctttctctaggtttgggaagtgctctattattatccctttgaataaactttccctatctctttctctacttcctccttaaggacaataactcttagatttgcccttttgagagcattttctagatcctgtaggtgtacatcattgtttttattgttttttcttttgtctcctctgacttttattgttttttccttttgtcttctctcagtcagcttgtggtgaatgctgccaggtctgggactcacccttcagagtggtaaattcccctctggcccaggttaggtccagaaatgccatccaagagccaaggcctgtctccttgactgtgtattttcaaatagcgtatcttcaagctcattaattctttcttctgcttgatcaattctgctattaaagactctgatgcattcttcagtaagtcaattgcacttttcaactctagaatttctgtttgattctttttaattatttcaatctctttgttaagtttatttgatagaattcttaattccttgtctgtgttatttttaatttctttgagtttcctcaaaatagctcttttgaattctcttcctgaactgtcccattctgtttttctaggattggtctccagtgccttatttagttaatttggtgaggtcatgttttcctagatggtcttcatgtgtgtggatgttcatctgtgtctggccattgaagagttagatatttattgtagtcttcacagtctgggcttgtttgtatctgtccttcttggaaaggctttctacgtatttgaaaggacttgcgtattgtgatctaagatatatctgccttagggggcactccaaggccagtaacactgtggttcttacagacttgtatagatactgccttgatagtcttggataaaattcagaagaaatatttggattaccaagcgaagactcttgttctcttttcttactttctcccaaacagagtgtttctctgttctgagccacctggagctgggggtggtatgacacaagcatctctgtgcccatcaccactatgactgcattgggtcttacccaagacccactataaccactacctggctaccacctattttcactcaaggccttagggctctacaatcagcaggttggcaaagctagccaggttagtgtccttcccttaaagatggcaagttccctcaggccccaggttgatccagtggtgccatctgggagtcagagaccggaatcaaaaaccttcaaagtctctctggtgttctattctaccatagctgagccagcatgcaaaccatgagatacagttcttcccacccttccctctcctttccacaggcagaggcgcctcaccccagggccaccaccatgacagtcccatgggaagtaccaccaggctacgaccaatgttcccttaaggcccaagaactcttcagtcagcttgtggtgaatgctgccaagactgggactcacccttcagagtgctaggctcccatctggcccaggacaggtccagaaatgctacccaggagccaaagcctggaatcagggatcccaagaacccacttggtgctctacccctctgtggccaaactagtgtgtaagatatgagaaaagtcccatttgcttttccctttgcttttctaaagcaggaatctttcaccatagccaccatagctgggaacttgctgggtctcacctgaagtcagcacaaccatgagtcccacccaaggcccatggcatactacctgggtatcattgctgggtattcagggcccagtggttctttggtcagcaggtgatgtgtcctgctagtacagtgtccttcccttcaaggaagcatgagttcccttttggcctagagtatgtctagaaatgtctggaaactagggtctggaatgggggcctcaaaactctgcctggtaccctatcctactgcaactaagctggtatccaagatgcaagacaatgccctctttgctcttccctctcctttcctcaggtggaagaaaggggtctctttcggagccatgagctggggttttggggaggggtggcacaagcactcctcttagccacactggctgctatctcagtaggtcacctgcccccaagcccactgggcctgagcccagttcggcattaggactcacctaggagttgcagtccttgtggcctagactgcctttcaagtttagttagagtcccagagtactttagctcatggtggcaaggcttacaggaactcaagttccaatggctggaatgagtgattcccctctgactagagctggtttaaatactcccgccatggatgggcattagctgagttcagcccagcaccgagttcaatgcaatgtttcacaattgctgtactctccctctcccaagaacacagattctcattgccacgcagcttcagccacaggatgggaaaggagtggtgtcagcaattcaagactgcctttcctaccctcttcagtgtctctttcagcaacacaaagttaaaaccaggtactgtgagtgttcacctgacttttggttcttatgaaggtgctttatgtgtagataattgttaaatgtggtgttccagcaggggagataatcagttgagccttctatttggccatcccgctctgcctccataatttatattttctagagcaagagaaagagtgctaagagtgctaagatcaatgaaacaccttgcctgaacaaccataaaacatccaatttagagctaacactgttgcttagtgacaaccagaagcctgttatttgtcaaatttaaattttaaggtatcattttaattaatgcattgtgtttatcttgggcctgctaaaagttctttggtgtagcattatgtagagtaaaatcagggacttggggagaggggtcaattcctacacagcaaagaatcacatcactgttcaaggaagatgactgcatgttatcacagctccactaagaaggagatccaatggaagaatgtgcctaattcttactggaatttaccatttttctccctaggacaaactacttagagtagttatagcacagattcaggtattagagtaaaaataagacaacagaggtcacttagtgtaacctcccacccaagagcttaaccctacctataacattcagtcatttattcaacaaatattttcagtacctactatgcaccagccactataatagacacttttaatgcattctaaacatgagaggcaagtatcccaaactcataaatataacaacataatcaatgagacaaagtacatgtgtttactaacacatgaataattacagattttgatacagtcttagaaagaaatgaacaaatgcttggattgagaacaacatagggcagagggaatccagtcacagacaggatggtcaggtaagtcttctctagaaaggtgacatttgagctgacttctgaaaaagaagaaacatgccatgcaaggagctgatgaaaaagtattccagttaaatgaaacagccagtgcaaagactctgtaggaataagtgtttatagcaaagtgagaaaagggaaagaggtgaagttgaagaactgagcagaggttagacaatgcttccctgttgaccatgagagaaagtttggactatacatcaaatacaataggaaaactttaaacagggtaatggcaggatgtgatttatactgaaaagagagctccaccatatatcatcccttctggcataggaatgcccctatgtaaactggcaagctaggtacaagttgctttagaacattcagactccttcatagcccaggtgattaccatatttttttaaagtaagaatatgtgcatatagttcatcctgtaataatagtattaatagtagtagtggtggtgatgacgatggtggtagtagtagcagcagcaacagcagctaatagctgttgagtgcttactatatgatcagtaccattttaaatatttttaggtattagctcatctaatcctcacaagcatgcaaggaagcaggctcagttattatccctcttttacaaatgagcaaactgaaactacatgcctattaagtaaatattttcttttccaatgatttctgttcttattttgttgctataattcagctcaacatgttttctagtatttgttgtgatttcttctttgacccaaaatttatttagaagtgtatttcttaatgtataaacttctgaggatttctggttcttttttctattactgaattctagttgaattccacttcagtgaaagaacattgtatagtatttcaattctttgaaatttgttgagatttgttttatgttccagtatagtctatttttataaatactccatggttgcctgaaaataatgagcatgctgcagttgtgtatactgttctataaatgtcaattaggtcaagttgtttaacagttttgctcaaatcttcattattctttttagcttttatggagtgtgtttatcagttactgagagagagtattaaaatctatttgtctatttaatcttgtcaatctttgttttatgtattttaaagttatcttcggtatcattggttttgccttcttattgaattgaatctttcaacattaataaatgttcctctgtattttcattaatattttttgccttaaagtctactttgatattttagactcactgactagcttttggtgagtatttacatggcatatctcttccataattttactttcaatctatttgtgaccttttatttagcaaattgctctcataaacaggacatagttgggccaatctaacatttgcctcttagagtgtttagtttatttgtatttcatataattgctgatatactggatttaagctttcttttgatttttttttctatttatctcatctgctttttgtcctttgatcctgtcttttctatcttcctttggattaactgagtattttttattattccatttttagctcctctactagctttatgtattttttggtggttgtcctagagattgcaatatgcattcttgaattatttctaataattttaaatgtatacttttcctatttccctattgcatcaatcttagaatagtttaactcctttccttcctcctgccctttatgctactgttgtcatatgttttacttctacatgttataaaacctaagagacatttttattattgttactttaaatggtcagtattctttttatttactctttctagctatgttcattccttcctttaattttgtgcttgtaacatggtttgtattatttcttgtatttcttttaatacagatacaaattacaaaatctgagttaatttttttcattttttgaaaaatctttgcatcactttctttttatttttttcactattatttctgaagaatatttttactgagtatagaattctaaggtggcagggtttttttccctgttagcactttaaagatgtcattccactgttttctggctttcagggtttctgttgaaagtcagccatcagtgatactgttgttcttttgaagttaatatatccttttttttctctgatttcttttaagattttttttctttatcttgattttaagtggctttactgaggctgatgtgcattggtggttttctttatgccttttctgtgtggggttgactgagaagctggatctgtaaacttatttttcatcagtttggggaaattcttggtcattatcttttttcaaatattgcttctacccattctctatttcctccatcaggaactccactacattcatgttaatcaatttgactgggtcctatatagcccttggccccctgttctgttctttctattccattttctctctatgcttcagtttgaatgatttatttaaatatttttagggtgcttgatgtcattgattctatctttagctgtatagaatgtggtgttaaacttatccaatgacttctaaatttcagatactgcatttttatttttctgctctacaatggccattttattttgtatatgtgataattctctgtttaaatcttactctgttaaatccatttggggctacaaatcaaaatggctgactagaggtgcacaacaccgacctcccccctcaaagaaggaccaaaacaataaatatatcactgtactttgagtagagaatctaaaggagaacattggaattcaacaaggaagtgaagaataccctctgaggcacagaaactaaggatggcagcatagagaaagaagcaaagtccatgcctaggatcagctcagagccatgagagattcctactatggagaaagggtagtgggaagtcttcagcagtgcccattatcaccatggacacctgcaatctcagctatataagagtcccacagtcctcacagaccctaagcccaatatagcgagctgcttggagtccatatagctgcattgctccagagaggaaattcatgctggatctccccaaatccccaggacccaagctgctgcagcctgtcaccactttgcaaacagagctactgctaaagcgcatcctgccctggaacccaatagcccctgcatcttcacatccctggatccccttttcaccccaccatgcccaaacaaagggctgcagtgtcatgactccagatagacccagtgttagagtcatgatctcaacacccaagcctacttagctccctacaccccatggaaccaggcagtcagtgcagtgggggaccacacccaggactgggaaaaccaaagcatgcactctccagggcctgaaagccagccacctagaatctgcagccaccagcaacctcacaccctcaaccaatggggccaccatgtgtgccatacatgcatgccccagggctcaaagacagacctatctggcacccactgccatcagcaaccccacacccttgactggtggagctaccatgcacaacacttgtgccccccagggccaaaggatgggccgacctgatgcctgccactgccagttgcccctccccctcaaccaaaaaagctgcagaatcacacacacacacataacccagggcccaaggataggtgtggccagtatcagctagcaattcagaccccttaattggcagagctaccacacactgtgcacattcccctcaggtaccaaggactgacctgcccaaggcaaaccaccatcagaaactccatcctcagcaaagctgctccaatgcctccacaaaccctgcaatttaggccactgaggcatctggagaaatcactgacattaattacagccaaagaaatcacatagagactttactactgcatgcatccagaaccaataccaaagcaccctacccaaccaacactataggtcacaactacagaaaaaatctttttctaagaaagccactccataaaattggaagaggtgagaattccaccagatgcacagatatcaatgtaggaatacaaaaacatgaaaaagcaagaaaatatgacatctgcaagggaacacaataatattcctgtacacacttcaaagaaaatcaaatatataaaaagcttgaaaaggaatttgaaatagtgatcttaaggaaacttactgtaatacaagataatgatgataaataatactaataaatcagtaaaataatacatgatgtgaatgagaaattcaacaaagagatcaatattatttaaaaacaaagaaacagaaatcttgaagctgaagatttaaatgaataaaattaagaatataaccaagaccttgaacaatagactagatcaagtagaagaaagaatttccaaacttgtagacaggccttttgaaataagtcagatcaaagaaaaaaaataaaaggtgaaataagcctataggatctatgggacaccattaagagaacaattttttgtattatgtgatttccaaaaggataagagatggggaaaggaatagaaaatctatttaatgaaataaaagctgaaaacttcccaagtcttgggaaaaatttggacatccagatccaggaagctcaaaagttcccaaacagattcaggccaaataggtcctctccaagggacgttatagtaaaactgccacaagtcaaaagcagagagagaattcttttttttttttttttttgagacggagtctcgctctgtcgcccaggctggagtgcagtggcgcgatctcggctcactgcaagctccgcctcccgggttcacgccattcacctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgagaattcttaaaatagcaaaagaaaagcatcgagtcacatgtaagaaaatcccaaatagaaaaaacacaaacagatttccccaagtcacatataagggaatacacatataaggttacagcagaaatcttaaaggccagaagagaatgggatgatgtattcaaagtgctgaaagaacaaaactgccagccaaaagtactgtattcagcaaagctattctcaaaaatgaaggagaaatagccctttccagacaagcaagaactgagggaatgtgtgataacttgatgggccttatgagaaatccttaaaggagttctatatccagaaagaaaaacacactaactacaattatgaaaaacaccaaaccacaaggataaaaaatgagagaggaaaaaaataacaaacaatatcaaaacagccagaaaataatttaaaaaaagataagaataagtcttcacctatcaataatgattttgaatgtaaatggactaaattccataattaaaagatacagactagctaagtgaataataaaacaagacccgagtttgagaccagccgaggcaacatggtgaagcctatctccacaaaaaatacaaaaattagccaagtgtggtggcacacgcctgtggtcccatctactcaggaggctgaggctggagaattgcttggaccagggaggtgaaggttacaatgagctgagatcatgccactgctctccagcctgggcaacagagtgagaccctgtctcaaaaaaaaaaaaaattaacctcttctataaaggtgcacatatacacatagactgaaactgaaggatggaaaaagatattccatacaaacagaaaccaaaaaatgagtaaaagtagctatacttatataagatgaaatacactttaagtcaaaaactgtaaaaagagacaagtttattatataatgataagggaattaattcaccaagaggatataacaattctaaatatatatacactcaacacttcagcacccagatgtatcaagcaaatattattagatgtaaaaggagagatagaccccaatacaataatagctggggacttgaacacctcactctgagtattaaatagattatctagaaagaaattcaacaaacattagatttaaactgcactacagaccaaatggacctaacagactacagaacattttgtccaacagatgcagaatacatattcttcttggcagcacataaaacattctccaggatagaccatatgttaagccacaaaacaagtctcaaagaatttttttttaattgaactcatatcaaatatcttttcagaccacaacaaaataaaactagaaatcagtaaaaagaagaacttcaaaaactgtataaatacgtataaattatacaacttgttcctgaacaaccaatggtccaatgaagaaattgagaagaaagtcaaacattttttgaaacaaatgtaaatgaaaacacaacataacacacctatggtatataataaaagcagtgctaagagggaattttataacaataaacacctacataaaaaaaaagatttcaagtgaacaacctaacaatgtaactcaagaaagcagaaaggcaagaacaaactaaacccaaaattagtaaaagaaaaggaataataaagattagagcaaaaccaaacaaaatagagacgaaaaaatacaaaggttcaacaaaataaaaagctgttttgttgaaaactgacaaaactttagctacactaagaaaaagagaaagaaaacccaaacaaataaaatcagaatggaaaaaagaaacattacaactgacattgctgcaatagaaaggataattagaaactatcatgaacaactgcacataaacaaattgaaaaacctagaaaaaatggataaactcttggaaacatacaaccttggttcaaccaggattgaaccaaaaaaaaaaaaaaaaaaaagcagaccagtagtgaaaaacaagatagactcagtaatttaaaagcctcccaacaaaaagaaaagcccagaaccagatggcttcactgctgaattataccaaacttttaaagaataacaaacaccaatttatctaaaactattccaaaaaattgattgcaagagaaaaattccaaattcattctataacaccagatatctacaaccaaaacaaaataagaacacaacaaaaaaagcaagctacaggccagtatcctgatgaacatagatgcaaaaccctcaacaaaatactagcaaaccaaatccaatggcacatcaaaaatatactccaaaaccaagtaagatttatcccagggatggaaggatggttcaacatacacaaatcaataaacaccataaatcacaccaacaaaatagacaaaaaccatatgatcatctcaatagatgcaaaaagcatttgataaagttcagcatcccatcatggttaaaaaaataactgtcaacaaattaggcatacaaggaacatacctcaacacggtaaagatcatatatgacaaacccacagttcacttctattggatggggaaaagttaaaagcttttcctctaagaactggaacaaggtaagaatgccaactttcaccactcttattcaacatagtgctggaagtcctagccagagcaatcaggcatgagaaagaaataaagggcattcaaatttgaaaggaggaagccaaattatctctgtttgcaaataacatgatcttatataatagaaaacctaaaggattcaccaaaaaaactctaagaaatgataaactaattcagtaaagttgcaggatacaaaatcaacaagcaaaaatcagtagtgtttctatacattaataatgaactagctgatagagaaatcaataaagcaatcccatctacaacatctactgaaagataaaatacctaggaataaattgaatcaaggaggtgaaagatctctacaatgaaagctgcaaaacactgatgaaattgaagaggacacacaaaaaaatggaaagacatatatctcatgttcatggattggaatatataatattatttaaaatgatcataatatccaaagcaatttacagattcaatgcaatctctatcaaattaccaaagtcattcctcacagaaatagaaaaagcaggaagggaggatcccagatggctaaataaaaacagctgcaattggaggctcccactgagaagaatcaaaacagtgagtgaatcctgcaccagtaactgaggtatccaggttctgtcattggaactaggtggtttgtgactcatggagagtgaggaaaatcagagtggtgcaacagcctaagacccacatggggcaaagcgagctcccacccccagccaaaggaggcagtgggaagccacactttttccaaggatctgtgcaacccacagatcagggaatcccactcatgagcccatgccaccagggccttgggtcccaagcacagagttgtgcagattctcagcagccactcagctggagagtgcctaagactactgagctccttgagggaagggaagccattatcactgtggctgcctggtgcctaagatgactgaattccaggaaggatgggcagcagccatcactgcagctccagcctgccatttttcccctgctgggactggggagacagaatggtttgcacccaggaggaattccccacagcacagcacaatggctgtggcagatcatggccaggctgcctttttaggctggactctgacccattccctcctctctgggctgggccgccctgcaggaatttcagcaactccagtcagggatttagggacagaactctgatctccctgggactgagcccctgggaagagggggagccatggtctctgtggatcaacagatttagtctttccttctgctggctctgagaaatgcaggcagcccagacgagtgggattccccacagttcagcacagcccctctgccaaggggcagccagagtgcttcgttaagcagatcccagaacccatgccccctaactgggtgagacacccccaaaaggggttgccagacaccttatacaggagcattcctgctggcatcagatcagtgccccttgggggcagagatcctgggggaaggagcaggaagccatctttgctgttctgcagcatcctcaggtgacacctccaggtgtgggagggtaggaggaaaatagggtttggagtgaacccccagcaaacggcagcagccctacagaagaagggcctgactgttaaaagaaaggcaaacagaaagcaaacagaaagcaacaacaacaacagcatcaatgaaaaagtctccacaaaaaccccatccaaaggtcagcagcctcaaagattgaagctagacaaacttatgaagatgagaaagaatcaacaaaaaaagtgatgaaaactcagaaagccagagtgcctcctcttcacaagacttcacctctccaacaagggcacagaactgagcagagactgagatggacaaattgacagaagtaggcttcataagggggctaataacaaacttcgctgagctaaaggagcatgttctaactcaaggcaaagaagccaagagccatgatacaatattacaggagatgttaatcagaataaccagttcagagaggaacataaattacctgacgaagctgaaaaacacaacacaagaacttcacaatgcaaccacaagtatcaataaccaaatagaccaaacagaaaaaagaatttcagagcttgaagactatgttgctgaaataagacaggcagaacagattaaagaaaaaagaaggaaaaggaacaaacaaaacctctgagaattataggactatgtaaaaatatgggacctatgatggattggggtacctgaaagaggcagggaaaacaaaaccaagatggaaaacatacttcaggatatcatctggaagaactttcccaacctaacaagactggccaacattcaaattcaggaaatacagagaaccccagtaagatactccacaagaagataaaccccaagacatataatcatcaaattctccaaggttaaaatgaagggaaaagtgttaagggcagcaagagagaaaggcaagatcaccgataaagggaagcctaccagactaaccgcggatttctctgcagaaaccctacaagccagaagagtttgggggccaatattcaacattcttatggaaaagaattttcagcccagaatttcatatctggccaaactaagcttcataagcaaaggagaaataaaatccttttcagacaagaaaatgctgagggaatttgtcaccaccaggccagacttgcaagagctcctgaaggaagcactaaatatgaaaaggaaaaactggtaccaggcgctgcaaaacacagtgaagtacaaagtccaatgacacaatgaagcagctacataaacaagtctgcaaaataaccagcaagcatcatgatggcaggatcaaattcacacataacaacattaatcttaaatgtaaatgggctaaaagccccaattaaaaggcacacaatggcaaactggataaagagtgaagacccattggtgtactgtattcaggagacacatctcacatgcaaagacacaaataggctcaaaataaagagatggaggaaaatttaccaagcaaatggaaagcagaagaaagcagagttgcaatcttagtttctgacaaaacagactttaaaccaacaaaaatcaaaaaagacaaaaaaggcattacataatggtaaagggatgaattcaacaagaagagataattatcctaaatatatatgcacccaatacaggagcacccagattcataaaacaagttcttagagacctacaaagagacttagactcccacacaataatagtgagagactttagcatcccactgtcaatattagacagatcattgaaacagaaaattaacaaagatattcaggaactgaactcagccctggatcaagtgaacctgatagatatctacagaactctccaccccaaaacaacagaatatacattcttctcagtgccacatggcacttactctactcaatcacataattggaagtaaaatactcctcagcaaatgcagaataagtgaaatcataatagtctctgaaaccacagtgcaatcaaattggaactcaagattaagaaattcactcaaaaccacaaaactacagggaaattgaacaagctgctcctgagtgactccttggtaaatgatgaaattcaggcagaaatcaagaagttctttgaaactactgagaacaaagagacaatataccagagtctctgtgacacagctaaaacagtgttaagagggaaatttatagcactaaatggccacatcaagaagcttgaaagatctcaaatcaacaccctaacatcacaactaaaagaactagagaaccaggagcaaacaaaccccaaagctagcagaagacaagaaataaccaagatcagagtggaactgaaggagatagagacacaataaacccttcaaaacatcaatgaatccaggagctgtttttttgaaaaaaattaatagactactacctagactaataaagaagaaaaaagagaagaatcaaatggacataataaaaaatgacaaaggagctatcaccactgaccccacagaaatacaaacaaccatcagagaatattataaacacttctattcaaataaactagaaaatctagaagaaacgcatcaattcctagacacatacaccctttcaagactgaaccaaaaagaagtgaaatcccttaatagaccaataacaagttctgaaattgaggcagtaataaatagcctaccaaccaacaaaagcccaggaccagagaaatttacagctgaattctaccataggtacaaaaaggagctggtaccatttcttctgaaactatttcaagcaattgaaaaggaggcacttctccctaattcattttatgaggccagcatcatcctgataccaaaacttggcagatacatacacacacacacacacacacacacacacacacacaaaatcaggccaatatccctgatgatcatcgatgcaaaaatcctcaataaaatactggcaaaccgaatccagcagcacatgaacaccatgacaaagtcagattcatccctgggatgcaaggctggttcaacatatgcaaatccataaatgtaattcatcacataaacagactaaagaaaaaaaccacatgattatctcaatagacacagaaaaggtcttcaataaaattcaacatccctttatgttaaaaactttcaataaactaggtattgatagaatatatctcaaaatagctgagcacagtggctcacacctgtaatcccagcactatgggaagccaaggtggatggatcacctgtgttcaggagttcaagaccagcctggtcaacatggcaaaaccctgtctctactaaaaatacaaaaattagccagacatgggggtatgtgcctgtagtcccagctactcaggaggctggggtgggagaatcacttgaactctggaggcagaggttgcagtgagctgagatagcatgattggactccagcctgggtgacagagcaaaactctatctaaaatatatatgtatttattatatataatatatattatttataatatttattttatattgcatttattatatataatatttgtatttattatatataatatttattatatattatatattacacatatatttattatatattatatattacacatatatttattatatataatatatattatatattacacatatatttattatataatatatattatatattacacatatatttattatataatatatattatatattacacattatacatattatatatgtataaaatatatacatatatatttgagatggagatatctatatatataaaataagagccatttatgacaaacccacagccaatatcatactgaatggacaaaagctggaagcattccctttgacaaccaggacaagacaagtatgccctctttcaccacacctattcaacacagtattggaaattccggccagggcaatcaggcaagaggaagaaattgaggatattcaaataggaagtgagaaagtcaaattgcctctgtttgcaaatgatatgatcctatatctagaaaactccatcatctcagcccaaaagctccttaagctgataagcaacttcagcaaagtttcaggatacaaaatcaatgtgcaaaaatcacaggcattactatacaccaaccatagacaaggagagagccaaatcatgaatgaaatcccagtcacaattgctacaaagagaataaaatatctaggaatacagctaacaagggacatgaaggactttttaagcagaactacaaacaactgctcaaggaaataagagaagacacaaacaaatggaaaaacattccatgctcatggataggaagaatcaatatcatgaaaatggccatactgcccaaagtaatttatagattcaatgctattcccattaactgccattgatattcttcacagatttagaaaaagctactttgaaattcatacggaaccaaaaaatagcccatacagccaagacaatcctaagcataaagaacaaagctggaggcatcatgctacctgacttcaaactatactacaagactacagtaaccaaaacagcatggtactggtaccaaaacagacacatagaccaatggaacagaatagagatatcagaaataagattacacatctacaaccatcagatcttcaacaaacctgacaaaagcaagcaatggggaaatgattcccaatataacaaatggcactgggaaaagtggctagccatatgcagaaaattgaaactggataccttccttacaccttatacaaaaattaactcaagagggttaaagacttaaatgtaaaccccaaaattataaaaaccctagaagaaaatgtaggcaataccattcaggacataggcataggcaaaggtttcatgacagaaacatcaaatttcaacaaaagcaaaaattgacaaattggatcaattaaagagcttctgcacagcaaaataaactatcatcagagtgaatagacaacctacaaatgcccattaaaaagtgggcaaagaaaataaacaaacacttctcaaaagaagacatttatgtggccaagaaacatatgaaaaaaagctcaacatcactgatcattagagaaacgcaaatcaaaaccacattgagacaccatctcacaccagtcagaatggtgattattaaaaagtcaagaaacaatagatgctggcaaggctgtggagaaatcggaacacgtttacattgttgttgggaatgtaaatatagttcaaccattgtgcaggagggtctgggattcctcaaagacctagaactagaaataaaatttgacctggcaatcccattactgggtgtatacccagaggaatataaatcattatcttataaagagaacatacatgcacatatatgtttactgcagcactgtttacaatagcaaagacttggaatcaacccaaatgcccatcagtgatagactggataaaaaaatgtagtgattgctggcaagatggctgaatatgaacagcaccagtctgcagctcccagtgagatcaatgcagaaggcgggtgatttctgcatttccaactgaggtacccagttcatctcattgggactggttggacagtgggtgtagcccatgaagggtgagccaaagcagggtggggcattgcctcacacaggaagcacaaggggtcaggaaattttctcccctacccaagggaagctgtgagggactgagctggaggaaccatgcacactctggcccagatactgtgcttgaaccactgtcttcacgacctgcggaccaggagattccctctggtgcctaccccaccagggccctgggtttcaagcagaaaactgggcagccatttgggcagacattgatctagctgcaggagttttttgtttgtttgtttgtttgtttgtttgtttgtttgtttgtttgttttccataccccagtagcacctggaacaccagcaagacagaaccacttactctggaaatgcggctgaagccaaggagccaagtgttctggcttggcaggtcccacacccatggaacccagcaaactaagatctactggcttgaaattcttgctgtcagcacagtagcagtcagattgacctgggacactcaggcttggtggggggaggggcttccaccattgctgaggcttgagtaggcagttttacactcacagtgtaaacaaagcaaccaggaagtttgaactgggtggagcccactgcagctcagcaaggctactgtggccagactgccagatttcccttctctgggcagggcatctctgaaaaaaaggcaggagctccagtcagggacttataaatgaaacccctatatgcctgggagagagcacctgggggaaggggaggctgtgggcacagcttcagcagacgtaaacatccctgcctgacggctctgaatagagcagcagaccttccagcacagtgttcaagctctgctaagggtcagactgcctcctcaagtgggtccctgacacccgtgaatcctgactgggagacacctcccagtaggggctgagagaacctcatacaggagagctctggctggcatctggtgggtgcccctctgggatgaagcttccagaggaaagaacaggcagcaatctttgctgttctgcagcctctgctggtgatacccaggcaaacagggtcaggagtggacctccaacaaactccagcagacctgcagcagaggggcctgacagttagaaggaaaactaacaaacagaaaggaatagcacatccactcaaagaccccatccaaagctcaccaaaatcaaagaccaaaggtagataaatccacaaagatggggagaaaccagcacaaaaaggctgaaaattccaaaaaccagaacgcctcttctccaaaggatcacaactccttaccagtaagggaacaaaactggaaggaggatgattttgatgaattgacagaagtaggctttagaaggtgggtaataacaaactcctctgagctaaaggagcatgttctaacccaatgcaaggaagttaggaaccttgaaaaaaggttagaggaattgctaactagaataaccagtttagagaagaacataaatgacccgatggagctgaaaaacacagcacgagaacttcgtgaggcatacacaagtatcaatagtcaaattgatcaagcagaagagaggatatcggtgattgaagatcaaattaataagataaagcatgaagacaagattagagaaaaaagaataaaaaggaatgaataacacctccaagaaatatggaactatgagaaaagaccaaacctacatttgattggtatgcctgaaagtgacaggaagaatggaaccaagttggaaaacactcttcaggatattatccaggagaccttccccaacctagcaagacaggccaacattcaaattcaggaaatacagacaacaccacaaagatactccttgagaagagcaaccccaagactcataatcgtcagattcaccaaggttgaaatgaaggaaaaatgttaagggcagccagagagaaaggttgggttacctacaaagggaagcccatcagactaacagcagatatctctgcagaaatcctacaagccagaagagagtgggggccaatattcaacattcttaaagaaaagaatttcaacccagaatttcatatccagctaaactaagctttataagtgaaggagaaatgaaatcctttacagacaagcagatgctgattttgtcaccactaggcctgccttagaagagctcctgaaggaagcactaaacatggaaaggaataaccggtaccagccactgcaaaatcataccaaattgtaaaaaatatcaacactatgaagaaactgcatgaactaacaggcaaaacaaccagctagcatcataatgacaggaccaaattcacacataacaatattaaccataaacataaatgggctaaatgccacagttaaaagacacaagactggcaaattggataaagagtcaagacccatcagtgtgctgtattcaggagatccatctcacatgcaaagacacaaataggttcaaaataaagagatagaggaatgtttaccaagcaaatggaaagcaaaaaaagcaggaattgcaatcctaatttctgataaaacagactttaaaccaacaaagatcaaaaagagacaaagaaggccattacataatggtaaagagaccaatgcagcaagaagagctaactatcctaaatatatatgcacctaatacaggagcacccagatacatgaagcaagttcttagagacctacaaagagacttagactcccacacaataatagtgggagactttaacactccactgtcaatattagacagatcaacaagacagaaaattaacaaggatattcaggacttgaactcagctctagaccaagcagacctaatagacatctacagaactttccaccccaaattaacagaatatacattcttctcagcaccacatcaaacttattctaaaattgaccacatgattggaagtaaaacactccccagcaaatgcaacagaatagaaatcctaacaaagagtctctcagaccacagtgcaatcaaactagaactcaggattaagaaactcactcaaaaccacacaactacatggaaactgaacaacctgctcctgaatgactactgggtacataacaaaatgaaggcagaaataaagatgttctttgaaaccaatgagaacaaagaccagaatctctgggacacatttaaagcaatgcatagagggaaatttatagcactaaattcccacaagagaaagcaggaaagatctaaaattgacaccctaacatcacaattaaaagaactagagaagcaagagcaaacaaattcaaaagctagcagaagacaagaaataactaagatcagagcagaactgaaggagatagagacatgaaaaacttttcaaaaagtcaatgaatccaggagctggttttctgaaaagatcaacaaaatagaaagccagactaataaagaagaaaaaagagaagaatcaaatagatgcaataaaaaataatatagaggatatcaccactgatcccacaaaaatacaaactaccatcagagaatactataaacagccctatgcaaatacactagaaaatctagaagaaagggacaaattcctggacacatacaccctcctgagtctaaaccaggaagaagtagagttcctgaatagacaacaagttctgaaattgaggcagtaattaatagcctaccaaacaaaaaaagtccaggaccagatggattcacagcagaattctaccagagtacaaagaggagctggtaccgtttcttctgaaaccattccaataaatagaaaaagagggaatcctccctaactcattttatgaggctagcatcatcctgataccaaaacatggcaaagatacaacaaaaaaggaaaatttcaggccaatatctccgacgaacatcgatgcgaaaatcctcaataaaatactggtaaactgaatccagcagcacatcaaaaatccagaagcacaatcaagtcatcttcacccctaggatgcaagaccggttcaacatatgcaaatcaataaacataatccatcacatgaacagaaccaatgacaaaaaccacatgattacctcaatagatgcagaaaaggcctttgacaaaattcaacaccccttcatgctaaaaactctcaaaaaactaggtattaatggaacgtatctcaaaataataagagctatttatgacaaacccacagccaatatcatactgaatgggcaaaaactggaagcattccctttgaaaactggcacaagacagggatgccctctctcaccactcctattcaacacagtgttggaagttctggccagggtaatcaggcaagagaaagaaataaagcgtactcaaataggaagagaggaagtcaaattgtctctgtttgtagatgacatgattgtatatttagaaaaccccattgtctcagcccaaaatctccttaggctgataagcaacttcagcaaagtctcaagacacaaaatcaatgtgcaaaaatcacaagtattcctatacaccaataacaaacaaacagagagccaaatgatgagtgaactcccattcacaattgctactaagagaacaaaatacctaggaatccaacttacaagggatgtgaaggaccttttcaaggagacctacaaaacactgctcaaggaaataacagaggatgcaaacaaatggaaaaacattccatgctcatgaacaggaagaatcaatgtcatgaaaatggccatactctccaaagtaatttgtagattcaatgctatccccatcaagctaccaatgactttcttcacagaattgaaaaaaactactttaaacttcatatggaaccaaaacagagcctgcaatgccaagacaatcctaagcaaaaagaacaaagctggaggcatcatgctacctgacttcaaactatcctacaaggctacagtaaccaaaacagcatggcactggtaccaaaacagagatatagaccaatggaatagaacagagccctcagaaataacaccacacatctacaaccatctggtctttgacaaacctgacacaaacaagcaatggggaaaagattccctatttaataaatgctgttgggaaaactggcctagccatatgcagaaaactgaaactggaccccttccttataccttatacaaaaatcaactcaagatggattaaagacttaaatgtaagacctaaaaccataaaaatcctagaagaaaacctggacaataccattcaagccataggcatggcaaagacctcatcaccaaaagcaatggcaacaaaagcaaaaattgacaaatgagttctaattaaactaaagagcttctgcacagcaaaagaaactatcatcagagtgaacaagccacctacagaatgggagaaaatttttgcaatctatccatctgacaaaaagctaatatccagaatctacaaagaacttaaacaaatttataagaagaaaacaaacaaccccatcaaaaagtgggcaaagtatatgaacagacacttctcaaaagaagacatttatgcagccaacaaacatgaagaaaagctcatcatcactggtcactagagaaatgcaaatcaaaaccacaatgagataccatctcatgccagttagaatggtgatcattaaaaagtcaggaaacaacagatgctgaagaggatgtggagaaataggaatgcttttacactgttggtgggagtgtaaattagttcaaccattgtggaatacagtgtggcatttcctcaagaatctaaagctagaaataccatttgacccagcaatcccattactgggtatatacccaaaggattataaattattctactataaagacacatgcacatgtatgtttattgtgacattattcacaatagcaaaaacttggaaccaacccaaatgcccatcaatgacagactggataaagaaaatgtggcacatatacaccatggaatactatgcagccataaaaaaggatgagttcatgtcctttgcagggacatggatgaagctggaaaccatcattctcagcaaactatcacaagaacagaaaaccaaacaccacatgttctcactcataagtgggagttgaacaaggagaacacatggaccccgggagaggaacatcacacactgggccctgttggcgggtgggggtgctgcggaaggatagcattaggagaaatacctaatgtaggtaacgggttgatgggtgcagcaaaccaccatggcacatgtatacctatgtaacaaaactgcaccttctgcacatgtaccccagaacttaaagtatactttaaaaaaaaagaaaatgtggtacatatacaacatggaatactatgcagacataaaaaggaatgagaccatgtcctttgcagggacatggatggagctggaagccactatcctcagcaaactaacacaggaacagaaaaccaaagatggcatagttgtcacttataagtgagagctgaacaatgagaacacatggacacagggaggggaacaacacatattggggcctgtcagggggcgagcagagggagagcaacaggataaatagttgatgtatgctgggattaatacctaggtgatgggttgataggtgcagcaaaccaccatggcacacatttacctatgtagcaaacctgcatctcctgcacatgtatcccagcatttaaaacaaaataaaataaaacaatcttataatgaatgtagagccacaaaagaccctggatacacaatgaaatcctgagccaaaagaacaaagctggaggcatcaccctacctgacttcaaaatatactacaaagctatagtaaccaaagcagcatggtattcgtattaaaacagacatatagaccaatgaaacagaatagagaacccagaaataaatccacatgtttacagccaactgatttttgacaaaggcagcaagaacatccactgggaaaaggacattatcttcaataaacggtgctgaaaaaactatatatccatattaggaaaataaactagaccccccccatctctcaccaaatacaaaaattgactcaaaatgaattaaagacttaaatgtaagatcacaaactgtgaaattactagaagaaaacgtagagaaaacacttcagaaaattggtctgagcaaagattttatggaaaagacctcaaaatcacagtcaacaaaagcaaaaatatacatatagtattatatcaaattaaaaagcttctgcatagcaaaagaaataactgacagagtgaagcaacaacctgcagaatagaagaaaacatctgcaaactattcattcaagggaatgatatccagaacatgcaaggaactcaaacaactcaacagaaaaaataataaaccaattctaaaataagcaattgatctgaacagacaattcttaaaagaagacataaaaatgacaagaactatattaaaaatgctcaacatcactaatcattaggtaaatgcaaatcaaaaccacagtgaggtatcatctcccccaggtagaatggctattatcaaaaagacaaaaaaataataaattctggtgaggatgcaaagagaaagaaactcttatacactgtttggggagtgtaattagtaaagcaattatggaaaacagtacggaggttcctcaaaaaattaaaaacagaactcccatatgatcttgcaattcaactactaggcatatatccagaggaaaggaaatcattatgtgaagagatatctatctgcactcccatgattactgcagcactattcacaatagctaagacgtgtgattaacctaagtgtccaccaacagatgaacgaagaaaatgtagtatatatacaaaatggaatacaattcagtcataaaaaataaatacaatcctgtcattggcagtaatatagatgagcctagaggacattatgttaatttaaacaagccaggcacagaaagacaaaacagcatgatctcactcatgtgaagaagctaaaaaagttgatatcagagaagtagaaagtaaaattgctgagaagggtagggaggaggaagtagagggaaaagtcagcaaataaaaaaattcagctgggaaggaggaatacattctagtggtctatagtactgtagggtgactatagttacaataatttattgtattttcaaacagctagaagagagaattttaatgtgccccacacaaagaaatgataaatgtttgaggtggtaaatatgctccttaccttgatttgctcattcagattttatatatatgtgtgtgtgtgcatgtgtgtatgtgtgtgtatatatgtatgtgtatatatatgtatatatatatatatataaatatcactctttaccccataaatatgtacaattatgatgtcaattaagaacaaaaaaactcattttgtccttgttcatcttttctataatagttattttaaagtgtatgttttatacagacaaactccacagtccccagtgctcagtaaatgtctcatgtggaaagcagttttgtgttttgggctccattggattcaaatccatcgtgtcagcacttgtcaccaaaagctccatggaattctctttcttccactacaggccctccacctaggctaaattgatcctcagcctataatctctaatataagactgagaaaacactctcatggaagaaaactgccagtgatctcagctaccctcagaaggactcttccctgcatggagttttagtttatctagtcctctttgctttcacagatctctgatgttttcaaaaatatgattgttttgtaatttatccactattttctagttgttgcagcaggagcaacccaccatattctatctagaaatggaagttttatactcaagtccccacaagttattataataggggcaaatagtgttgcaggacttttccttagatcagctaaagactgggttcttgtctgtcccacggccacaaaaatttagcctcgcagacgatttaaagggtgagtagagcaggggttttttgggtgaaacggggaaaaaaaagggagacagggatcctccgcaaggccagaatcccctgctagagcgcttcccgccagcagttggaatcccaggttccacacaggaagaggaggggccaggctcctccctgctgcaaacatcgtcaacttcccgaggccccacctcaacacacaggctggttggagtttttccagggaccccctcccacctggctgtctcaatagcacacgctagaaaagcctctttggaggagtttctgaacatatcatagggcaagtcaaggcctcaaattcatcttacaaaactcaacatacagtaaattgcaaactgatgtctcaaactataatatgtacaatagctaaatgttgtagaaaattcattcagaagatatttattcaaggcctattacgtacaaagcaccatactaacaactagaagaagagaagaaacaaaaaatataatatagtttctaatctctcaagactctcactagaaaatataaaacaagaatactaataacaaatacaataagtaatggatgctacattcacttggatgaatttcatttaacttatttatgtgcttggaatggagtgctaaatagacttgtggatgcaggattaggtagacttcatgggggaggtgttatttgaattagaaccagaagaaacagcaggattttgatgggaaagacgttccaggtctcttgggaaaaatatttacaaagcctcaaagactaaaaaagaaaaagcatttcaggcagagttaggatttcatgatttatcctggtttcactttaaaaacatcaggaccatctgggaagcttgaaaacataccaatacatgcccctccacctcctcatcatgaccagttagaatctctggaaatgcggcccacatatttttatttttttaatctcccccaaaaattatgatgcacagtaagagttgaaaactactagtctccaatataagaaaaatagaaaaattacactgatattatagggcttttgtcaaaaagtagacaatcttgagtgctaggttgaaatgtaagtgctttattgagttagtaaaggaaagccactaaattaagccatacaataaacctagtggcagagtgccagaccattggtgggtggggggactagaagtagggagaccaattagctattaaaagacattgtaaggacttaaactttagaggagggggtggtttacagaagcaataaaaagaagggaacatattaaatagataagaaattgataaggcagaatagataggattaagaactaactgaatataagcaaagcaagagaaaatagccagtgaatgacagcctccagatttcaaggccagttactaatttacctatgctactattaacacaactgggaggttgagaggaaaacctagggttaccatgcggaggaaatatggcatattatgttttaggaacttggggatttgggtggaaatgtccaggagacatctagaaatttcaaagaaattaaagataaaaatacaagtatgagagatatttactagaggtattcattgaaaatatggttaaaattggatataggaatggaagggaatggaaaagcaagtccagagaggttgtgctcctctcttctcatctacttgcttctttaccccatcaattcttcttccacactctgctgtagtgtactagctaatagtccctaccttcccttccaaccaggagcaggcttgggaaggagtaactataaaggcagcaatcaagtctgtaacttcaagaaaaaagtgaagaatgaagataagggacagaagggcataccaagtaacaagagatgaaagaatacgttttatgcccccagggtcacccaactgaggtggtcatatctaagttaaaatgtatatgtaatgaaacattcataatttgagctagatgagagattgtccatatatttcaaataattttgtctaagagaagtctagtatcttagaagtgagacatgagtcttagaagtgggtgtttttttatttatacttttttatctaagttttatataatcaatatacttttttgagacagggccttgctctgtcacataggctggcatgcaatggcacaaccatagcccactgcagcctcaaactctgggttcaagcaatcctcccaccccagcctcccaagtagctaggactacagatgagtgccaccacaaccaagctaattttttttaattttatgtacagatggggtcttgctatgttgcccaggctgttctcaaactcctggtctcaagcaatcctcccatctcaaccacccaaagcactgggcttacaggtgtgagccaccacggctgactcatcttttttttttttagctagaaatatctataccgttttgcattcacttcccttcccattctgaaccacccttccaaaaaacttttttacaatattggatagaatgctctgctgtatgtcattgcctaaaatcagcctaccagcagggaattcagcaaagagaataacaattctgcttaacagaatccagacggacacatgatcaggaaaacagataaaacatttcagggctggggataacttaagtgttattgagtaataaaataatgtttctagctaatcatcttagcttttcttatgtctgaagaatagcttcatgtacaatggtgacatttaacacaagaaagaatctccaaagatcacctacttttaagcaattaaacatctaagccatccaggacaaaaagtagtctgagctctacatcttcccttgacagcccatccattgttctggagttatgatagtgataaatttcatactatatatttgattgcaaaattgatactacagggacaaggaaaggagagacatttcaagttaagtcaaatctatgtctcagtcactatcctgctgagaagacaaaatcatatccaaaccatatcatgtactcctaaattctgagaaagcttgatttagaagcatggtatgaaaaaatttcttactacaagatcatacctggaagacacctagaggtgtccaaattctcaaaaagaagtaaaatgtaaagttgaacagtcctttggggtatccaattattgccagatatccagtattgccaattggagaggcagccattttctttttacatctaaactgaatagacttactctcctatgaatagacttaccttcaaaaggcaaacacacatcatcaaatgaaatacacaagctacttatccatttctttctcttgtggaacaaaattataaattgtaaggatacccttgattatcaaattcccattcttgtggagtaaagccaaatctttactatgagcatgggcagatcagacatcgcttgaaaacgtagtcaaattttgcaaaagcctgcattcaaagtgacactgcataatggatatgtttgctcttctttggaaattcaaagttgagctctgttgctggcaaagagtaacagagaccaagcattaaataatgaagccacatatcaacatcattcataatttaaggctagaaaatttacctcatttgtaagttgcaattaactggctatatcttaatagttgaataagagcaaagccacataactattaccctttcattactaattggggattaaggttacttatgacacatcattctgtgttccccaacagttcggatgaaatcaccactgctttaatgcaagatattaaatagatgactggtacttggaaaactttctaagtttagtttgtaactgacatgtggttctttgggagatttgccctctaaaagtccaataatgaatcatgtcctcacaagcatttgcttttttaataagcattaattgtttatcaatgctaataattaatcattttttccctttaataatattgctattgattgcagactaggaatgtcacagattccataatggtttacagagtatacataaatacatgaaatcaaagcagttatgatttcattatttaggtatccatgtgggaaaaggcaaaaagatctcagctattaaaagtgctgatgtagttcacatttgtattttcctaacaaacatctagtcccttcatatttcttacattagcaacttggaggatacagaggtgcccttcagagtgtctccacatatcattatcatttctcatgatattcaaaggaccagttctaaggctgtctctccaaagtgttgagagattggcttattttcaatccaagaatgcataatgataggagttacatggaactgccttatctaacattcctaataatataccacaaactatttagctaagatttgttgacttgtcttcttgacaagtcaacacagctcaaagttcaagtcaccaaaacagtaccagccattcaattcaaagcagtattcaacacttccaggtgtaacgtatgaccagatcattctaccatatttaatacaatatgattaacttcatttgtgcctgccaatctagaagaggcaggcaggagcctgtgaaggatcttaagtgaactctcagccacactccccataagtctgctcatatatttagatagctgtgcagatggacatatcataaaatgtgctcatgatgtgaaaatttgccaaaaggaacaagcaagtcctaacttcagcttcaagacaaaggtaggaatgtggatatgatccagggcaatgcagtgctgagcagacagagtggagagacatttaatgattcatctaaccagttggcgttcaggagggttgtaaaggcaccagcccctggcacacttgaatagttgtttcccaccccgtcagcactgcaggcattgagacacgaaagcacaaagcagagagtgagagagtgggcaagtaagacaagaggataattgtgatgttatttggcctctaccttattctgttcccctgaggttagagaaattgtttccttgaactacataagctcatttccttaaagtatatcaagaatatgatattgcattttttggagtcaagtgaaactcttttcaacaaatttttatgccagaattttctaaagttccatcccagtgcatcatcctaaaaatagataaaagtctctttgtatgaaaatactgtttaatgaattatcacccagtaaaaacatttgctggttttttctgatcactttatcagcagtgtaagcaccaaggagtgacttgagaacttcctgcatatacacacattgtctagtagccccttccagtccaccccaaataatgctaagtaaaatcactgaactggttactgaaatatggctacaagaaatcccttgttccctcttcctgtctgaccatccatcccaattatgtcctatatggaaatcctggaatccagaaaaaataatgccttctttttcttctttctctcctcttaccaactccatctttcttaaaagtttctcattccaaatagaaaaccctggccaggtacagtggctcatgcctgtaatcccagcactttgggaggctgaggtgggcggatcatgaggtcaggagttcgagaccagcctgaccaatatggttaaaccccatctctactaaaaagtttttaaaaattagccaggcatggtggtgaacgcctgttgtcccagctactcgggaggctgaggcaggagaatcgcttgaacccaggaggcagaggttgcagtgaaccgagatcacaccattgcactccagcctgggcgacagagagagactccgtctcaaaaaaaagaaagaaagaaaaagaaaaccctaattaatgtctctctaagtctctgctataaagtggtaggcattagtatagaaagaaaaaattagtttagttttttagtggctatatccctaaacctcaattaacatcgtcttccttcctttttcttagtatccatccttgaagagcaagatgcaatataaaatttccattactgttactaatgcatcacatagtgactctaaggttgtaattagttggtagaaaataaaaatatacttatcaggatgggtcaccatgatcgtactaatgcccaatatttcaaaagtgagaccatagttctaagtatttttcagatgttgtctcctgtttgtagctttacctggtcccagtgccctggcaaaatgaatcacctctgtgtcctgatagcactttatttgtaccattaatatatcattttatacattctattggcgttcattatcaatatgttatggttttttctagatcatgacctacttgaaagcaaaatccattgcatatttatctttttatgttcaccttgtcacacaaagtttatcaacacagaagttagcaaaaatgtgttgtgtgaatgaataaaataaatgaaaacaatcgcttatagaaggaacctctatactaaatttgacaatctaggcaacaagttgtcttttgaaaggaggggtagggtgggatttaatttaactaaaaagctgagataattaaaatcaaacatgaagaaaatggagaaaataaataccaatttttttcaaaatcactatgcaagatcagcattgtgcatgaattgaactcatgtatggtgacacattgtctatttaaaggtattcatcatgacggtgataactctgaaagtctgggtctgggagcatgtggcctaaggcttgagcctggaaaagtgaactaacttgagccaacaggtacaatgaactagaagaatccataatagtccatctgccatgcgggtttcatatgtcaatgagccccttggacatggtgaggacccactgagaagaaatgagaacctagtggacttctcaagttaagtcagtctcctaggtaagaagtacctattcccattttggttcttcctccagcctccagcatttgaatccaaatgacaattcacaaagccaagagtgatttcctggcagggaagaaagaaggtggccctaccatgggagccataaagcatgagaatcacctcaattaggtaagtgtgggaaacagacctgacctggacaaaggggtattctgaaaagccacctgaatccaagaaatggcactaactaaaacaaccagatctggatttcaaaacatgtattgtgcagataactcataaactctttttatttataaactttgatttgctcttgcttttgttatttgaggattgatttgtgtgtgattaaattaaagcatttctatactgtatcatcaaaaaagaagaacttcaggaaaatctctattggtcaaaattggtccttcaggatctgaaaactagttcctcagaagagaagacctaaggcctactcttgaagccaagggtgtagaacatacctctttgtttgcttggctccattccagttactttaatgagctgatgctctcatgttggccccttctgccatcctccaatatttgaattcaaatgaaggatcagctgggcatggtagctcatgcctgtaacctcagcactttgggagacgaaggcaggagggttgcctgagcccaggagttcaagaccagcctgggcaacatagcaagacttcatattcacaaattttttttttaattagcctggtgtggtggcacacacctgtggtctcagctaattgggagattgaggtaagagaattgcttgatcctgggagatcaagactgtagtgagctgtgattgcaccactgcactccagcctagatgacacagcctgtctcaaaaaccaaacaaacaacaacaacaacaaaatactacagactcataggcaatttacccactctggacacagtgtcttatcaaacacaagtctcacctctccagaacatggcaggacacatagatttcaaagtcttcaatattttgctcccatacattcaatgaattctcaagaggaactaatccaatgagtatagtttcaagtcaccagctagatatataaccctggtagagaagtcaaggataacagccatgtttcaggcagaataaaactttaagcctctaagacagttttaacaaataagaaatacttttctaagaaactctagaagaaaagatgcaaagtacatgcaagctggaacatgttttcctttagccctttccagaaataagtttattttaacaataactttcatgtgtttttctacagtcagcaataactaaactctccccatgagaatcatccttagtggcaatatcactgtagggatttaggaatcaaacaagtttgttctgcatcttttaatgccagtaaactaaacacaaatactaaatgtgaaagaaaactcttaagctgatttcaaatcacaggcatatgtttggatggaaaaacatactgaggaacaaacacttcaaaggaaaatcctttagaaatggaatcactggcaccaaacccactgcctcttaaattctttgaccaaaaagactgcttcaagactcctcagctctttacccctataaccaaagcaggaatatttggaagcagtcctgaaaccataacttcacttgtgacacaatcccttttccgtaactctggccaaacagtctaactctctaaggaaccaagagtcaagcaacctcttcctcttcatgtaaaaataacttcccaaaggtgatgaattctgatacaaacacaaaactacatcacagatgcaacactgttttcgatcatcataattctatcacttttgagttattattttcttataggctcatttccactttatctttaggattaatgtatatatttgtgtgtgtgtgtgtgtgtacatatactcacgtacatataccaaaaaagcttaaactgaggatttaaaatcaatggtaatttttaaaccacatgacaacaggtttgggagaactttcatcttggattccctttctataagtcaagtatatttaattctgtgtgttcacaaaataagcttggatggaaaaagacaaacagtagaagatgaaataaattctctttcaaaatttttaaagatttttcacacatttaaaatcacaaataaaccattcagacaaaaacattctcagttggaatataaattatacatgcaaacatgaattatacatagaaaagctgttatatacatatatgcacatttctgggtatttatgttcctaataagaagaccataagaggatacaattcccatatctctaggtgccagcagcattgaaatcatttagtaacagataattttcagaagtttttcagaactaatccttttgcatatattttatgtgcattaagttcaccttttattcagtgttataaattagaaaacttgtactcacagactaagaaaagttatctgtgtgctaaatggtttcactattattttctgcacaagagcacagggcattctgtttaactcttgaccagtctgagagaggcagctttcttcttacatttttctctcacatgtgtattcattcatttagatagctccgtcttttgccctggtctctggcaagtctcaggcctgaagaatttcaaaggcatcaaaaaacttagcaaagaacctctaggagccaaatagccaactctagtgttcaagagctacaaatgccttgggtaccaaaagctgcaaggaaaagggtatccaagcagcagctgcattacatgctaaaatagaagagtcacttggataaaagacaaatactttcacaaagcacaggaagagtcccctactaccaccactaccttctaaaactgtctcttgatattcgcttattgcttaaaaatgcaatcactgtcctggaattcatcatccttttccctgcttagataactcctaaagggacaccatgacaggagttctttgtgaacccagtcagataatgtggagtgttggttctacttttgccaagtgaaatgaaaagcgaagaaggaaagtgtatgatgtaagacattcccaatccaggcttgctctgattctccatctcaagactgaacaacaggacagtgcgaagtgataaaaacttaacccattcttgttacacttgtaggttatcacctctaggtcaccattagttcccatgtctcagcaattaattataaaaatggaaaccgctctgacctttggttttccgaatttttgaaaataaaaagaaacagtcttgaaacaatcaagacaaagaccaaatggcaaaagaaatgagttgtttggcaaacatttttgtcagattaacattcatatttttgtccttgtttggtaaaccccagagaaaatcttacatgcacctctcctgcctgccctgtccctttccatcaccttaatctcacccccaagttggaatgaaagtcattcttcctatgtccccataacattttgttcaaatacttatcacatcctgctataactacactataattacatagatgtctcatctgccccactggacagcaaattggtcaagatcatagaatagattgcattccacatttttctttccaatgtaactggcaataaatatgtgttgaattaaatcaaattgaagtaactaaaagcgctagaaatagttgaattcctactgcatgtataggatacttatcatgaatagtctttgaagctgaaaaatacctgtatgtaaagtatgtagcaaaaactgtgagagagtgggaaatgaacctagggtatgacagattaggaatcgcttctttcagagaagaacaaaggattatattcagaagccaagataagcctcttatttatctatgtgactgaaagcctattaaaagcaagattgtgttggggcctttctgaagtaaataggcacaattatagggaaggagtttacagtagtctttaagaatgtgagctctaaactaaaagagtctcctaatggccaaatttgggtatatgagtatttgagctacagagtaattatattaattgaccataacccacagaataaagtaagaatccacgcagtttctgctgataaaaataaaatgatgactcttccttacagtaaaattgcaactaataaatgtagaaggaatgatggagataaaaaaaatcacaaaacagcaaccaccaccactgtagctgtttcaggcaagtatcatcaataaatgttaaaagctggggcaaatgtatgatgagaaacaggaaatttattttggctcaaaatgttatttgacagcaaatgaatgtaacttctttaaaaataaaactacatccagggagtgctcctgaaataatgaataaagaaactgtatatacttgctcttgttcagtgtattttttaaactaaattttcaaatgacaaaggtaaaatagtacatttgcagtggagaaagctgacagcctccagcttaaccaagtgatcaaagttaccaccaccagtgttggataaatcaaaatcatgtgcctctcacatgatgcactgagaagaatacatcacttctacaatacttttgccagaagtttccaacctgaactgaatcatgaggaaacatcagacaaatacaaactaaaggacattcagtgaaataattggccaatattcttcaaaattgccatggtcataaaagaccaaaaaagaatgaggaacttcctagattggatggaactaaggagacatgataactgaatgcagcatgtgatatcctagatttgatcttggtccagaaaaattcctagtggggtaactgtcaaaatttgaataaggtctgtagtttaaataacactattgcagccatgttaatttcctgattttgataatttatatattgtatttatataagttattaacatttggagtaactaagtgaagagtttatgcacattctttgaactctttttacaaaaaaaaaaaaagaaagaaagaaaagctgtggactctagtatcatgctatctaatatggtggccgctagtcacatgtggctataaattgaaatgcagcttgtccaatttgagatgtgctataagcataaaatacacactaattttaaagagttaagttttaaggagttcagtacattttttttaacttatttttcagttttgccctcagggcaaccacacaagtaaataagtcccattattttataatatgtgaagttttgttgttgttttggtttgttttttatttttatatttttaattataaattcacaaattatagttgtgtacatttatggggtagaaagtgatgttatgatttatgaatacaatgtggtttgtgtcatgttttttctaaaagtcaatagtactcacattgaccatatatccttttctagacttggttcttaatggcttaggatttttcaaaagcttcagcctctcccaactaaaagataatcaaaggaatgtgccacagactcagaggggaaaaaatatgttttcatgatggtctaaaaatactttgattaataaatgcattgttgaaatcagtaatagcttcccccaaaaaaaacattttgagagaccatattttagttatgtagattctgaattaagtttctttatagtcagattacattttagacacatttttgtctttgttgtaacctgcaaagcttatgaaccagatgaatagtggtttctgcctttttgtatttgcaacatacaattgctactctttttttatttaaagacacatgcataaaacctactcctaaacatttttaaagcaaatatttcattttatgtttaaatacatttaagttgggtttttggtctctaaagcataaagagtacgtcttgggttcactgggacgactctgggatttcgcaaaacctgagctggaaattacagtcctgaactaagactcaagcaacacaggattatggaaagtcctggtattatttcaagtcaggattttcttccatatccaatttcacccaaagtcgagcattagtcagcctgaacctttcatatagcagaaaggagatttgattaatgtgatttctttgtagaaaaatctaagaagattaaggcacaatgatataggaaaagcatgccctttatcgacatgacattcttcagcactatatagaggtctgaagatctttctcatcattagattgttcacactagctgcatctgaaaaagggaaaaaaatctatcatcaggaaaaactttcaacttttcacattttagtttccatctcacgaacaggtcaacaaatctagaggttggtatcgatttcactctatacacaggaaagggcatttttcaaggaaacatttgcagattacttccccaacccacccaccccacccctcttctagggactgagttttgtgatggtccttggggaaaaaaattagaaccttctagatgatttctgtactcagtgaagcacaatgcaaaataaatccagttggtgtgatttccattaactattctccatctgtgcattctgaaaatctaatactaaccaggaggtatgcttctctgatatgagaaaatgaattcaaagctggtttaaaacatatatatatgtatgtatttatatatatatgcacacacatatatatcaaatgtcatctgcctcttccacttttatatacatttgtgtgaaaaaatatatgttgagcaaaaaagaataaaattaaaatacctttccctagatcctctcaactttcagaatatggatattatactcccactgctttgctcaaatgtagaccatttgagaatgcgatagatgaagaagtaaattactttcaacagatcatttccaaagttgttttctccttggactatcacatgtcaatttgatggatatgaatctgaagatcctgttacaattgaaagggctgcagggtcagaatttactgagcagccttctttgtacatctcagctgcccagctaagacacctcagtgctcacaacttaaagaacccctactgtggcagtcaggggcctcttgatcctgcacttttcttcagaaatctgacaacccagtcaagggtacctaaatggatacaaaaactaccttagctctgggggagagggataaaaactgatgaacctggtatttaatatccatatcctcaaatacaatttacattgttacatgatggcataaacactcaactcctgacttttaaaatgataaaagttttttgttttttaggtttatttaagagttggggtcttgctatgttgcccaggctggagtgcagcagctattcataagcataatcatagcacactgtggcctctaactcctggcctcaaccaatcaatacccctgcctcaggctgctgagtaactgggactgcaggcacgtaccaccacacccagctaaaatacaaatttttgacagtcactgttactacaatcttcacaaccaagtataataagacatagtactagtacgttaattagtcagttacattaaaaactactctcattttgataaattaatcctagtataggtaaaatagaaaaaaactacaacataactcatcatagagaaagtaatatagttatgtgaatagacaggaataactaacactcactatctgttctcaagtaaaaccataagcttttattcttaatatcacaaagaaaagatatataaaaccaaaagttataatacttaacagagaaacaataacaagagtcaaggatgtccttacaatccatttctagtaggttgagccatatgaaattgtcatttttgaaggccaaaagaggttgaataccaggtatttcatatgtttccatctaataataaatactgtactataattcaaattagatctagaatccattcacttctccccatttccaccaccaccatcttccacctggaaaatttcaatagcttcctaactggtccccctgcttccactctcctctgcaatttattctctcttctgcaaccagagtattccttttttaaccttttatttaagcttaacagacattaaaagtgcacaaatcatgagtgtacaacttgatgaattttcacagactcagcacatccacgtgaccagtgcccagaacaaagaatagaatattcacaaaaatggactcatgcactgtgtccttttttgcatttggcttttttcactcaacattatatttaagttgacacattatttcatgttattaggtaccatagagcaacaaattagtcattttccttgctgtataacatcttgttgtaggaatagatcacactttatctatccattccactgttgatgaaccagagtaagctttttaaaatgtaaataagatcaggtaatttcccaacttcaaactcttcacttgcttcactttgcagtggcgctagcccacctgtcctatttaccctgccacacctgcagccccttctcctcacccccatgctccatccacactgccctcctttctattctctctctctgttttccattcctgagatgttctccctagccactatcagtctgtcttctacccacctaattcgaaaccaaatgtatagggctggctctgcctcatccttcaacctcaacagggatcatcttcttagggatggcttccttaaccttcttccttggaatactcccttattctatttcacaccaatctgcttgtttcaccttgacttttcactttatttcaccttgactttcctctgagaagaaaacattaaggataaaatgcctacattatcaatagcagagagaaatataattcagttctttttaaagcagagctccacccaaggggaaaaaagatttactatctaaggtatagccaagcctcaattcatgaaatcaattcagtttaatagaaacatcagtctagctggttttccgacatagcgttaagggtttttttaatgattgacaatttttcatttttcaatatgttactttggcatcatagccagtcagaatgagaattaagtgctccaagaggttcaggatcagagaaatgttgagaccaaagtcctattattccatttccaaattccaaactagatttctaagatgctctgcaatatgccttgtgggttgtttcctgcaggcaaagtggcagtgacttctcacaaaactatagagctccaataacaaaatcctttcagctgaaaaaaaggctgattttataaggaaagtgtttacaatgttttctacaacatacaaatgtttgtacaaagaaaaatgaagcaaagttttaactcatcttttcaaaactaaaccagagtttaaaatcaagctactagaagtaaactggtgcatttatgcaatttgtgagtcctagacatttctagttaagcaaagaaaagtggtgtgtaaaaaaacagtaatgtatttttaaagggtagtagggaaattaaatgtgttcagttgagtttaacttcttcaagaaataagcttcttatgctggtaagaaatgggtcatagcaataaaagtatgctgtaaattcaacttgacaaatgggaaaatgaattcctgagggtaaggcctattaaaagaatatattaatttaatcatgcagtgaatatttctgagtagcttgtatatatgcaagaaactgccttacatattttaatgaggaaaaacatagtattagttaatatagcaataattttttctattactaacttctcagctataatatagaaagatcaaatataaggaaaaaaagttaagcctctatatagagatgcaagtttctaatacttgcttataaacttcaaaattcaataatgtgtcacacccacaacttaaagacatgtgcagagcattagtcatttcagtgaacagaaaagcgacctgcttcttctgcataaaatgtgatatgatgccaccttatggttgaaaattaaaccttatgttttaggatgataaacaattattttcagatgtactttcttagatgcctgaaggaaaagatgctgagtaccactaaacctgtaaaatttacaaatcgaagtgcacagaatcaacttacctctgtgaagaaaacataaaacagttatgatgcaagtgtgcaatgtctggcacgtaggaagagtgcctatttgggttgcatttaggtggctgctcatctgtctgctcattctagttatttttataacaaatctccgttagatttttctagctcaaatcactgttctttacttccaagtttataaaaacaaaaaaagtataaagtgaaactaagcaaaagtttttcaaattcaccacataatttactattaggatgaatcatataaaagttccatttttgtgaatcaaaaattgtccagtatgggaaattccataagattccttctagagttatcttaagcataaatgtgaatttaataatctcagataataaataaccatggtattagtccatcatcaagtgtcagtccctcttcactaaactactggtgaaactcttacacagaagaaacctggctttgtcctttctcaagtacccttcatcaatggcactcctctatgacacaccaatcctctgcttgggctccactgtgccttcatatcttccactgatccaccattcaatactgttccaactttaaagtggggcactgttatcagccaaatttttataatcttggttaattctatttttatttactattgaacaaatccagaaactttgggaaatacagatcttctttaatgcatatcctataaaatgctgcttccaaaattatttgtcatctcagtattgctataaagcctcaattgttcctgagaggataaactaacttccagcctgagagaaacctaaaaagttctctcttattctaaagttttttcttttgtcacaatattattcttccttctcccttctccagtaatgataactgcagttaaaactctcaagtgactttttaaccaaaatgtttagtgctcaactgttgaacccttattatatatgtaggttattctatcttagcagtaaacttgaggggaatgttataggaacattatagaaacaaattaacttgtaaacatgaatataaaattattgcaaaactcaggaaatcaaatgtaaaatgttaatatcagaagaaactgggtgacgggcatatgggaactctgtagtatcttggcaacttttccatatatataaaattatttcaaagcaaaagcttgattaaaaaaaaaaagttcagggaatcagaaccagagtcacaggtattaatttgtcttctctccaacagctttgccagattgaggtttcttttcctcttttgcacatttatttatgtattctatacactcgggcccccttacatcagtaaggaattggagctgtcatcttactccataggagaaaggccagcctggtggctccttgtttgaagttccctgctcaaatgccaatgtagataggggcatgattgctctgtgagcttagccaggtcacttccctctctgcactttgttttcatcttatgcctaaagggacagataatacttacctcccacctctacttgaaaaggaaggaaggctaaaaagttaatctgaacatatttttataaaggaaaaacatttttaagttccagttttgtacataatacagaatattaatatctactgtttttgtcagccttagatagtaagcttcttgaagcagatcctgctctttgattcacaatagatactcttgagtcgcttcacaaataatgatgccaattcttaactcttaagttttcatcctgaaatttcagattaatttagagtagcttttgcagccacccatgagtacattggtgttaatgatgcacccattttcctttcctcaatgtttgctttacttctaatagagcacaagagcctaaaaatctacctttagaacattatttacatcctgagaaaggacttgtgcccagaatcacatgataacacatagaccttgactcaagggccaacttgtactctcccatttggctgccatttcactcctgacgctgtctctgtttaaccttttggcccctcaagagaagtagcagaagccactgaatgaggaatgggggttctcagaagtcactgagattaaaggggtccaccctgcaggaacagcatttctctcttcctaggcagtttttgctgctcctgtcaggtggtaagaagaggagagaggtttttattattattattattaatcccaaactgtcaacttcaaaggaggaatttagaagtttcacaattagaaaaaatacataatgtaatggttgctggtgatgtacacagcctatgttaaggagagagacagagcctaaagattcttaccccagtggagcgccactcggacttatgcatgaggaaatctatttaccatatgttagcttcatgctctcctctttcttctaaggaaaaatttgcttttctgaggacatgacggacttttctttcctacaggcctagataatatattacttagccttgagaaactgagaaatcccccactgtgtcaccttctagagcccctgtcaaccctttgcaactccaagagacaagtcactcctactttccagaaaacattcagaagcaagcaccagcccttccccagaggtcaagcagcagaaagggccttccactgcaggtgtgagagaaaatctgagctcactcctttatcgccttgcttagggctggctgtacaatctcctcatcaaaaaacatagtgagaacaatcagcatatggaaggacccaaatataatcaggatgtgaggatctgacaaagttcaaatacattacaatttagagctgctatgtctagtacgttaaccaccagccacatgcagctacttaaatttaaatttaaataaattagaaacttagttctccagtcacactagccaacagtagctgttgtattgcacagcccagatatagagcatttccatcattgcagaaatctgtactggaaagactgatatagctaacacaggaaaatacattttaattcttcaaatcctactatgtcatcttttattccttttagtaaacatttgttgaacaactacttcctgcaagtcactggacaaggtgcggtagagcatagaaagatgagtatgactgtaagtggccctcaggacctttgagatttagaaatctaagataagtaactatctataagatagaaatacataccgtagagaaagaacaaccaaattgttgtgcttaaacaagtagaaatgtatgcaaccatttcacactgagcttcagcagtcccagaattccaagataacaagtactgtcctgactgagaagctgcacatttccatgctgtcggttccatggaaacagcatttggatgtgttccatcaaaactgctttgaaaaatggtccaaagcagaatttacttttgtgagaaaaaaatacaaaaaacataagaggcaccacatgctaatggaagtagcacaagatttggagtcagaagatctgtttgagagccagccttatccttgctacctgtgtgatgctgggtaagccacttaacttctctgggcctcaggattctcattttcaaagtgggaaaaataatccctaccccatatgccccataagggaacactgtaaaaataattaagatactgaaagcacctcagaagcagtaggatgctatattattattaccacagaaagtgacatgaaactttggaggacatataaatccataactgcaagcaagtaaattttaaaggcatgtggaaggttcaagttctacacagtgaatataatcaaattctcaatctggggatttttcttagatttaagagcacaaacatatactccctgagcacctttatctcttctacagggaccacagccaggccaagttcactccatcttcatcccagaggataatttgcctcatgccagcatgaaggacaccatagcatcaaggatgaacttactctgaatgacaaataattaaaacttcctggctagaacaagtcaaccactgaatgggaaaattgtatatttttgttgttgttgtttgcttgttttgttttgtttggatatggacaatagaatggatcagtaggatcattgctatcctgtacaaatgggaggaaagaaggtcttggaacaattgctagatatgtgttctgttgatttcatgaataattacaataagaatttcacactttgtaatcacaagcttttgagtctgtccgtgaaaatgctaaatgcttctgtaaacgtaaaatgataccacttttactttcctgcaactcccagcaataacatgggatgatttctgtttcagcagagtgtgtgaccagaattggggttttttccagatgtgcatagaatggtttcaattacctagtgccatgccttaatttttgagcatccccttgaacctattgggtttggcagttccagcaaaagcatggaactgtggaaggggctgtccagccattcaagctatggtttcaccatactcaccatgtactggcaagaactagcgtgtaatagaatagaaatgcttatgttgggatgcaaggcaccgaatagcataaattctaaacaaggaggtctaaggttaaaataataaactttaaatgatgtatgccacatgtgacattttggttccagatgtaacaaaaccaaaccaaagtcttttgctagacaattctaaaacaatattactctcctaggtttctgattctgattttgcccagttgctcacagattacactctggcaaacttggagacaacacaatactgtttaaaatacacatgctgggaaacctgcatgatgatctgcactaaatcatccctggattctttgttactgtggtcacttaaccatttccacaaatgtggcatggactttttcttctggagaaaaattttaaataatcactataagtaagtagtacagtgaactctctccctccttgaataaaacaatagtcatttgttctaaaataattggccacttatcccatatctcagcaatttatagctcaactgtctaaaactgaaattgcaacattttaatagcaaattacagacttatcagtcatggaagagtccggaagtgggttccaaaaagtccaaagtttggtatacatttcataacccagttgaaagatccaatagtcttttcttcactatttcaaaattctattttttaattattttgaaaactttgaagtacatattctatcttgaaatgcttcaacatttatatccttaagctctggagtataaaacaatcacgggaataactattatttagtttggtgtctatcaccatgtctttgtgaggaaggtaagttattgataaccttacttcattgtattataataaggctaatatggtagccaggaatggtggcatgcaccagtagccccagcaactcaggaggctgaggtgggaggatcacatgaccccaggagttccagatcagtgttaacatagagagaccctgtctcaaaaaaaaaaaagaaaagaaaaagaaaaacaaaggctggtatgagacccaagatcacacatgggattatcaatgaaatcaaacaatggtgagtatcttgggacccgaagtccaccttatttgaaaatatagtgatggctaattactttagttaaactacataataggtaaatttgttataaaactactatatgagattgccattccaagatggctgaataggaacagctccggtctgcagatcccagcatgatagatgcagaagatgggtgatttctgcatttccaactgaggtacctggttcatctcactgggactggttggacagtaggtgcagcccatgaagggcaagccaaagcagggcggggcatcgtctaacccagaaagagcaaggggttgggggatttccctttcctagccaaaggaagccatgacagattgtacctgaaaaaatgagaaactcccacctaaatactgcacttttccaatggtcttagcaaatggcacaccaggagattatatcctatgcctggctcgacgggtcccacgcccatggagccttgctcactgctagcgcagcagtctgagatcgacctgcgaagcagcaccctggcagggagagggacgtctgccattgctgaggcttgagtaggtaaacaaagcagccagggaagctcaaactgggcagagcccaccacagctcagcaagacccgctgcccctgttgactccacttctgggggcaacgcatagctgaacaaaaggcagcagaaacttctgcagacttaaatgtccctgtctgacagctctgaagagagcaggggttctcccagcacgtcgtttgagctctgagaacagacagactgcctcctcaagtgggtccctgacccccctgtagcctaactgggaggcacctcccagtaggggccgactgacaactcatacaggtgggtgccctctgggacgaagcttccagagaaaggatcaggcaacaatgtttgctgttctgcagcctccgctggtgatacccaggcaaacagagtctgaaggagacctccagcaaactccaacagacctgcagctgagagacctgactcctttttttttaattttattattattatactttaagttttagggtacatatgcacaatgtgcaggtttgttacatatatatacatgtgccatgttggtgtgctgcacccattaacttgtcatttagcattaggtatatctcctaatgctatacctccctcctgccccaaccccacaacaggccctggagtgtgatgttccccttcctgtgtccatgtgttctcattgttcagttcccacctatgagtgagaacatgcagtgtttggttttttgtccttgcaacagtttactgagaatgatggtttccagtttcatccatgtccctacaaaggagatgaactcatcattttttatggctgcaaggtattccgtggtgtatatgtgccacattttcttaatccagtctatcattgttggacatttgggttggttccaagtctttgctattgtgaatagtgccacaataaacatacgtgtgcatgtgtctttatagcagcatgatttataatcctttgggtatatacccagtaatgggatgtctggatcaaatggtatttctagttctagatccctgaggaatcgccacactgacttccacaatggttgaactagtttacagtcccaacaacagtgtaaaagtgttcctatttctccacatcctctccagcacctgttgtttcctgactttttaatgatcgccattctaactggtgtgagatggtatctcattgtggttttgatttgcatttctctgatggccagtgatgacaagcattttttcatgtgttttttggctgcataaatgtcttcttttgagaagtgtttgttcatatccttcacccatttgttgatggggttgtttgtttttttcttgtaaatttgtttgagttcattgtagattctggatattagccatttgtcagatgagtaagttgcgaaaattttctcccattttttaggtagcctgttcactctgatggtagtttcttttgctgtgcagaagctctttagtttaattagatcccatttgtcaattatggcttttgttaccattgcttttggtgttttagacatgaagtccttgcccatgcctatgtcctgaatggtattgcttaggttttcttctagggtttttatggttttaggtctaacatgtaagtctttaatccatcttgaattaatttttgtataaggtgtaaggaagggatccagtttcagctttgtacatatggctagccagttttcccagcaccatttattaaatagggaatcctttccccattgcttgtttttgtcaggtttgtgaaagatcagatggttgtagatatgcggcattatttctgagggccctgttttgttcctttgaactatatctctgttttggtaccagtaccatgctgttttggttactatagtcttgtagtatagtttgaagtcaggtagcatgatgcctccagctttgttcttttggcttaggatagacttggcgatgcaggctctttttttgttccatatgaactttaaagtagttttttccaattctgtgaagaaagtcattggtagcttgatgcggatggagacctcactctcagaaggaaaactaacaaacagaaaggaatagcatcaacatcaacaaaaaggacatccacaccaaaaccccatctgtaggtcaccaataacaggctctgaaattgaggcaataatcagtagcctaccaaccaaaaaaaggccaggaccagatggattcacagccaaattctatgagaggtacaaagaagacctggtaccattccttctgaaaatattccaatcaatagaaaaagaaggaatctttcctaactcattttatgaggccagcatcatcctggtaacaatgcctggcagagacacaacaaaaaaaaaggaatttcagaccaatatccctgatgaacatagatgcgaacatcctcaataaaatactggcaaactgaatccagcagcacattaaaaagcttatccaccacgatcaagttggcttcatccctgggatgcaaggctggttcaacatatgcaaatcaacaaacgtaatccatcacatagcagaaccaacgacaaaaaccacatgattatctcaatagatgcagaaaaggccttggacaaaattcaacaggctttcacgctaaaaactcaataaactaggtattgatggaacatatctcaaaataataagagctatttatgacaaacccacagccaatatcttactgaatgggaaaaaactggaagcattccctttgaaaactggcacaagacagggatgccctttctcaccactcctattcaacatagtgttggaagttctagccagggcaattagacaggagaaagaaataaagggtattcaattaggaaaagaggaagtcaaaattgtccctgcttgcagatgacatgattgtgtatttagaaaaccccatcatctcagcccaactgagctaataagcaacttcagcaaagtctcaggataccaaatcaatgtgcaaaaatcacaagcattcttatacacccataacagacagagagccaaattatgagtgaattcccattcacaattgccacaaagagaataaaatacctaggaatccaacttacaagggatgtcaaggacctcttcaaggagaactacaaaccattgctcaatgaaataaaagaggacacaaacaaatggaagaacattccatgctcatggataggaagaatcaatatcatgaaaatggccatactgcccaaggttatttatagattcaatgccatccccatcaagctaccaatgactttcttcacagaattggaaaaaaccactttaaacttcatatggaaccaaaaaagagcccacattgcctagacaatcctaagcaaaaagaacaaagctggaggcatcatgctacctgacttcaaactgtactacaaggctacagtagccaaaacagcatggtactggtaccaaaacagagatatagactaatggaaaagaacagaggcctcagaaataacaccacacatctacaaccatctgatctttcacaaacctaacaaaaacaagaaatggggaaaggattgcctatttaataaatggtgctaggaaaactggctagccatatgtagaaagctgaaactggatccttcccttacaccttatacaaaaattaattccaaatggattaaagacttaaatgttaaacctaaaaccataaaaaccctagaagaaaacctaggcaataccattcaggacataggcatggacaaggacttcatgactaaaacaccaaaagcaatggcaacaaaagccaaaattgacaaatgggatctaattaaactaaagagcttctgcacagcaaaagaaactaccatcagagtgaacaggccacctacaaaatgggagaaaatttttgcaatctactcatctgacaagggctaatatccagaatctacaaagaacttaaacaaatctacaagaaaaaaaacaaacaaccccatcaaaaagagggcaaagcatatgaacaaacacttatcaaaagaagacatttatgcagccaaaatacacatgaaaaaatgctcatcatcactggccatcagagaaatgcagatcaaaaccacagtgagacaccatctcacgccagttagaatggcgatcattaaaaagtcaggaaacaacagacgctggagaggatgtggagaaataggaacgcttttacactgttggtgggagtgtaaactagttcaaccattatgaaagacagtgtggtgattcctcaaggatctagaactagaaataccatttgacccagccatcccattactgggtatatacccaaaggattataaattatgctactataaagacacatgcacacgtatgtttattgaggcactattcacaatagcaaaaacttggaatcaacccaaatgtccatcaatgatagactggataaagaaaatgtgccacatatacaccatggaatactatgcagccataaaaaatgatgagttcatgtcctttgcagggacatggatgaagctggaaaccatcattctgagcaaactctcacaagaacagaaaaccaaacaccacatgttctcactcataggtgggaattgaacaatgagaacacttggacacagggtgaggaacatcacacactgggtcctgtcgtggggtggagggctgggtgagggacagcattaggagaaatacctaatgtaaatgacgagttaataggtggggcaaaccaacttggcacatgtatacctatgtaacaaacctgcacgttgtgcacatgtaccctagaacttaaagtataataaaaataaataaataaaaataaataaaagtactatataatacaataataaaatattaaaatacccatgagaaagtcagcaagactgttcctaaatcacagggttattgtatgctaggtggctaaatgcctttttacttcttcagtaaaactacttaaaggcaaaataatataccattaaagcacaagcagaagtggagaaataaaaatcagatgcaatccaggtatatccagatgaaagctaaagaaagcaatgcactgtgagagaaaagccaaagggagtcaaatgaccacagaatttcagagctgaaaggatctgagagctcacctattctaccccaacattttacttaataaaaataagaaaaatgagccccacgtaaggaactggcttaaattgagaacacagttggaaccacaatcaacttccctcctcctctttaaacaatgctttttctactagacccaagtcccaagtcttcagttccagttctggccataacactgaattgtctatggaaaacactaggcaaatcacagaatccttccatatctctgatttctcctccgtaaaagcagaataacatcaaccacttatcgtcttcataagacgattgtgcaatattatgttgacaattcacataataaagtcatacactcaaaagaataaaaacaaaacatcaaagcaatgttttttaagattatttgaagttacatgtggatatgaaattctcaaagttcagggccttaaataaggctggagtcagtaaatccacaatccagtcataaaacaaagatgtattatactcctgcaaatgcttttccaaagttatccaagtcaaaataatcatggagaagaaaagaaaatcatggcacctaaattaataggcactagacatttgaaacaaggaattgaaataagtgtgcaaatttaaattgtggaattttcctttgtgttcttctcatagttattcacgatacaggcaatatcatttgcaagcaaagataaacattctttactgatgccaggaaacattctttgcagcaaaaacttactaatgaatatcttctcaccagtgggctcctatctcctaccaagaagaaaaactaattatttttcttaaatttgtttcaatttttagattatattttctacattaagcaaaaaaaaaagactgaaagtctatgagccctttaaatcatattttatcacaattttcttcacttaatcatattataggaggagagagaccattcttgatatgtctttatgaaagatggcaatatgttatcacttttcccttcaaattatattgaagatattggcatagaaatagattattagcttattctattataattaatgtgtttatgatgactaaagaaaataagggttctatgtgatcctgtgatttcagttataaccaatatacacaaccagtaagttctttaaaatcaaggttgatcagaaatgaccccatcacgtaggcctctacagtattggggggatgggggggttcctttttttatcttagatttatcttttattttatttttaattgctatggatatataatagttgtatgggtggaggtagggtttgttttgttgtgtgtttttgagagggagtctcactctgtcaccagcctggagtgcaggggcacaatctcggctcactgcaagctcctcctcccgggttcaagcgattctcctgcctcagcctcccgagtagatgggactaccggcgcccgccaccacgcccggctcatttttgtatttttagtagagacggggtttcaccatgttggccaggatggtgtggatatcttgacctcgtgatccgcccgcctcggcctcccaaagtgctgggattataggcgtgagccaccacgcccggccagggtggactcttaaaggtagagaccctatggtaaagtaatggagactaaaagtgggaaaggacttctgcttctggcaacaacagagaaacttttcctcttaaacaaccatagaacttgacaagacatatgaaataactgttttcagatgtcagacaatgggcaaaatctgattcctgagagaaggaaaacaaacaaggtgagcctagaagcactttacaaacctctgtatcgggtgctgatgaaacagagatcagaattcagggccactgagacagctggaatgcagaggacatggtacaggagaggaaagggttgtgtaatctgtttgtacaaatacataattccaagttgagaaaagtgatataaatgaatggataagagatccaggaatctgcataggagaccccttgagtctttggctgaatactatgcaagagacgtgttaaacaagactccacaaagccaaggaaaggactacaggggagctgtgggctgaacaactatcagaggtcccccagcccttggaaatgttcaaatttcaacgtgtctaagtggcagcctcagtaaacactctctgagcattcaacagaccctagaaagaccatgccttaggaggaagaccactatagccctagtaacggtactctacaacacctgccctaacaaagtttgaaagacaagcctcaaaacgatcatactaatggctgtttgccaagcataccatgtaaacccctaagtaatacagggtgttgactacactgtttgtcattaagcgatggccagtgtgtatttacactacgctaggtcaaactatcttattccagatctgcaagcaaaatcctaagtgaccaagaaatgaactggatgaaaaatacatgtggactctgtgttttctcttatgtggtatttttcaaaaccaagtcagaaggtctggtttgcaaattctgcacattcttacgaggaaatgtgaaattaattagtggagttcattaagcaagcttgaaacttttctcggtatcttcacaaatccctcaaacactcatttgcacacctaaactcctttctcctaataatactctcttttacagtgtgcattggtgcgaggcaatgtgctgagttctttacatgcatcatctcatctcaacaactctatgaggtgggattaatattactcatatttacagatgagaaaacagaggcttgaggaggtttggtataatgtgctaaatgtcataccggatggaggagtgtttctaacccacagatgcaggattccaaagccaaccacttattcacattcaaccaatactgaggttgaacatatggaatctactctcacacactctcagaatccgttcccacacaaaaattcccacaaaacagcaatcaggtaagtaaataaatgccagactttcctttatgcttcatgcctggttccttcctattccagacagctggagcaaactaaattgtataaattcttgttttgatatgggcatgagtgaggggatatggtagcatttttaaattatggggtctgaataactttgttgtggtatttttatcagaaatggcaatttccaaaggaggccaagttctttgatacactctgctctaacctctcatctataattttactctaaacataacttgccctattggtttggctaataattcaaagatgctatagacattcctaaatgtttagaccttcatgaaagacctgactcctacaaaggctcacaatgtaattttaaacaagtcagtgattcttcctgggcctcagtttctttgactataaaataagaactctgaactacattggcatttcctgaatttcataccacaaaataccagtgctaagagatactcctctcaaaaaaaacgggttccaggtcaaataaataggagaaaagctacaaacaacaaccccatttaaagattcataatccattaacaagggataacctgttagcatattaaaaccccagaaaagtcctacagtaaagaaactttaacttcatttaatctcaacatttccaaatttattggatctgaaaccatttcctatggaaaaaaagtgtataagcatctcattggaagtaaccatgtattgattacctaccatgtgccaggacctgcactgggtactgcagtgtctctaatatcatattacatcaggatatcacagtatcttaagtgataccaatataatttatgagatatattatatatgggtataatataatattataccaatataaattatatgggtataatttataatataattatacccatataattagtatcacttaagatgatatttgaagaatgagaagaggtctgctataaagggcaggggaaggtattccaggcaaaataccagcatctgtgaaaacctcagggtatgaaactgcttaacaagttaagagaattgaaaggacagtgagacagatgaggaggtgactccaggagggactggagaaattggcaggggccagacatgcaggggttctgggccatataaaagaggttggttttactctaagtacaatggaaagtttaaactgggaagtcacctgatagaatgtttttctgtttttttaaccaattttattgtgtatatattaagtttacaatataatgttatggaacacacacagatagcaaatggttactataatgaagcaaattaacatacctatcatcttacatgtttactttctgtgacaaaagcagcaaaaatctacctaacaaaaatccctaatactgtcacaggattcttcgggtgtcacttcaccagccagaaacatctgtggccagtgacgcctttgcccaagttttgctcaggcctgctgggctcattccacccacttgacctgccagactgcagtcagctcatgcttctggcctggatcccatgcctgccaagggcaagcaaggcacagagcagtgaggggtgtatgagtgagcgtggggtctaactactgcgcacagccaggcacactggcgactgcgggacatgcagctccaggcactggcacaggcgctggctccctgcaagcctgcagctggaccaggtgtactgcaagcagcttccatggctggcactgggaaacacggtggcacctagaagcttggagacaccagaaaccgcagagccctaaagagggtgtcacagtcatggtgcagatagctcctaggtctgggctccctgaagggctgcagctcttcattcttctttccttcttcttacccacaacatggcaagcaaggggtgtatttcagccctatttgtgttacagctcttttagccccaccattcagtgagtcccaagttcttgtcctgcatctaggaagaatgaggtacacagacaagtggagggtgagcaaggtgaagaggagttttattgggtgacagaacagctcagaggagacccacagagggtagctcctctccacagccagggtgtcccagtgagtgttcagctctgagcagagaggagaccctggagtgaggagctcctctctccacacaggttgtttcgtcatctactcagctctcagcaaaagggagactcttgagcaggtagcttctctccgcagctagccgtcccattgtatcctcgtctggctgaatccagggcttttatgggcctcagaggggagaaagtgcacactgattggtccatggacagccatgagcaggcccagaaaaagcaccacaagttcccacttcagtacatgggactggcagcccagcccctaggcttcagaccctccccagcttgaagttggggcttgtcaggggacccacccccttccacccaggagcctgatgcctcctgccactgttcatggtgcccaggctgctcatgctaagggacacctgcaggccagcaccaaactgccctcagcccctccttggcctccctcccatgctcatcagtgcccaaagtccagagggggtgaagcagcagggggctggtgtatcagtgctaccccgagcgtgcacatacccagctgggctgtgacaataccaaggctcagccccaaccttgctctgaaatcagagcaggcaccaggagcagtgagagtccagacattggaagcagacaccctgagcctgcaggggcacgggagccttcccaggcccccgagagtgcagagatgcccaggtctgcagccgcaacttgggtagctgcagctgtgcccagaagagtggggctcctgcctgcttccagcccttgctggctccatggaacatgcagccccagcagagcctcccacactgcaaccagcatcatggcagcagccactccagatgggccactgctgccatcaatacagtacaattttattaactttagtactcatattgtaccttagatctctaaacttgttcatcctacgtaactgctattttatagcctttaacctacatctccccatttccccgcctcctcccctccactcatggtaatcactgtttcattttctaactctgtgtatttgagcctatataagtgtgtgtgtgtgtgtgtgtgtgtgtgtgtgtgtgtgtgtgtattccacatataaaagtgagatcatgcaatatttctctctctgcatctagcttatttcacttagtataatgtcctccaggtccatccatgttgtggcaaatagcaggatttcattctttttaaggctgaataatattccatcgaataggccaggcgtgctggctcactcctgtattcccagcactttgggagcccgaagtgggcagatcacaaggtcaagagttcaagaccagcctgaccaatatggtgaaacctcatctctactaaaaatacaaaaattagctgggtgtagtagcacgcacctgtaatcccagctactcaggaggctgaggcaggaaactcgcttgaacccaggaggtggaggttgcagtgagccgagatcacaccgttgcactccagcctgggtgacagagcaagactctgcctcaaaaaaaaaaaaaaatcccattgaatatatacacatatatatatataccacattttctttatccatttttctgtaaatggacatttaggttgttccatatcttggctattttgaataatgcttcagtgatatgggagtgcagatatctttacaaggtggtcatgtagtcccatttatttatttctgtttttgttgcctgagcttttggtagaatttgttttttaaaaggtcaccctggctatcctataaagaacagcttgaaggggcagaatacttcggaagaacaaaaagctgtattcattttgattgctactgtaataaatggccaaaaatttagtggctttgacaatagcaatttattaatatacagttctgtaggtttgatgtctaatatgggtctcactgggctaaaatcaaggtattggcacagctgcattcctttctgggggctctagaggtgaatcaatttcttgattattcagattgttggcagaattcagttccttgtgtttttagaactgaggtccctgttttcttgctggctataaattgagggccattctcagcttctataggtcactgatattccttagcttgtggctgccttcctctgtcttcaaagtcagtaacagtgtgttgactctttctcatgcttccaatgtctccttccatttcatttgtctgattcagccaagaaatgttttttgcttttaaggatgcatgtgattaaatcagacccaccaagataattccgtataatctcattatctgaaggtctctatccttaaatcacattgacaaatcccttttgccatgtaggataacatattctcaggttctgagaattaaggtgttgacatctttgagggggtaggggaaacagcattattctgcctaccacaaaagctgtgttagcagttctaagtgagagatgaggccaattcgaccagtgtggtggcaatgagaaaaggtagacagatttcaggtatgtttcgaagacagaaccaattggctggttggtgatcctataggtggacgagtgggtacaagaggagggaatcaaggctggctcctaaattcctggcctttcaggctcatcagctgagtgtcagggaatgcctttcaaaaaataaagaagtctgggagtgaaaccaattttagagaaaaattcaagagttctgttttctatgggacacacctagagaaacattaaccagattatctctgggatctcttaccactttaacattctaagaagtcactaaaaatattttctccattcagaagccattgtgccacaatttttataactaatatctattcctattatcttaggcaatataatatatatccaagagtaacttgttactgactcaacacatcctttgaagtcgaaggaagctcagtatgttatctattactgtgtaaaaaattatcccaggccaggcacagtggctcatgcctataatcccagccctttgggaggccgaggcgggtggatcacctgaggtcaggagttcgagaccagcctgaccaatatggtgaaaccccatatctactaaaattacaaaaattagccaggagaagtggtgtgcccctgtagccccagctacttgggagactgaggcagaagaatcacttgaacctgggaggtagaggttgcagtaagccaagatcatgccaatgtgctccagcctggacgacagagtgaaactccatctcaaaaaaaaaattagcccaaaatttaacagcttaaaacaatagtttctgtgggccaggaatctgaacatgatcctctgcttcatggtctctcatgaggctgtaatcaaactattagccagtgctgaggtctcggttgaaagttcaactggggaagaatccaatctcaaactcaattaaggggttactggcagtattcagttgcttgagtgttgtaccgagggcctcaattactttcaggctgctgaccagaggccaccctcagcttcttgccatgtggacctctacaccatggcagtttatttcatcaaagctagcaagaaaaagaaagtctacaaacaagtcaccatattttataacctaattatggaaatgaaatgcccccaacattgtcatagtctatgagttagaagcaggttacttaggaggagggaattaaataagactatgaataccaggagaccggaatcattgggagccatcgtagaggctgtggaccacacttggggtttgaagaactcaaagaagagataaaggaaaatgaaagtggaaagggaaagtgagaaaggtaaccttcatcttctcaattttttagggctgcaatcttaaaacagtatcctcagccagtagagtgctccctgaagaggtgattaggaaactagttaagaggtagaaaaggatagcctgagaaagattgcaagtcagtttggcagtaacttctaaagattatagctggaaaataagattaggacaagttatttttaaatatttgcaattcaaaattaatttactaaaaaaagacttttagcagaattggaacaaaagtacaagatgtaaaaaaaaaaaagtaatattttgaaaaacacactaatcagttcccagcaataataataaaaatatagtaagtaatttctaatggaaatctcttaaaaacagaatgcttcattccattattgggtatatacccaaagaaaaataaatcattctatgaaaaagtcatatgcattcatatgtttatcacagcactatttacaatagcaaagacatggaaccctaggtgcccatcaacagtggattggataaagaaaatgtggtatatacacaccatggaaaactacccagccataaaaaaaaaagaatgaaatcatatcctttgcagcaacgtggtgcatctggaggccattatcctaagcaaattaatacagaaacagaaaaccaaatacctcatgttctttctcacttacaggttggagctaagcattgggtaggcatggacacaaaaatgggaacaatacatgctggggagtactagaggggagcaaggactgaaaaactatctgtggggtactatgctcagtacctgggggacagtatcattcatatctcaaacctcagcatcacacaatacacccatgtaacaaacctccacgtgtacccccaaatctaaaataaaagttaaaattatttttctaaaaaatagaatgcttccaaatcctgccattttgtacattatctcacacgttgccttttttaaaaaagcagaaataaggggaagaaccacttccctgatcttcttaagaagcatctgtgcctattaccatggtcttcctttttccctttctcttttcatttctttgactttaagattacttgagtattactttattgaactaacagtcttataacttcaattgtaaaaaaatcaataaaagtagatgaatataataataataatataacaatataggtttcattagttataatcaatgtaccatattaatatgttaataatagggtaaactgggtgcagggtatatgggaattttctgtactgtctttgtattttttgtaaatctaaactgtttttaaaataatgtttatatttttatgaaaatttcaaaataaatactattcatagaagtggagaaaaagtagacaactcaagtgttctaatttcctttccatatattggcaacaactcttcattgcattggaataggtgcccaggctggggcttgatattatgaggactgctctgggacctcgcctgcaacaggaccctcagtggacagaatacagactgaggtccagagatctgaaagcacatcccatgtttagaaaacccatttaactcctcattccctaagctagcagtctgaaataataccctagggaaacctttctagaaaaatatctaagaaatgataaaagctgtatgcacagatctgttgcattatttacaacattggaaaaattagaagcaactaagtattcaataataggagtatagtcaattgccttatggacagtctactcactgagatgttatatagccattaaatgattatgaagatagtgtcacatgagagaaaaaggttattatatacttatgatataagatgggtgtttttaaatcaaaacacaaaatgcacatagtatgtaagtgtaacttttttctatgaccatccaaaagatccagattattaatcttataaataactcccttcctttagggtgtcaaatacatattacacaccaggcagtgttctttttctacatgtaccatatcttgaaagtggattcttgacacagagttatagtaagtactttaaataacaggtaatacaatctgacccacattggattggagagtcatctggatgggcaaactgactggtaaggtaagcagaccctcttcccaaatagcagcatgtacttcttttccctaagttatgctttagtactaagagaaaaattattattcaatcatccattcagcaaacattttttgagcatctactagatgctagatactctgtgaaatgctggtaattcaatggttagcaaaatttatatggttcttgacctcatagaatttatagtctagtgggagatataaataaccccacccaggagttgtgttcctactatgaaaggaaatacagagtgctatgaaagaatattatcaaacgacatggtttagatggagaagcatttttgctcaaagatacagcacacatcaagcactgtctttgtgggctacaatgctgaggacaaggcaagtcttttattttaattatatttaaattctagggtacatgtgcacaacatgcaggtttgttacatagatatacatgtgccatgttggtgtactgcacccattaactcatcatttagcattaggtatatctcctaatgctatccctccccactccccccaccccaccacaggccctggtgtgtgatgttccccttcctgtgtccatgtgttctcattgttcaattcccatctatgagtgagaacatgcggtgtttggttttttgtccttgcgatagtttgctgagaatgatggtttccagcttcatccatgtccctacaaaggacatgaactcatcctttttatggctgcatagtattccatggtgtatatgtgccacattttctttatccagtctatcattgatggacatttgggttggctccaagtctttgctactgtgaatagtgccacaataaacatacgtgtgcatgtgtctttatagcagcatgatttataatcctttgagtacatacccagtaatgggatggctgggtcaaatggtatttctagttctagatccttgagtaatcgccacactgtcttccataatggttgaactagtttacagtcccaccaacagtgtaaaagtgttcctatttctccatatcctctccagcacctgttgtttcctgactttttaatgatcaccattctaactggtgtgagatggtatctcattgtggttttgatttgcatttctctgatggccagtgatgatgagcattttttcatgtgttttttggctgcataaatgtcttcttttgagaagtgtctgttcatatcatttgcccactttttgatggggttgtttttttcttgtaaatttgtttgagttctttgtagattctggatattagccctttgtcagatgagtggattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttacccatgcctaaggacaaggcaagtcttaaatgtctattcacctcattcacaaagatttacaataaagtcctgcaagtcctgctgtaggtcttccaagcaaagatccatgaaccacctaacttctcaacttgcccataatttcactaaatgctccagcttcttagaaacattctcatctcatgtttcctagagttggcctcacatttaatcttggaaaagatttttctggccactacaggcccaaattccttatttttttcactcttctaatgagaggtagtggggggagggaggaaaaacagctacagaaatgctaggcatatagaacatttatagctagtctacctggcatcctacccccttcctctggcatgacgctgataatcgtttggggacctagtccttccgcactctcagcctgatggactggataaggcaaccttcccagaaccatgggtgaagtacacaacttagcccaaagtcagcccaggcatcattcaggagcaagcattggccaatccaatgggaagcacatctcagaccttgtgctcagaatagtgagatatggaatcttgctctatttcattggttttaaacctagcaggattagctctaggaactgctgacagccatcttgtaattataaaaagagggcctgcctgagaatagattgaacacacaaaaagctatgctgagagatggaaaaaaaagaaatagaccctgataacagtttgagctccagactccaggccagtttttccttgcatgtcctacatctggtccatggaaaatactcttggtatttgcccaacaaacactggaaaaagaggccacccaacaaagacacatctccttcactcctggtgtcagaacagctaacagactggtctccatctcttagattttccttgtaatcatcagacactagtccactatgttcctttaaccacagagggcacatatcaaagttctccatgccacctattaaatctccttttctcttgacttgagatgaagaaataagcaccctcccaattcacctccttggagatgataggacttagcacaactctttccaaaaaaaaaaaaaaaaaaaaaatccttacaaatcttgagataatctctactctctcaaccctttcatgacctttaagtgggtgagggattcaagaatcacataaccagttcttagtttactcctttggaaattctacatacaaactgcctcctgctttagaatgcaacattaactgtatccttggatcttggaagaaacttccattttaacattctgttacaaatgtgaacatcacctatcacatatttcacaggggaaaaaaactgaaaactgcttcaatgttttcacatttcctacagattccaaaatgagaagcttgaccctgaaataattgtaggtgagaaccaagttcatattttcagtatgtggggaattttgaagggtttagaggaaagcaatcaagatgattaaggatatgaaaattaaggataaaggaattacagtctcttaaaatcaaatgtttaactatagtcctcctatataagaattagtacaccccagtgtaggttaccaagctagttcatctaaactcataacaagtttgacttggctataagagaaattgcctaaatcttggcagaaagaattattaactattttaatgagttaccaatggaggccatgcatcttcctttggggttttttttttttaaaaaaagaagagcctcgctttagggtagtttagcagaattattaaaaagtcaaaaaataacaggtgctagcaaagttgcagagaaaaaggaaggcttatacactgttggtgagagtgtaaattagttcaaccatggtggaaaacagtgcagtgattcctcaaatacctaaaaagagaactaccattaaacccagtaatccccttgctgggtatatatacccaaaggaatataaaccgttctatcataaagacacatgcacgtgttatgttcactgcagcactattcacaacagcaaagacataaaatcatcctaaatgtctgtcaatggtagactggataaagaaaacgtagtacatataaactctggaatactatgcagtcatttaaaaaaatgagatcatgtcctttgcagtaacatggatgcagctggcagccattatccttagcaaactaatgcaggaacagaaaaccaaataccagatgttctcactttataagtgggagctaaatgatgagaacaaacagacacatagaggggaacaacagacacaggtgcctactggagagtggagggtggaaaaaggaagaggatcagggaaaataattaatgagtactaggcttagtacctgggtgacaaaacaatctgtacaataaacccccatgatacaagtttacctatataacaaatctgcacaggcacccctgaacttaaaagttaaaaaataataaaaataaagtaatttagcagaaatcttgctctaaaacagggatgtgatcactttaatacatcgtgaaccttctgaatgtatggccatcattgattctcccactcaggtttcttccagtctgttattggtgtcctttgctctgatctcctttcgtttattctgtgtacctcctgtttcccaacatccagtacaaggtatttctgggaggcagtattcctgggagtgatcttctgacaactgtttagaacagtttagaacaagaagtgaagacaaattctccatccatgactgaaacacaacactataccttgatctatggttttgaaaggctttgagatgttttctcatttgtgccacccacggaatttccttctaaagtctgagcttggttttcatatcctatagaattctgcagttggagaaagccttcaaaagttgtaagagtctgccaatttctggaaggtttttactggctgcaagttatgattgtaattatctacgtgctgttcagtttagcatgccaagagatatttctaaaatgatctccctctggttttgcagggttatctagaataataatgtaaaaaccgcacaacagtgtgggagacagaagataaggtcagaggaaaataggtcaagcaacctaaaaaacagtgaataaagacttctatgcttttgtcacacatattctccccctactcttcaactatggtatgtattatccctgcatattggctttccaactgtggttaaggagttctgatgtgtgtgtgtgtgtgtgagagagagagagatctcacatatatgaattgctggcaagcgagacatgtctccaaacctcaatgaaggaaaaaaaaatattttggaggaaagaaactgatatttgtatatatagctagatacctatacatcacactctcagcttactatttctttcatcatcctgagtccctgcagcaaatgtatgcccagcaccacagaccatttttttctctatctcaggaattctggtttattccatacatggaaagtgaaccatatcacgagtttgcaatgtaaaaacttcatgtgtagggaaatgcaatgttcatcattgtcttcagcagaaccaaacaggtcacatgggagagtacatttaagaaaacttaaatgataatgtattgactgagaagattaaatgatccaacctgatatttctgcaagacctaatttaaagggccaaggtgtcattccagaaaatcaagtttaaaagaaaaggggcttatttttataatccgtctttcctcagtaaggttgatttttatagccacaggcttctcagccagctggtgtgtctaatgatgaccctgaggagacaacaacatgggtctacatttctccatctctatttgcaaaatgcagccaaattagttctagaagctgtctgggaaggggactcttcccaaagaggctgatactcaactctctggtcagcaacatcctccagaaacgggcagacagcctacaacccaatacccccaaaggagcaaaaatggtgccatgaaattccccctcagtctaggaagaaggaaaacacatccaccaccctattaaacagctcagattttcattaatactcagaagtcccagggttcctttctgaacctcagctgcctcgtctataaatagaaaggcttgctcaatttgtcccttcctgctctaacatgctgcgattctgctccctgacctaacaatttctgttccaccatacacacttttatgatcccttcccctgcatttctcttttctactgccagccacagagccaggctctcatacccagtaggacacctctctgatttattaagccaaaagccatataatctctctgcctttctaatacactgttttagctttaggctgaattgaaaaccaaacacttaagctatagaacacaaaattcaccaaaaatgtatctcatatcaaaagcacagcaataagtctttgttgatcctgctgatcttccaagtttctattcaatttctctcctttttgccaaatttaattatatggtctacatgacatcatctctcttactgtcactaaactgtcaccaaatcccttcataaacacctgatgagacttcctctgacaacactccactgaaatatttctcttgaaggtcactaattactaaatctaaatccaaaactgattagcttttctcagtcctcattattctccatccttttccaacatttggcacaatgatctatttttgaaaaattatttcctcccttagattctgtgacaccgtattatccaggtgttcccttctgtggctgctacttctccgtctccttcactggttcaacttttgtctgctagatttttccatttttaactctatacctaattcctctaaaaaaaaatgcatctacttccatgtcttcaattatcatctctatattgataatttacaaatagacatctgtgactttcaagtctgtagctctgagctccataggtttggtgactgagattacttccttaaatattctgtcctaattttcaaatcagcatatccaaaggggaaggctttaccttcccagcctttaagccagttgctctctacaacttctctatttggtcagtacaaacaccattctagagacctggaaacattcactttacactttatttagtaaatatgaactgattaccgcttttattccaggcataatactaaatactaggaacacaaagataagacaaagtccttgtccttcaagggtttcctcctctgcttgctgtactgcgtattattccatgatcccttttatttgagctcatattttcccctaaatcatcactccttcgacttgcactctttctgcccattatacctctcttggcctccttacttatactcaaaattcaaagcaatacttcatttcttcttcttgcttcatatactattggtctctaggttctatcaaattcccttcataatattattcttactcaataataaacatttactgagtgtctgccaaatctgatcactgtgctcagcaaggagaatacaatgataaacaagacacaaagtatttgccttcagtgacttcagagtcttatataagaaagataaaccagctggtcatggtggctcatgcctataaacccagcattttgggaggctgaggcaggtggatcacctgaggtcaggagtttgagaccaggttggccaacatggtgagaccccatctctactaaaaatacaaaaaaattagccagaaaaaaaatagcaaggaaaggaaaggaaccaatcattacaatgtggcagggtaggtgttaacgatgtccctaagaaggaggcccctaacctgacttggcagactcagatcaggcttctcaaagaaaatgatacttgagctgagctgtaagtatcatgtggtatgagcctatcagactggagccttcttgacaggacaacagcagctgattcagtagaactgaagtatgagcacatggagtgagaagtgagagatgagactaggaaagtagaaatgaatcacctcaacatacaggtcattgtgtgttatgggttgaactgtgtcccccaaaagatatgctaaagtcctaatccccaatacctgtgaatgtgaccttatttggaaaagttaagatgaagtcattaggtggagccctaatctaatctgactgttgtttttataagaagaggaaaatgtcatgtgaagacagagacacagagataaccccacatgacaacggaatcaaagacagaagtattgaagctgcaagccaaggaacacctgggttaccaaaagctagaagaggccagaaaggatactctgttagcagcttcagaggaagcatggccctgtcaagaacttcattttggacttctggcctccagatctgagagagaatttcggtcattttaagacaccaagtttttggtacttggttatagaaatataagctaatacagtgtgcaataccaagaaatgtacattcacattcatttttatgccccattccagcacttggcataaaaattcacctcacatactgatcaataattacctggtcaataaaaaagtacttagtttccacctccatatcctcctatctaaattgctctattttgactattctaagattaaaaaattgtacagattttaatatctctaaaataggcatataccctacagtctatagcatcttaccctcagtgatgtcctacaattgctgctggtccagaatgaaactgagttctccaagttcttccaaatcttccagagaggatttgcctttgtatctgtcaggtccaatagcactaccaccctgaaacttgtttaaattaaattatctgcttgaggcttgtgttgttcttggtggtggtggtcctgtattggtgctagtttgtgtcttgtgtgtgtgtgtgtgtatgtatttcattctactctggtagaatagattcagatcacaaatctgagtaagaattgattaacagttcaaattctcagagtattctattcccttcacataataccaaggttataattataaatataattatataattatatagaattaagttatttatataataattaagcataacatcttgttgttgcccctctatgcatgttaagtttgtttctcattttctcttaaatggaaatctaagccctctggtgtctcaggtctcggactaaaaatcctatcttgggcacattttcttacttagcaatacataaaataatatcatcttccaaatgatggtgtcttctgtttgctaaaatatggtaccatgagtacaccatgtcctttccaatctgctctgtgttctctgttggactaatgttcctaaaccagggctgccataacatcacccctatcaaattcctataatagttccttattctcctgaaacaagtctaaattctcaagaatcaacaatatggaggagtaaaaaattatataaacttgaacaaataatttcgcttttaaagcctgtttcccgtctgtaaggtggacataagaatgccgagatcacagaacattagttatctgttgctttgttttattaaccactctaaacttagaagctgaaaacaacaatcatttattttgctcagaaatctgcaatttggacagaggctcagtggtaaaaacttgtctccacaccatgtggcatctgttgggaagactcaaaggctaggggctagaatcatctgaaagctcacccactcacatgtcttgcaggtgatgctggctgttggcttggcctcagctggagtctcccattgtgactgcttggcttactcacagcatggtggctgagttccaagatcaagtgtccccagataaaggctgtatcaccttttatgacttagccttggaagtcacactgtatcacctctaccatattctattggtcaattcacggctaagattagaatagattcaaggggtagacatagactccatctctcaatgggaagagtgtcaaagaagttgtagatatgttttaaaacatataaggttttacaaataccacatgttctaacttataagtgagagctaaacgtagagtacacatggatgtaaaggagggaacaataaatactggggcatatttgagggtggagggtaggaagagagtgatgattgaaaaactacctatcaggccaggcgtggtggctcactcctgtaatcccagcaatttgggaggccaaggcaggtagatcacttgagatcaggagtttgagaccaggctggcaagcattagtgaaactccatctctactaaaaaatacaaaaattagctgggcatagtggcaggcacctgtaatcccagatactcaggaagctgaagcaggagaatcgcttgagcccaggaggcggaggttgcagtgagccaagatcgtgccactgcactccagcctgggtgacagagcgagactccatctccaaaaaaaaaaaaaagtatcgggtattatgctcattacctggatgacaaaactatctgtacaccaaagccctgtgacatgcaatttactcatgcaacaaatctgcacatgtaccccttgaacctaaaagttggaaagaaaaataataacaatttttaaatatgtaagattttaataacgttaaataaggttattgggaaaactaggcaagaaaacatacatgaagttcctagcattttacaacgcccaccccgactccctacccattcttcataaaatggccaagtttagactgtagactcaaaatgcatggtgaatcttggtttcccccattcactgggttgttgatcttagacaagttatttaatctctccattcctcactcaatctgaaaaatgcaggcataatattactttccttgtggggctatgagggttaaatgagataattactgtaaagcacttagcacagtgtctgtcactattgttatagttttttgttgttgttgttgtgttgttgttgttactgttactgttattgatgctgctatcatctatcaaaacattgtacaaaaaagtccaagggcagggcaagtagaggaggaagctgagtaattaagagaagggtcaggtagctaccagttggtctatgacacaggtatcaggactaccaagcagggtctggggcaagtagggcagaacaagagcacaggtgagaaagctgcattaaatcaggctgtcagggcagggaggggctggcaatgacatcggaatgacattggatgatctattctaaagtggctaatcatgggaccaaagtctgaatagaagaaagagaaggtaagcaaggtaccatttattggtgccagagacaacaaacagcgagaacaattgtccaaggagttatggggaagagatccccttccttcctgtccccttttaaagcagttacagactttcattgtggactcagccaattatagggaggggaaggtgaatgtcaaatcccacagggctggattctgtcttcttcaaactgggagttcttcaattctatttctgaaaggagtagagctgtttctggggaatacaattcctataatatccattctgtgacctagtgtgtcctcttaaatgtcatcccacacaccatgacattgcccatgttggttccctcacttgaaatgctttccttcctggaattacagaatgagaggtactttagagggcatccgcttcaacctctcagtcaagactgacttctctcctgtgatgttcctaaacatctgtgatcagcccagccttttgcgggagggagagcggtgagatgcggtcttactattttggccagggtggtcacaaactcctgggctcaagcaattctcacaccttagcctcccaagtgcctgggaatacaggtgcatgccatacccagtttccaggctctatttaactacagcccatgaagtaactcatccctcagttaagcagcctgttccattaatagttctaactgcagtgtgatgaggagggagcatgagccttgtacttgggttcgaattctaccttcaccattgatgacatttgtaagttttcctctctaaattttaggcttctgttctataaaataaagatgacaattctatctccttaattccacaaacggcgagaactttatttttttcactgttctattactagacttagaacggtacttgcaccataatcagtctttcataaatagttcctaaatataatgacagttatgataatgaaacaaaatgaggtatagaaagctgctagcatggcgctagctcatggtaggcactcaataaacagttctcatctcactgtgaatcaaaatttgctttctaattacttctaccacttaaactcagttctaaccccttgatgcaacattcaagaaatgtaattccatttctactaagaacccatcaaatatttgaagacaattacaaagccctatgaaattttgttttttctaaacaaaagttttgttttgtcataggcagaaatttagatagaaacacaaatatatgtgtgtgttttatatacatttacgaaaaaacaaaacttttttataatttcaatagtcttttggggaaaaggtggtgtttggttacatgaacaattcctttagtgatgatttctgagattttggtgcacctacctctcacctaagaagtgtacactgtactcaatgtataatcttttctccctcacctccctccaccttttcccccagagtccccaaagtccattatattattcttatgcctttgggttctcatagcttggcccccacatatgagtgagaatatacaatgtttggttttccattcctgagttacttcacttagaataattgtctccaattcaaaccaggttgctgggaatgccattaatttgttcctttttatggctgaatagtattccatggtatatatatagatatatagatatcaattttctttatctactagggctggttccatatttttgcagttgagaattgtgctgctataaacatgtgtgcgcatgtatctttttcatataatgacttcttttcctctgggtagatacccagtagtagaattgctggatcaaatggtagatctacttttagttctttaaggaatctccatactgttttccatagtggttgtactacttacattcccaccagctgtgtaaaagtgttccctttgcaccatatccacatcaacatctattatttttagattttgtgattatgccattcttgcaggaggaaagtggtatcacattgctgttttgatttgcatttccctgatcattagtgatgttgagcaatttcctatatgtttgttgtccatttgtttatcttcttttgagaattgtttattcatgtccttagcccactttttgatgggaaattttgggtttttttcttgctgatttgtttgagttccttatagattctggatgttagtcctttgtcagatgtatagattatgaagattttctcccactctgtgggttgtctgtttactctgctgattgtttcttttgctgtgcagaagctttttagtttaattaagtctcatctatttatctttggtgttgttgcatttgctttcggatttttggtcatgaagtctttgcctaagccaatgtctagaaaagtttttccaatgttatcttttagaagttttattatttcaggtcttacatttaagtctttgatccatcttgagttgatttttatataagttgagagatgaggatccagtttcattcttctacatgtggcttgccagttaccccagcaccatttgttgaataggctgttctttccccactttatgtttttgtttggctagtctaagatcagttggctgtaagcagttgggtttatttctggattctctattctgtcccattggtctatgtgcctatttttatactagtaccatgctgttttggtgactatagccttatagtatagtttgaagttgggtagggtaatgcctctatatttgtcctttctacttagtcttgctttggctatgagggctccctttttgtttcatatgaattttaggatttttttttctagttctgtgaagaatgatggtggtacttttatgggaattgcattgaatttctagattgcttttggaagtatggtcattttcacaatattgattctacctatccatgagcatgggatgtgtttccatttgtttacattgtctattatttctttcagcagtgtttcatacttttccttgtagaggtctttcacatcctggttaggtatattcctaagtgttatattgtatttacttatgtatttatttatgcagctattgtgaaaggggttaagttctggatttgattttcaggatggtcactgttggtgtacattaattttatatcctgaaactttgctgaattcatttaccagttctagaagctttttggaggagtctttagggttttctaggtatacaatcatatcatcagcaaacagtgacagtttgacttcctctttactgatttggatgctctttatttctttctcttatctgattggtctggctagcacttccattactatgttgaatagaagtggtgagagtgggcatccttgtcttgttccagctctgagggggaatgctttcaacttttccccattcagtataacgttggcttttaatagatggcttataatggatggcttttattacattaaggtatgtcccttctatgccgattttctgagagttttaataatgaagggatgctggattttgtcaatgctttttctgcatctattgagatgatcgtatgatttttgtttttaattctatttatgtggtatatcacatttattgaaatccacttgatcatggtggattatctttttgacatgctgttggattcagttagctagcattttgttgaggagttttgcatctatgttcatcagggatattggtcggtacttttctttattagttatttcttttcctggttttggtattgggtgatactggcttcatagaatgagttagggaggattccctatttctctaccttgtggaatagcgtcaacaggattagcaccaattcttctttgaatgtctgatagaattcagctgtgaatccatctggtcatgggctttttattgtgggcaattgtttaattatcatttcaatgtcactgcttgttattggtcttttcagagtttcattttcttcctggtttaaccaaggagagttgtatatttacaggaatatatccatctcctctatgttttctagtttatgtgtgtaaaggtattcatagtagccttgaatgatctgtatttctgtggtattggttgtaatacttcccatttcatttctaattgagcttatttgtatcttctctctttttttcttggttaatctcattatggcctatcaattttatttatcttttcaaagaacaagctttttgtttcatttaccttttgtagtttttttgtttcaatttcatttagttctgctctgatctttgttattcttttcttctgttgggtttaagtttggtttgttcttctttctctagtttcatgaggtgtgaccttagattgtctatttgtgctgtttcagactttttcatgtaggcatttaagggtatgaactttcttcttagcactgcctttgctgtatcccagaggttttgataggttgtgtcactattattgttcaactcaaaaaaattttaatttccatcctgatgtcattgctaagccaacaatcactcaggagcagattatttaatgttcatgtatttgcacggttttagggttccttttagagttgatttccaatcttcttccactgtgatctgagagagtacttgatataatttctattttcttaaatttattgagacttgttttgtggcctatcatatggtctatctcggaaaatgtttcatgtgctgatgaatagaatatatattttgcagttgctggctaaaacgttctgtaaatatctgttaagtccatctgttgtagagtttaagtccattgtttctttgttgactttctgtctttatgacctgtccagtgctgtcagtgaagtattgaagtcccccactattattgtgctgttttctatctcattccttaggcctagtagtaattgttttatatatttgggagctgcaggttaggtgcatacatatttaggattgtgatattttcctgttgaacaagcccttttatcattatataatgttccactttgtcttttttaactgctgttgctttaaagtttgttttctctgatataagaataactactcctgctcacttttgcgtgtctgtttgcatggaatatctttttccacccctttaccttaggtttatggaagtccttatgtgttaggtgagtctcttaaagacagcaaatacttggttggtgaattcttatccattcagccattctgtatcttctaaatggagcatttaggtcatttacattcaacattagtattgagatgtgaggtactattctattcatcatgctatttgttgcctgagtaccttggggtgtgtgtgtgtgtgtgtgaatgttttacaggtcctgtaagatttatgttttaaggaggttctattttggtgtattttgaggatttgtttcaagatttagagccgcttttagcagttcctgtagtgctggcttggtagtggcaaattctctcagcatttgcttgtctagaaaagactgtatctttccttcatttatgaagcttagtttcactggatacaaaattcttggctgataattgttttgtttaggaggctaaagataggaccccaatcccttctagcttgtaggttttctgctgagaaatctgctgttaatctggtaagttttcctttataggttactgatgcttttgcctcacgctcttcagattctttccttagtcttgacttcagataacctgatgattatgtgcctaggtgattatctttttgtgatgaatttcccaggtgttctttcagcttcttgtatttgaatgtctagatctttagcaaggcaggggaagttttcctcagttattccctcaaatatgttttccaaacttttagatttctcttcttccccaggatcaccaattattcttagatttttgttatttaacataatcccaaacttcctggaggctttgtttattttttaacttttttcttcgtctttgatggattgggttaattcaaaggccgtgtttttgagctctgaagttatttcttctacttgttctattctgttgctgaggattttctgtgtattttgcatttttgtaagtgtgtccttcatttccagaagttgtgattgctttttatttatgctatctatttctctggaaatttttccatccatgtcctataacatttttaaaatttctttgagttggtatttacttttctccgaggcctccttgagtagcttaataattgaccttctgaattctttttctggcaattcagagatttcttcttgatttggatccattgctaatgagctagtgtgatcttttgggggtgttaaagaaccttgttttgccatattaccaaaattgtttttctggttccttctcatttgggtagactacatcagagatccagtgttcaagggctattgttcagattcttttgtcccatagggtattacctggatgtgggtgctcagggatgaggcttcatgagagccaaactgtagaggttgttacttctcttctggatctagctgcccagcagagctaccaggctccaggctgctactggggagtgtctgcaaagagtcctgtgatgtgatccatcttcagttttctcagccctggataccagcacctgctctggtagagatagcaggtgagtaaagtagactctgtgagggtccttggttgcagttttgtttactgtgctagttttgggtttgttggcctccagccaagaggtggcactttcaaaacagcatcagctgtggtactatagagaggatacaggcttaccctagtgtcacctggaaaagtttctcaggtagttggtgtggccatacagctcccaagagattatgtcctttgtcttcagctaccagggtgggtagagaaagaccataagtttggggcagggtaaggcatgtctgagctcagactctcctcaggcagtgcttgctgaggctgctgtggggaatgggggtgtcattttcaggccaatggagttatattcccagggtgattatggctgcctctgctgcatcatgcaggttgccagggaagtggaggaaagccagcagttacagcccccacctagctctcacccagctcccacacagcccaaaaggccggtcttactttcaccgtgccaacccccccaacagcaccaggtttatttccaggcagtgggtaagcagggctgaggatttgtcccaggctccaggccttcccgctgggaaagcaagtagggctttcaggtttcatgccttcctgcctgccacaacttctgtgctgtttctgcgctcccagttcaccctctcacccagattctgtccaggaaacttcatgtttggttgaaattgttacaaagttcagctggaggtttccttctccctgtagtctttccccaattccactggtatcccttcccaaggacccctgtgagacaaagtcagaaatggcttccctgggaacaaagagtgcccacatgctcttcccactgcttcgtctacccctgtatttcactcagctctctatgtttatctcagctccaggtaaggtcaaatccttctcccatgatctggaccttcaggttccccagtgaggatgtgtgttcaggggcagacgatccccctttcacaccttcacactttgggcactcacagttttttggatgtctcccagagcctgcacttccttcaaagggtctgtggattctctcgactttcctggtgtattcctgcactagttcttggagcaaaagttcacagtgtgagtctccacacactgctctgtccatccaagtgggaggtgtaagttagtcctgccacctatccatcattttcctcacaaaacttttgaaaaactgtttgaactttggaaactactgaacaataaaatctatatttgttgtgggcttgccctaataaaagtttgtaagtcacttttaattcctttcttaaaaataattgcatagctaataatccttgatgtttaaccaactgcagaacttgaattgtcaatatttttatagtatctatacctagaaaggcttatggaaaacaataaggaaacagctgttttcaagtcctcattagaacttaattttaggaatctttacacattctgatgcaatttttactctagcagcctaactaccatgtgtattttatgaaactccaaatgttggcattttatcctgtatttgagaaaaagcattaaataatttattttacacttctttcaagttttacctgcttagagtctaatagtctttctttaaaggcaacagagaaacatcatgattttttaaatgagataaatgttccaatggcaaatacactataaccattattctgctactattcataagtgtttccctactacacagccagtgtctggtacaacaggaaactgttaatgtgattttcatttgttccttgaatatctccagctgaatatgtgagattttttttccttaatcttggtcctatttagtttgggaggttttgtttatttctttgattttcagttgtggtggggtttttttagctaagatatagcaaataatgttaaaagatggattttgatgggtataattttttcttaatgaaatctacaaaccaagtaactgaatttttaaatcagccattctggatatcttctgctagtgttttaaagcctcagatatttaggtggaaaagtctagaaagaataacattatataaaaggattcaattataatcaacatttttcttgtcgcccatatactcacttcttcccttgcccagcctaaattccacagtcaatcactaaagcattgtcctgcatgacactcaattccctactccactctctcttctcttagtcacttggcaaaacttcaaccctcattaaattctactctgtctgctctatgtggctgattgatctcactttaaattcatgaccactaaaccccagtgggcccactatgctactttgtaatcacagtatatttcctattcaagtaattgtcccactctcctaggcaactgcctcataatctctcctcaatcttctagcaccttctcctttatcctcactcttagctgataaccttggttcctatttcaattaaagagccaaagagattattttaaaacatcagtcagatgcttacaaccttccagtggctccttccctctcatagtaaatgccaaagtctttacgatgacctgcatgacctgacactattacatctctgatctcatcttctatacttacccctcttttattgctccttccttattgacccctttgttgttcagttaatacattaagttctctcctacctctgggcctttgcacctgccatttcctctgcctagaacgctcttcccctgtatatatttttatggctcactcctttgcttcctttctctttaaatatcaccttctcaatgaggtctcctctgacccttttatttaaatttgaatcccttcattcaccctggaactccctctacccttttcctgctttattttttgccacagcacttatcaccatctgcatactgtatgctttactcatttattttgttttttgcctatatccatctactagaacataagttttggcctatgggccagaattatagcctattttgtccactgttgaaactctagcacttgaaactactttatacctactgggtgcttaagcaatatttgttgaatgaatgaataaataaaatacctttattaaaggaggtgtgtcgaaacttcacctgttggcttgctagtttatgtcaggttgttctctctgtaatcgttaaaaacaagcacttaaatccacatttgtatttggtcagtaaaattacaaaaataatcttacttttaagattaagctgtgaacaacgctgtgtccagcaggaacatctgtgagccgtttcctttgcccagaaaaagagagttgctgttgtccactctcagtgatatctcagaaataatggcttgtagctcaaagatgctttctctctttttacaaaaccataagacccacaaaaattacattagagccaggatttgcttaagtcccactcacattaaccattattactcacctccctacaagagtacaaaagtaaccaaatgttcccttcatgttagtcaaagttttttgttttttgctttttggttttttcagacaaggtctctgtcacccaggctggagtgcagtggtatgatcacggctcaccacagccttgacctccagggctcaagcaatactcccacctcagcctcccaagtagctgggactacaggggccttcgtgttagccaaagttttttatttttgttttttgagacagggtctctgtcacctgggctggagagcagtggcgtgatcttggctcacagtagtctcgacctcctgggctcaagcaattctcccaactcagcctcccaaatacctagaactacaggcacacaccattgcacccagctaatttttgtattttttgtggagatggggtttcaccatgttggccaggctggtctcaaactcctggcctcaagctatccacccatctcggccttccaaagggctgggattacaggcaggagccacgtgcctggcccttgttagtcaaaatgacatccctaggcattgtgtgtgtgtgtgtgtgtgtgtgtgtgtgtgtgtgtatgtgtatgtgtatatatatatatatatcttatctccaaaatgtattataccataaatcactcaaagtgttttcttatgtctatttttaaagatagcattacatcgtatagatctatattattaatacatacaatctggggtgttgggttagagattttaattgaatagtgattcagggaattttgtgaaggaaaaaaaagtgagatcaattttccccttgcagactttagtaggtaatactaatgtcatatatcttacttgctttataaatcatgttttaagttccctattacatctaagtatttagaaaaacaatccaccaaagcactgggggaataaaccctcaaattcaaatcattaaaatgaaatctgtctctgaatgtttgaaaggatttacagtaaaaatatcagtttgatattgtcaatgaaaggtatcattcatgaacctgaaggaggaaaatggcacgcagagttgggaaactttacaaaatttaaagctgctataagggcaagggacttgggagattattaatttgctgtagctaaattcagatacaagcttttctttgttatttgacttctggtgccatttttttatcgtcaaaattaaccgagtaacagccactagaattttttatttaaatttattagctgcataagctagctaaaaatatgaaagttttaagacaaattagttgatttgaatgtcaactacaatgacagggcctgcttgtttttcattacactgctatgttgcatttgataaccatatgaaaagtagctaaattgttgtgccttctacacaaaacatcgtctgttgattccagaatatacagagctacatggggaaggcagtgtgttgagctgagagaggcagcttctgccttcttatagcacttacagatggagccatccgattcagccaccatcttccattacttatagttttgtgggcacacatcttatctccccaggactgtacctagagcagttctgggagtttcctatttcttctaataggctataacttccttaagattaggaccatgactgagtcacctttataaatctcacaaaaccagttacattaaaggcatggatgcctatgttcccaattaaacaataagcccttgaaaggacagaacatctagtctgattaatcttaagtacagtgtcttaaacctagttggcaataaataaatattgactctattttgaataaattgctgaagaatgaatgaatgaatgaatggcaaatactctgcaaccccttgataagtgatagcaaggaatactttctgtatagcaaagcaactttgtagtccaagcccccctatctctactacctcctccaaagatggaaaaatcagaactacctgtgcttcagtaacttcaacataactagtatcattattttcagaatttaataaagtataacattcatgtcctagagctactgcctcaagctggtaagatggaaaagatcaaattctctagcattttaatgatttttttttttagacggagttttgctcttattgcccagctagagtgcaatggcaggatcttggctcactgcaacctctgcctcccgggttcaagcaattctcctgcctcagcctaccgagtagctgggattaaagacgcccgtcaccacacccagctaagtttttgtatttttagtagagacgggggttcatcatgttggccaggttggtcttgaactcctaacctcaggtgatccgcctgcctcggcctcccaaagtgctgggattacagaggtgagccaccgtgctcagccaggcattttaatgactttttaagcaaaaaccctattggccactagatggcacttgtattagccgtatctctaatttgagtagagactctaaaagtcctttggtaaatatgtagcttgaaacattgaaagcattcatttaaaaataaataaagataaaagaccctttccagcaaacttataaaggctaattaaatttatagtatgtatatagtattgtaattttctaatatgatgtaatcttacacaatactaaactacactagattaaaatgtactatactataccatgctatactttgttgcagtatttttcaaactgtggttctggaagcctgtacaaaataaatgtgggattcagggcttcatcctagacctacaaaatccaaacctttacatgaagcccagaaaactgcattttagtaagctcccaagggatttcttgcagaataatttctacagaatataacaccacttaagaccactttcctatgagaaagtcatttacgatttctactatttactaatatttactactaacaatttctatcttcttattacataagagattccctatccttaccaatactccacattcccagtaatggtttgtcacagcctccaacagagctcaggtgaaaataagagaagttgaggaagaggactgagatttccagaggcatggatacaaagataataggcattggtgtgccagaacctcctgccactgtaagactacagggacactccttgtgtatacccacttctctgccttccttctctttctcaggccagtaccaccccactcccagctacctatttctctgctatctcccagtgacttgagtacaatttctctcctctccccacctgactacaaaataggccccagctcacagcctctcccctctgtccctgaagctcatatctaaagctagtctgatttcctttttatcagcagccaagagaaataaatagcagcaaaaaaaacaacaaaaaacaaaacaaaaaaaactctcctctgcattgcctaattcactgtaggtagaattagccaaataaaatttgggacatccagttaaagttgaattttaacaaataattttcttagtataagtatgtcccaaataattgcatcagacatagttataccaaaaaattatacatttttgcctgaaatgcaaatttaactggatatcttatatttttatttgcaaaatctgacaactctagctgtaggagagaaggaaagaatacagaggtggttaggtgataatggcacggttttgggtacttaaaggactgcaatgagaatcatctacacgtcaggaaatccagattcaaactcctgtgagcatctcacctcagaagcagaggctctgctcaagatgaaatggagcctcccaaaactacagatggtatcagtgttgagacaggtaatactatcatatataacaatctaggaaacagtggagaaaatactgaaatgggagagttccctcacaggacaggcaacaagggtgtggctcatctgttcagcgctcaaaccccttacaggagggggagtgtgcagacggcaggtgcaggagcacaggctcccgctcctgggctctggccccacaacatcatccaggagtgggagcctgcgactcctgaagcccatgtgggtgtgtgctacagtgtgctcttttagccttgccatccgcagatggtttgttaaaaaggtcggtgccctcttggtacccaggtccttgtccggcgtccaggaagaatcaggtcgcacaccgacttaaggatggtgaatgcaggggttttactgagcaggggaagtggctgtcagtgggatagatggggagctgaaagggatgatggagtgaaaagatgatcttcccctggagtttggccatcctggggccaatctcctctctgcctgtccccagccaatctctcgacgttcaaaacgctccttctcttctcttcttctctgccataccattctgtgattcttctgctcttctgtttgtctcctcatatgcttgtctgctcatggatcctggggtttgggatttatatgggtacaggttaggcaggcatggcaggccaaaaggcaacttttgggcacgaaaacaaaaatgcctgttcacatttagggccatgggtttccaggcttgagggtggggcctttgccagagaactgccctcttctacccagtatttccctttctcctgttcatatcaataccaaggtacaccacatatagtaagaataattattgtttcctcaacaacaggtatgaaatttttgtatttgtgtatatgtatggtattgagtcactgtgtaaaatatatttcttttgggagtacagtccaaaaagttttataaagactgctctgagcctcttagcaaaggcagctatcctcagtgactgcctgactgtaagaacatacataaattgggaaatatctatagtatgttagcttatttttttgagcagttcctactccctagcacatatctttgatatgagcaatcctgaagaatagtctactgtgacagagactggctctgttctttctttaaaatgtatcacagctcccagatgccttgcaatttggtgggctcgtgtgactggctgtcaccagcagtgtggaggagggggtgatgtgtgtcacctccaggtggttaagagcttgtgtaacttctccccatcgtgtctgaaggctggatgcagccaaaatttcaatgctttagaaggtagcagaatgattcattggatttgggatgccgaggcgggcagatcacctgaggtcgggagttcgagaccagtcggaccaacatggagtaactccatctctactaaaaatacaaaattagctgggcatggtggcacatgcctgtagtcccagctacttgggaggctgaggcaggagaatcgcttgaacctggaaggcggaggttgtggtgagttgagatcgagccattgcactccagcctgggcaacaagagtgaaactccgtctccacagagtaaagctccaacctgcccctgacaacctgcatcaggaatgttttccatttcattaacacaattacggcatttatagttactcacggctttgtatttgtgcatgtatattaataatattaccaatttgttcttgagtttctttttccatacttcaatttttatatggatcataataggaaataatggtggtttatatgagttatcatttacacgcaaaacaaattggaactgctaaggccaggatagtgaataataaattatacacatctgatacccttcaaagtaatcttaaataagaatgcaatcttatgtgcagttagtttaacctatctttcttgatagtgggattaactcttctctaaataagtaatttataaaagtaactcaaaagccaaggtcagtgatattcacctgtaattccaactacttgggaggctgaggtgggaggatcacttgagcccaggaattcaagcctatagtgcacaattgttgagtttgtgaatagccactgcactctagcctgggcaatgtagcgagaccctgtctctaaaaaattgttagataaaaagtaaatgcgactcaaagtgaatgcagttaatttatgttactgcctatcttaaatccttactacctccaggataagatccgaacacctcagcatatcatgctttcccttgcttatctcccttgcctctgtctctacttccccagcctctcacactgaagcaattctgaattactcgcaggttgtacttgtaacctaaaaagcttatttaaaatacagatgtctagagtctggtgctaagagtcttgttcagtagagctggggtgggaaactaacctctacattttaataaatatctcaggtgactctgatgcaggtgaattacagatcaccttttgagaaatgctgatgacaacaaatgataaaaataatactaggagatgttttacatgacaattttaataagaaaaaaagctaaaaattgcatttattttgattatttttaaatacatagactagttactcattttatttatgcaaaaagttataaaagtaagtagggacacttcatttctaaaatatctactgaatttatttctaagataatgagtaaagcaattttccactttgattaagaaaagtactaatcattgtaacttccactgctgtgcttttaaaaattatgaatctgtatattcaaaagtaaaatattgactggatttggtggctcatgcctataatcccagcattttgggaggctgaggtgggaggttcgcttgaggccaggggtttgacattagcctgggcaacacagcgagatcccctctctaaaacaaacaaacaaaaaagatcaatttctatatttattaggctgatttgaaaaaaataatagtagtaatataaatagataatattaccatttgaatcatcaggactaaacaatcatgggttatatttaatagggaaaaaacagtctctagctgccacacctcacagatagagtcaaagaaaaattcatttttcaaaattaattttaatcaggaggatagttccacatacgtgagttattcaatgtcccattgcaacttcttgaccattggtttagttcccagagctagactcgttttagtgaaatttggaaccatagatctaaactttcatatcttacttcaatccacagtgagactttttgcaaatcactccccgtctctttttacactcctcatctattaaacaggactaacaattgccaataaccttaagtctgaaaaaatatatatactataatcatatctctaacaaaatttgagatcttaggaataaatcactggatataaatacaaaatgtaattatcctgaaagctttccctattgcagtattggtagagtacatatttcaaacacaaatatttaaaaaggttattctcatcattaacattaataaatatttactgaggtgcctatcgggtatttggcaatgcactagtgagcaatcttacatcaagtttgaaatagattcacattgcagagaaatatataacctaaattagagtctcagaaattggagactggccaggttctctcctctaggaaaaaaagaattcaaacacatgaagagctaactgagcactggacacaaatatcaacagctgagctgaaccacttccttggctactagtcctacaagcatcactctcagatttcttctataaagagatacaaccataatccacaagtaactgaaagaacacctcctctgaagtctgggactttcttctctgaagtttctgaactacatcagctctttaccacagccctctatgcctgctggcccaaagaaatctgttctaataaaacctcaagcctccccactgagtatcctctatttagaattccagagttggcttctgagattaagaactcttttaacccatttgtaaaaatttagtcaagacaggatataacatgttgcacagtaattacaccaagaattccgtgtcaaaggctcaaaatctcattttactttttatacatcttgggacctgcaaaagtgacttcacttctctggaactcttttctctcatctagaaaatgtaaagatgaatactaacctgctttgatcaaaagcttgttacatgggggaaaaaatacatttgtaaaggtctttggaaaatacaaagagctatagaaatgttagataataaaggttttgtccaagcaagactggaatggctacttctcctcattttgaccttctgttgaactcaccttcctcttcaggctacaaaagaaggaaccctatatttcctctctaaggaagtttttaaaatacattttaaaatgccttttatattcatgtttcaagttctgctggaactggcttttccccccccattatatatacaagataatgaggaattcagaagaaccacctgctgatgaaaacattcacaagctggcctgctgcccagcaaggatgagtccaatccataagcaactggagaaatctgcctcctttaacacaagcagtcgggtccctaatcttgcatcacagactttaggctctcagctcttaaacaaattctcacagaatgagaatacctctcccaagaaatttgagtttcgaattggttgaattccttacctcttgggagcttttccttctctgatttgtgtcctgaaaataattcttttatttctattacaaagcatttttgcatattttggtacatgaacaaccaataccgatggagaagagtaccactttaatgaattcacacataggtatgaaattatctgtctactgaagtagacaggtgccctcaagacgagatgatgaaaaacaaatgctcttccttattcccaaattttacagtcattctgttttgtttacgatggcaatgaggagaaattgtccagccaaaagactttcaacatcttatttcacccatcctgaaacaaagtaaaagcataaaatataaaaataaaatacaattctgagttctaaagaaaggtattgccttaatcccttttaccagtccagaagtgctagattaatgcttgataatacttgtcattgttttgtgtgaatactttgaaaaaaagtaaaaaagaaaaacactatacaaatcctatggcaatatattacagcaacacaaatttaaaattcgtagagttttcacatacactatttaatttaacctcacaacaaccccaagaggtaggcagagcagctattagtatccccgtttttcagatgaggaaactgcaacacagaggggcctaaagacatgcccttgtctgcttagtaagaaatggtagagctacaagacaaacccaggactggactttctgtattcacagtgctgcttgccttagttactttaagaagagtagaaaataagattggaagggcaggtaggggccagatcacggaggatcttgaattccaggcaatgcagaatcattcaagcagtattgggggtttttttgtttgttttggtggagttttttgattggtgttttaaatcagagtttatcagaataagtagggcaaaggtatgtataatagattaaggaaaaggtagtgtatcagtttaggtatagtcaggatacagaagccaccacagtaatttcagtaggaaacatttagtataaaaaattatttaagtataataggggagtaaccataaagatgtaagataactcaaaaaagaacactatgtttgatggagaatacaaaaagaaaaagagaatacaaaaagtagaagaaactaggaaggagggctgcctccccaaggctggagtaaagacctcattggagaaggtatgtttgcagcccactggataatgaagaggtttgctgggttggccaggtcagcgttggtctttagtcaccagagagcagcagacaaccctctagggagcaggcaagctgaggatggtgggtggacacacacacagaatcactgctgctggtttgcgaggtgtgaagcacctgctatccatggtgggacagttacaaaaacaaccttctgaagagcaggtaagccaaaacacgtggacagacacacagaagaaatcaggatgccactgctagcacaaggcctggaacacaccagtgcccacattgagagagtcacagcaaggcagacgctgggtccaggccaggcctttgaggtcaccatgagactgcaagttctggggcacatctggagcagactgccagtaaatgactgccacacacacacactactaatagaccctgacactacatcaaggaaaagcaaaatgtagcacacagtaaccaggaagagaagactgtgtcttcctgcaatgtccttccatcaacctctactgacacagctcaatatcattctcactgtgacagagaaatgcctaaagagtccaatcccttatcccagagcaggtattgacaggtaaatttggagctgagagactattggtaactggcacagagagcatcaagttcctccttctctctcacctgaaccacagtattgacaacataaattgccattgattggaacaataatttggtaaaggtcctacagccatttcccaggctattctgagttcatgtaactatgatctccaatgggccccttaaaaatattctcctattgcatgtttaatgacaattctaatataaaattctaactcttcaaaagttttctgtatcttccttttttcaggggaaggcaattaggaaaaggaaatagtaaaaaggaaacagaaagatggcatctggaaaaatgaagacatttgttccagcatactgtcatggaccgctaaagctgaccctggtggtaagatcactttgaaaagaactgggacttcagtcagttaaaaaaaactttcctacctatcagtgactgatcctcttacctgcttgacaaacacttcttgcttaaagtacggggatcaaaaaccttttcaactgatctctttaagcttagtcacatgcattaagggaatggaagagactaaaaggaaagagggaattaagatgaataatacttatgaagcaagcattgcaaaaagtatattcctgatcataggtgtgcaagcttctccacaaagaatgtatatgaatggatttttagaagctttttaatgtttaccactttaaaagtttctaatggagaaggaaagtccaaagaaggaagaacaaaacaaaacaatagaaaactgtgagatttaccatctatgtaggaaatgcactgccttttccacaagccatcaaaccactaactttcctttccttttaaagtgattcattttttactgcaaaatcatctcccaaaattccataatacatattaatcaagaaccttaaaaattatcatattcttcagtaaagcaattccatttgatattattgaccactcactcattctagtggattgcattatacaatgccctcctaattttccccctacctcacccttaaacattggcatttctgagatctgttgtaggccttttctctcatcatgctactcatccatctcctcagtcaccaattgcatggtttcaatttctacctacacgccaatgacataaatctgtttctgcatcctagacttgccttctaagcaacagacctatatatccaactaactctaaacatattacaaatgtctctcaggcacctcagaaccaacatgtacaaaactaaagtcatcaccttgaccacaatctttctcttgctcctttatcctttttttttatatactttaagttttagggtatctgtgcacaacgtgcaggtttgttacatatgtatacatctgccatgctggtgtgctgcacccattaactcgtcatttagcattaggtatatctcctaatgctatacctcccccctcccccaaccccaccacaggccctggtgtgtgatgttccccttcctgtgcccatgtgttctcattgttcaattcccacctatgagtgagaacatgcggtgtttggttttttgtccttgcgatagtttgccgagaatgatggtttccagcttcatccatgtccctacaaaggagatgaactcatcatttttgtggctgcatagtattccatggtgtatatgtgccacattttcttaatccagtctatcattgttggacatttgggttggttccaagtccttgctattgtgaatagtgccgcaataaacatacgtgtgcatgtgtctttatagcagcatgatatataatcccttgggtatatacccagtaatgggatggctgggtcaaatggtatttctagttctagatccctgaggaattgccacactgacttccacaatggttgaactagtttacagtcccaacaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcgtttcttcatgtgtcttttagctgcataaatgtcttcttttgagaagtgtctgttcatatcctttgcccactttttgatggggttgttcatttttttcttgtaaatttgtttgagttcattgtagattctgggtattagccctttgtcagatgggtagattgcgaaaattttctcccattccgtaggttgccaaatcatgagtgaactcctattcacaattgcttcaaagagaataaaatacctaggaatccaacttacaagggatgtgaaggacctcttcaaagagaactacagaccactgctcaaggaaataaaagaggatacaaacaaatggaagaacattccatgctcatgggtaggaagaatcaatatcatgaaaatggccatactgcccaaggtaatttatagattcaatactatccccatcaagctaccaatgactttcttcacagaattggaaaaaactactttaaagttcatatggaacaaaaaaagagcccgcattgccaagtcaatcctaagccaaaagaacaaagctggaggcatcatgctacctgacatcaaactatactacaaggctacagtaaccaaaacagcatggtactggtaccaaaacagagacatagaccaatggaacagaacagagccctcagaaataatgccgcatatctacaactatctgatctttgacaaacctgacaaaaacaagaaatggggaaaggattccctatttaataaatggtgctgggaaaactggctagccatatgtagaaagctgaaactggatcccttccttacaaaaattaattgaagatggattaaagacttaaatgttagacctaaaaccataaaaaccctagaagaaaacctaggcaataccactcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaatcccttcaactcttgcaggaaattctacttcctaaatatttttgaaatccacccacctccctccatccccagcaactcccctaaattatggcactatcatctaatgccttctcagggaatgtctttccacacaacccattctccacgagagagagtcattcttagaaatatgtcgttcttagaatgacacatttggacagagtcattcttagaaatcagaaatcacattactccataatgagaagggcttaaaacccttctagttactattaggatacagttcaatcttaacataaaaagtcctttattttgcccagcctagatcactgtgttcattttcctcatcttccttcaccagcaccttctctcttgcctccaagcctctgtatatgctgctaactctgtagaaccctcttcctttccacctagtcctgtgcacttaatctattgctactcatgtcaagattaagattttcattccatgaaaaacttcctcagatcccttggtttgagatgaccgtatactgtggtcccagggtaccctatacttctcccaatataagcatgtttcacctttatttcttaaaagcagctttaagttataatttatgtacaataaaactcaccaatttaagggtataatttaatacaatttgatagatgtgtcagttgtataacaacgaccacaatcaaaatacagaacatttctatcagaccaaaaagttctgttgcaactttcttcaaatcaatcctctctccacacttctggcttcagcattaaccactgatatgctctctttcactatagttttgatagggacaggaggcagagaaattctaggcagaaaagggtggtgtccctggcgaagccccaccctcaagcctagaaccatggcccaaagtgagaacatccccatttttctgctcgaatgttgccttttccaaaaccctcctggcccgccctgccccacattctgtacccataaaaaccccaggctccactggcagaggaacagcagaaaagaagagaagcagcagggagatgtcagagaagcagcttgacttcagaggcacagcttgacagtgggatttgagagaagagcctggccagggacagccagactccaggagaagaccactttcctactccatcccctttccagctccccttcccactgcaagccactttcatcgacaataaaatcctctgtattcaccaccctccaattcatttgtgcatcctgattcttcctggacaccagagcttagtagccacaggggcagatgcttgagctgattaacacttaagccatctgaggatggcaaagctaaaagcacactgtaacacatgcctctggggctccaggggtcgtggtacccccctagatgctgccatggggctgcacagagttctgctcctgcctgtgcccagaagcactagtcccggctcctgcaccgctcacctgtgtgttcccccttccgcaaggggttcagagctttaggataagtaagtgaggcactgctgtcacgaggcccatgaaggggtcaaggaaaatgcctttcagttttagcttttccagaatattacataaatagaatcatacaatacataggtcagtcatttgttcctggcttctttctatgttattgcacatactgtaattcattccctattttttaattgctgggcagtatttcactgtatggatgtatccatttgtttatccattcacttgctgtttccaaactgcttgtttccagtttggggctattaggaacaaaactgctatgaatatttgcatacaagtctttgtgtggacatatattttcatttttcttgggttaagacctccaagtgggattgcttgaccatatagtaaatgtataactttatttcttaaactgccaaattgctttccaaagtggctgtttcattttgcattcccaccaatatatgcaagctctagttgctctatcttcttgacaacccttgctatggtcattttaattgtagccattcaggtgagtgtacagtgatatcacattgtaactttgatttgcatttccctaatgactaatggtgttgcacatcttttcatatacttatttgccatttatatatcctgatttgaagtatctgttcaaatctttttcccacttttatataggattatttgacttttttattattgagttaaaagtttctctatataatcagatacaagtcctttattaaatatatattttagaaatattttatcccagttcaaggcttacttttcattttcttagaagtaacttttaaggagcaaaatactttatttttatttgggctcagtttatccattttttaacatcatacttcaatattttattataatggctttaataattggctatctttcctactacagaataagctcaatgaggaaagactacatgtttcccttgcttactactttatttcctgtgcctgacatgtaaggcactctaaacctggcacataaggtactcaacaatatttaattaattgattgtaattggtaaaaacatggagatataattaagttttctgtacttgacaaaccaatcatattacctgccacactcacagcctgctaagctgccatattttgtgtcacatggttctattctttctactttcttcctttgtggctacatatcattgggctagagagaagcaaggttacctaatccccaggctgaccatctaactacacccagtcctgatgtgggaaaagtctattcaaacagaggcaagctagaccaatcagagtctttttattaaagattcgagttgcaaaatactatagggaataggcagataatagatatgaaactgaaacaaaggccatgaagcagaacaaaggctatgaaaatgtttgttttcttatatttttagagacaaggtgtcactctgttgcccaggcaggagtataatagcgtagtcatagctcactgcagcctggaactcctgggctcaagtaatcctaagcttcccaagtagctaggactacaggtatgcaccaccacgcccaggtcttttgctagagatggggtcttggtacgttacccaagctggtctcaaactgctggtctcaagtgatcctccaacctcagcctcccaaagcactaggattgcaggtgtgactcactgcacccagccaagataatattcagaagatgaatctgtgaggtagctaaaagaaaagaagtatactatggtggtcatcaacttgatcacacatctgaaacttgaaaagcttcttaaaaattcattcaccaggtctcatagaatttaattcaacaaatatttattgagtccctaatttgtgccagacactgtgatagtcactaggataacagctatcctatactcatggatctcacagtttagagaaacaaaaagaaaaaaagtaaacaaaataattatcaatcataataacataatttttaaaaagaactgaaaatagaaaaaagaaaataaaaacagtaaaaccaactctagacgagatgttcagggatggcatgactgaagagagaatatttagcaagttctcctgtcagtgagaatggagaatgggaagaccacagaggctttcaagactggagtgccaaaaccttgtggctttacctactttttactggccaaaacaagttatgagacaagcccagattcaaggagtgggaaaatagactccatcacaaatggaaaaagctgcaaagtctgaaatggctgtgagtacagacaggctgttaattgtgccatcaacacactcaatccacctcagctaccaccactgtgtgtagactcctgacatgctcggcttcctcactggaagctaccattctggagttagtctccagctggatccttcctctcaagatctgtcctgccttctataccacctcttatattccatctgcttccttcactccatttcctattgccttgaatgaaccactggggctcccactaccattcagatgagttccaagaggcttataacttctaagcactgtctctgccatgacaacaaatctaagctgtctttctgaggatgaaataccaacctacagccagcagatattcaaacatgtgaacaagtccagccaagatcagcagggcaaacttccagacccatagctaaccatagatgcctaagtgagcccagttaagaccagaataactatcttactgatctataaattccagaataactacaccatggtccatagacttccaccgattccaatccaattataaacagcaaccatagcagaaacgcagtcttgtagactagaccatgatggtgggaggtgggggaaagcagaactacaacttagtgctaacatgataagtcagtagtggtaatcctaagagtggaactggcaaggagatttaggggagtaattctgatcataatttaggatcctgaatatgggcaagggaaaaccatgagtctgattttggacaattttgatggagatagtagagatgtttgacaacagttggcaatgtggacccaaggtttggaaaacagttgctggtagaagagctagcaatgagattagaggagagaaaaggagagaaaaggctgctgctgtagccttggttaaggctaaattagagaaaacaaacgggaagaagagtcaatttaaaaaaaaaggacaaagtaaacagaaagaaatccaggatattgcagtgtcttaaaaggcatgagaggccaggtgcggtggctcacgcctgtaatcccagcactttgggaggccaaggcgggcggatcacgaggtcaggagatagagaccatcctggctaacatggcgaaaccccgtctctactaaaaatacaaaaaattagctgggcgtggtggcgggtgcctgtagtcccagctactcgggaggctgaggcaggagaatggcgtgaacccgggaggcagagcttgcagtgagccaagatcacaccaccgcactccagcctgggcgacagagcgagactccatctcaaaaaaaaaaaaaaaaaaaaagacatgagagcagataatttcaagaaatggggcattaaacactgtcaagagctgtagcaacatgaaggcaaatgagaactcaaagttcctattatcaggggatcagtgaatgaaaatgaacaaatattttaagactgactcacagtgagaattatagtaaaataaggactttaatttataattttgaagtatttaacaaagtttttgtaaatgtcatgcaggcctagcatcaatagaacaaagcagatggggaaaaaagtgaccaggaagatagccagtgtaggagtctcaagaagaaaggtatttatcaggaaaatataactactatttttataaaattcctgcaattgcttataaaaaccacaatactccttgaagtctgaaaacattttgaatatgcttcactttgcagatttagaaatagttccctggtgagggttcagttttgaaggaagaggagccaacaaaaaaaaaaatcagattgcataagaagccaagtataatctttctttgatggcactcactgggcatcctatgaatttataatcaagagcttctaattgataaagctttgatagcacaaaaggtcaccatggattacttggtcctgctatgcaacatactgtgctcttcacaaacattagcaattaaccgcaataaataatgacatgagtcaccccttcaaacatagggcagcatcctgaagccccttacctgcagtaaacagcagtcagaactggcctttgttgcaaacacttttcagttgttttccataccgccgataaattctcctctgaagtttatgattttttttccattgaacatatacatttatatagggtataattctattctctcacataagacaaccatattttcaaacaaagtttccatatcataagtgatacatgtatgaacttgtcatttttgtaaatctatttaattaaattattctttcttttaaccaagaactttttactgtcctaatgacttattatgttaattcagggcaactggcaagaaggaattaggtgccattctgttgtaacacgtctcatttccattccaattttgttcacaataaatgtgttacagttcttccattggcagtcaaggaaacctcatacaaaagcagcttttacttgcggttataaaacagccaagcaatacatacgctatttgacagtttggaatatctgttttccagcattcatctggagctgttattggaaccattaaaattattttctttatagtttttaaaggcccacaacatgttaatttatcctgatggatggtataatgcgttcatgtaaaagaaaaacaagtgttacataaaacatgactaagctgtcaaccacctcctctttaccttccttttaactctgcatgtttaatttattctccattgaaaatggcaaccaataaaaaataaaatccccattttgatttactttttacttttcacaccccttatcacactgagcaattttttgatccaaaataagactgaaacttctgccttcacacaaaagtaaacacagatggtccgataatagtagcgaactttacacaaactgccccatttgaagcaggcctatttaatgccacatttcattaaatatgacctatcttaaatcggacaggctctcctgcaaggagccaatctttatctttatttaaactcagtgtggcctgtcactataaaagactttgccttctttgaacaagggtagacattaaagctaaagaacagggtgggcctccttaccccagccaggccaatccaatttacaaacagattgtattcaaaggctcttttgtcagtctattgtaggattttaaaagcattttaccacagaaacaatgttatacccactggttaggttcttaagaaaggtcatttaaaaggttaaaagcctatttaacccaacatatagttgtgctgatattttaataggaataaaacgcacctgtgttaagtaatactatggaatgatgtataataatgtctctgaggaaattcattaagaattctgaccttttatgcctgtgacacaacttctggtaacatcatcctcacttccctcttgcagacctcccctgctactgggcaacaggagttcaacttccttgtcctaaatataaaccaccagtattggccactatcatctggagccagggctccagcatagtggaagatttatgtaagggcgtatgaagacagagactgggtctgaggggtgaaagtatgggatggggtctaggaagttaggaatcgacaaaagtcttctgccagggtacacctcaggcctcactccttggtctagcctgtacaccatcattcttttcttccagcagccctgggattgttctgattcccctccaactgctaccacctgttgcttccaccaaggtttcactcttcctcctggtctactgcatcacagaacagcagtcttggcttttctcctttgttcccacgtatccttttgaagtttcctaaagattgttacagctgctaacaaaggaggtcaagagataaaagtgtttttccaaatttgccttccacatcttttcttttttaattgagactaagttgagaaaaaagcacacttggataacaatcggtttggtgggggtgggggacaaaaaaaggtataaatttgttttacaacatttaagagcaagacagctcacattaaatggatatgttctactcagaaaaaaaaaaaatctggctctgccctcaccagccagaagtatcaagatattccaattcacttttgggtgactgccttctcctcttcaatgccccccaccagcatggggaagcaggatggtgccctgaaaacaaagtaaatctcttatgatccttaggccatcatgatcacacatgagatgttaattgcctcagtccaccagtccattcaaagaaggaccacaccattcttctgtgccagggatcttttaagccagcttccatgacagttataaatgtttgctgtccacagtatcaacatgaaccacctcaactctccatccaaagacttattaaaaggcaaggggacaggttgcaaccattcattaagctatcacccagattagtactccccccaaatctctgaaagctatttccattcctgccagttctgtttcctctgccctcccagaaaacccctcaccttcatgctcccattgcctccctccctcaacatctctaatcccaaaacaataacatgggtgatggggttttattccagagaccaagaaacttccattttcatccatgttatttttcaggtctgccatataaaggcagtttataataccttgaagctaggaatcccagaatcagaacataacagctcctggggataatggaaacaacaacaaaatgtcaataaattatcctgacaaatacattttagaggaatgctcagtctcaggtttatccagttattccatgataggtctgctgtgaagaccaagccaggaccttagatatgggtactgagtaaatggcatagaggatgaagatgctaccaaagagacctgcatactgggcctgagagaaccccaccaatagcaggggatgtttactctccccttcccttttcagtattcttttctctctgctttatgatcttgtgattcattcatttgcaatatataatctctaaagccaacatttataacaggcttaccatataccaggcggtatgacaaataaatgattagtgtgattattttaattctcacaactcagtaaaatagtttattattacaacttacagataaggaaactgacaaccttaaaaaagtattatatacatttaaagctacaaagaacttatagctaaaaagagaatataagacttcctaattatcagaacaaaagaacaaaacataacaaaaatcaaagaaaatacaccatatggtgaaatttttaaaaatcaataaacacagaaaatataacctaaaatatgatgttaatactgaggcaaaaaatatctgtcatataactaaatgtatatgggataaactctatttaaataaaagagttccagttttcaataaaggtggtctaggatttggtggcctcactcagaaagttgaactttgcttattttgagggtgctcatccccatggagcatttaatgattctgaaaggggcagctgagaggctaagcagggcttttgatagcactaggtgagggacagactaaactacagatcctgaaggaaaaggaggactcataaatactcttcattttggcttcagaccaaggagatacctagaaggaaaggtaaagcagaagtaggcagacctacacagtgttaaattgtttcagtccctgaaattggaatgaggtgagtcacagattgctaaggcccaaaggtatttggcagaaaacataaatcttctatggaagaagttagtatcattccatgtctcaaatgttttctaaaccttggcaaatatgatgtcaggtacacaataaaaaataaccaggcacatgaagaaacaagacagtttgaatgcaagccagaacaactgaaaatacaaatttaaaaaaggctccagatattgaagttatcatgtatggactttaaaataagtatttttgatagatatatagatacatggaaagatatatgatataggaggtataataaaatgtaaggagtggaatatagacgacaggtagatgttaactgtaaaattctttcaacttttatatgtttaaaatttttaagaataaaattttggaaaaataatatattgaaaggcttagcttcctggtagctacaggaggggaaataacagaagcacaaccacctacatgtggtcaggatgactgtgattctacaagatagaaaatagcccacctgctcagaagtaagcctttcctgtcttagtggtctaaggagaatttaagcatggattctcacaaagggagcatcagttttttgttgctttttttttttcaagatggctaactagggatgtcagatgccagttctcctcagaaataagatcaaaattataggtgaatggtcaaaatctgaatgaaaaaatgaaggaagacaaccaggatctgtcagagagtccagagaatgaagctgtagtgcagaaaaggaaagcagcaggagtgcagcagagatcaacccctgagaaacccatagccctacggaaagggtagggcttctctgctcctcttacccctgtaacaatttgctgaccaccaaatttttgaggagtccctgtgctctcatgaccccaggaaatgctgttggtggcaatctgggaacttccagggatagagaaccaggtaccaactcacacagaagtgcctgcataccccttaggcctgaactgagacagcaggtgccatattggttgttcaccgattgtggcccactgccctccccagggaacctcagcctttgaattgccacatcaccagaccccctgcaaacgtaccccacaacccgctttgactttcacaaccacaggggccagcaggtctctagggaactgcagaatctctggagatccagcactcagtatgggctgcccctagggaagggaagaattcagcccaccaaagccccacttaggacaaagaaaacatgggcatggcaccaactgctaaaggggaaggtaccagtggtcagaaatggacatggacagggggtcatctcctgctcccccatctactcttgcagacacaggagaggctctcccagctgggggctgatgtgtgtgtacttgctgactgccactctcattagggttactttccagtgcttttcatggtagctgcatccctgattaaagtgatcccccatagcaagggcttccacaaaggatagggcccatctctgcacaggatggcagcatcccagcaatacaaggcatgtaagtgcaaaattatctgctttggactggtataagaggctctgcactgagcccactttggtggtagctgtcaaaggggcattcctgcagtccacacccacactgcagcagggagtcaaagggcaatgtctataagaactgaaggtcatgagcaatgcaactagggtgtgatagggaagtggattacatgcttgctggcccaggttgagaagctagtgcaacttccccctcaccaccccttccccaagagacctcagtgcagtccaaaaggatctccccagtcaggaaagttgcctctattcattatcagactactcaagggtgagctggttcttattcttaagtgccacctactggaatggcaaccaaatagcaccaccaaataaaaaacctgctgtcaaaaggtcatagcactagtgtacaagataagcttcctgagacctcagcactctcagccctgcaggagacagtgtgttgactcatacacccaatacattgttacaacaagcagcatttgagaaagccaccacacaaaagctatccacaaccaaggaactcatacagagccttggccccctgaaaacacctggaaatgaagccaaatgatcatacgcaacatacaccacagtcataccctcaagtgaaacaagacgaaaaaatcaaaaagtcccatccaaatgatggaaaattaaaaaataagcagcaacacctccttcagatgagaaagaatcagtgcaagaattccagcaatacaaaaagaccgtgttttaactcctccacaggatcacaccagctccctagcaatagattctaaccaagatgaaaattccacaatgagaaaaaaagaactcaaaacatgaatttcaaggatgctcaatgacatctaagagaaagttgaaaaccaacaaaaagaaaccagaaaatcaattcaagatatgaaacatgagatcactatattaaaaaaaaacaaatagaacttgaatttgaaaattcactaatggaatttcaaaatgcaatcgaaagctttgaaaattgactacagcaagcagaagaaagaattttagaggttgaagactaattagacaaaaataaagaagaaagaattttttaagaaatatgggattatgtaaatcaaccaagcctatgacttttaggcattcctgagagaagaagaaaaagtaagcaacttaaaaaacatgtctgagggaataattcaggaaaacttccctaatcttgccagagaggtagacatccagatacaagaaattcagagaacagctacaagacactataccagatgaacatcaccaagggatatagtcatcagactatctaagatcaatgctaaagaaaaaaaatcttaaaggcagctagataaaagggtcaaatcacctgtaaaggaaatcccatcagactaacagcagacttctcaacagaaaccttacaagcaataagagattggtggtatatttttaccctttctaaagaaaaaaaaaatctagccaagaatgttacatcctgcccaatgtagcttcataaacaaaagagaaataaagtctttttcctagacaagcagacaataagggaatttgacaccactaggccgaccctataagaagtgctcaaaggagttctaaacatggaaacaaaaggacaacagttgctaccataaaagcacaagtaagtataaagttcaaagatcgtataaagcaatcacacaattgggaatacaaaggaactagctaacaacactatgataggaacaaaagctcacatataaatattaaccttgaatataaatggtctaaatgttccacttaaaagagacggatttgcaaataggataaaaaaaataagactcaaccatctgctgccttcaagagacttacctaatgtgcaatgacacaggctccaagtaaaggggtaaaaaaagatatgcaaatggaaaacaaaaaagagcaggggctgctattctaatataagtctgttttatctaaaacagacttcaattacagtgaaaaagacaaagaagaacattatataaagggttcaattcaacaaaaagatttaacaattctaaatgtatacacattcaacaccagagtacacagatttataaaacaaatactactagacctaagtaaagagatagtcatacaataatagtgggagacttcaacaccccactgacagtactagacagattatcaaggcagaaaattaacaaagaaactctggtttgtttggggtattttttttgagacagggtttcactctgttgcccaggttggagtgcagttacatgatcctggctgactgcaacctctgcctccttgactcaagcaatcctcccacctcagcctccagagtagctgggactacaggtgcacaccaccactcccagttaatttttgtattttttgtagagtcagggtttcaccatgttgcccaggctggtctcgaactcgtggactcaagtgacctgcctgccttgacctccaaaagtgctgggattacaggcgtgagccaccccagctggccagaaaattaacaaagaaactctggacttaaattggaatattctggacctaatagaaatctaaagaacacttcacccaacaatcacagaatataaatttttctcatctgcacagggtcattctctaaaattgaccatatgcttggtcataaagcaagtctcaatacattcaaaaaaaaaaaaactgaaatcatatcaagcatattctcagccacagtggaatacaactagaaatcgataccaagaggaactcttgaaatcacacaagtacatggaaactaaacaatttgctcctgggtgacttttgggtaaacaactaaattaaggcagaaatccacaaaatttttgaaacaaatgaaaatagaaacataacataccagaacctctgggatacagcaaaagcagtattaagaggaaagtttacagcctaaatgcctaaaaaaaaaaaaatagaaagactaggcacagtggctcatgcctgtaatcccaacattttgggaggccaagtccaggagtttgagaccatcctgggcaacaaagcaagaccccatctccacaaaaaaaaaaataaagaaagaaaagaaaagaaaaaagaaaagatctcaaactaacaacctcgtatcacaccttaaggaactacaaaaacaagaataaaccaaacccaaagctatcaaaagaaaagaaataacaaagatcagagcagaactaaatgaaattgagaccaaaaaaaaaaaaaaaaacacacacttatacaaaagaccaacaaaacaaaagcttggttctttgaatggataaacaaaattaataggccactagctagattaaccaagaaaaaaagagagaacattcaaataagcacaatcagaaatgataaaggtgacattacaactgataccagagaaatgcaaaagatcctcagagacgtctaggaacatatctatgcacacaaactagaaaacctaaaagaaatgaataaattcctagaaacacataatctcacaagattaagccagaaagaaattgaaatcctgaacagacgagttacaagttatgaaatcaaatcagtaataaaaaatctaccaaacaaaaaaagcccagaaccagacagactcatggacaaattctaccagacatacaaagaagagcttactgaaactattccaaaaaatcaaggaggaaaaattcctccctaacttgttctactaaatcagtatcatccttataccaaaacctgacaaggacacaacagtaacaacaaactataggctgatagtcctgatgaacatagatgcaaaaatcctcaacaaaatactagcaaaccaaattcagcagcacatcaaaaagataattaatcatgatcaagtgggttttattccagagatgcaaggatggttcatcatacacaaatcgatcaatgtatttcaacacataaacagaaataaaaacaaaaaccacatgatcgtctcaagacacagaaaaagcatttgataaaatccaacatctcttcatgataaaaaccctcaacaaactacgcattgaaggaacatacctcaaaataataagatatatgaaaaacccacagccaacattatactgaatgaggaaaaactgaaagcatttcccctgagaagtggaacagaacaaggatatccattctcatcactcctactaaacagagtactagaactcctggccacagcaatcaagcaagagaaagaaataaaagatatccaaattggaaaagaggcagtcaaactatttttgttggctgatgacatgatctcatacccagaaaatctgaaagatttcttcaaaagactcctagacctgataaacaacttcagtaaagtttcaggatgtaagataagtgcataaaaatccattcctatacactacagtagtgtatacattcctatacactatagtgcattcctatacactataactctcaagcttagacccaaatcaggaactcaatcccatttctaatagcaccaaaaaaaaaaaaaaaaccctaggcatatatttaccaaaggaggtgaaacacctctacaatgagaactataaaacactgatgaaagaaatcacagatgaaacaaacaaatggaaaaacatcccaattcttatggattggaataatcagtatcaataaaatgccttcccaaagcaatctacagattcaatgcaattcctatcaaattaccaacaacatttttcatggagttagaataaataattctaaaattcatgtggccccaaaagagatcccaagccaaagcaatcttaagcaaaaagaacaaagctgtaggcattacattacctgacttcaaactatactacaagctatagtaaccaaaacagcatggtactggtacaaaaacagacacatagaccaatggaatagactagagaacacagaaataagcctacaaccaactgatcttcaaaacagctgacaaaaataaacaatgcggaaaggacaccccgttcaataaatggtgctgggaaaactagcttgtcataggcagaagaatcaaactgaacccccatctctcaccatatacaaaaattaactcaaaatatattaaagacttaaatgtaagatgtgaaactataaaaatctagaaggaaatctaggaaaaactcttctaaacattggcctaggcaaagaatctatgactaaggtctcaaacgcaaatgcaacagaaacaaatatagacaaatgagacctaattgaactaaagagattctgcacagcaaaagaaactatcaacagagaaaacaagtaacctacagaatggcagaaaatattcacaaactatgcatctgacaaaggacaaatacccataatctgtaaggagcaaatcaacaagaaaaaaataatcccattaaaaggggggttaaaaggacatgaacagacacttctcaaagaggatatataagtaaccaataaatatatgaaaaaaaaggctcaccatcactaatcatcagagaaacacaaattaaaaccacaattagatattatctcaaatctgtcagaatggcaattattaaaaaatcaaaaaaaaaggagatatcggcaaggatgcacagaaaagggaatgcatacacaccactggtgggaatgtcaattagttcaactcctatgaagacagtatggagatttctcaaagaactaaaaacagaactaccatactggagctggaagccattaccctaagtgaaataactctgtggtctatcaattttgcttatccaaaacaaagaaccaaatgtttgttttcttgatcctttgtatggtttttttttgggggtctcaatttcatttatacacatttctgttaaagttaagaaaagaatgtctattaatactataattacattgttaatgctattgttatagaagtatcagctgacataataattagattagaaaaaggaatgggtaaaaaactttaacataaaatgaacagccttcctgtatacaaacagccagttaaaaaatgtagtgggataaaataccttatttacaatagcaatagtaagataaaaatacctagtaataaatttagcaagaaatatgtcagaggtatgtaaagaaaagctttaaaatgttactactgcaggtcacactcacacacacacatacacttgaataaatggaaacaatgtggtaccacagatagagtccagaaataaaacaaataggccaggcgtggtggctcacacctgtaatcccagcactttgggaggccgaggcgggtggatcacgaggtcaggagttcaagaccagcctggccaacatggggaaaccctgtctctactaaaaatacaaaaattagccaggcatagtggtgggcgcctgtaatcccagctactcaggaggctaaggcaggagaatcacttgaacccgggaggtggaggttgcagggagctgagatggtgccactgcactccagcctgggtgacagagcaagactctgtcccatgaaaaaaaagaaaagaaataagacaaatatttctcagtagacagaaaaagattatttaatgttgagatatatcacatttgaattttttcatcataaaactactagaagaaaatacgggtaaattattttataacattagaatgggaaagtctttctaaaccaggaaagaaaagataaataagtccaatcatatgcacattaaaatattctgcatggccaaaaaataccattaaaaaagttaaaagttaaaatttaggtggaaaagttacagcattattacagtcaatgggctaattttcctcaatatataaagagctcctgcaaaaagacaaatagctcaattaggggtaaaataggcaataggcataaaaagacaatttagagattaaaaaaatacacgaggctttgaacatattttttaaatactcaacctcattcacagtaaattaaatgcaaattgaagttaggagatactaactttacctatcaggttgacaagtattgaaaaatttaaaatctgccattggtgaaggagaaacaagcatcttcatacattattagtagatgtataattggtatagtatcaatggaagatagtttggcagtatatattaaaacttaaatgtacatatcttttgacctaataattatatttctaagactatgtcctaaagatattttgtacatgtaaaatgatatgaaaataaatatattcttgcagggattattttaatagcaattttataatgtgtcatttaacaatatataatagtaatttaataatagattaaatgctcatcaattaggactagttaaataaattttggtacactcatacaagagtactatgcagccattaaaaagaatgaagcagctccttgtgtactgacaaagaatgatccctaaactataaaaaagcaagtgaaaacaacagtatatattttatgctacaatgtaagtttaacaatacaggaacatatatgtacatttgtcttatataaacatagactatctctgagaggaaaacatattaatttattgtggggcctctcagaggtagtctatggaaagatagattagatgagtacaggagtggggaagatttactttgcattctaaatttgtttgtaccttcagaactatattccataagcagtaatttcctattttaacagtatcaaatgcagcagaaagtgcctcaaaaaaagactgaaatttgcccagtgcaaagaaaaaatttatcaatgttggtttccgtttgagccacatggcctttgaggaccagaatagctctaaggaaaagactgccccttatttgtgaagatacttcactgagcatttttggctattttgggctattgtggagatgctctaggcataatttagatgggaagttatttaggcaatgatgattttaaatgttcaagatcaactaacaaataagaggaattttggcattgtcctctggtgccttgaagagcggtgaaagacagaagaaaagaaacgaaatcagagtctaaaagtctagatgggccacatgacagcaagctaaagcctatgaagaggcagacagtgaaaaattccctgtaacagggaaataactaggcaacagctcactaggtgattgtaatgatctgactgatcacattttagaaccactgtttcaaatagttcctgagcagactttcagatgtaaaggacatatgtaaactgagcacaaaaatttcagggctgctttattaatagaatatagaaatctcagggctaccaaggacctaaaaaaaaaaaatctgtcatctgcatgtggttatcaagcatcaacatggtcctattgtgcccaaactcaagcaatagagaagctatattaacagatcatgttgtccaaagctgtgctttccaatacagtagtcactagccatatgtggttatttaaattttaattctaactaattgaggtttcttttttcattaaaattcagttcctcattaaccacatttcaagtactcaataaccacatgaggctaatggctatctactggatagaacagagagaaattttcatcactgcagaaagttctgttgggcagcactagtctaaaacatagcattgccactaagctgttgatctaattttgccaacctttattattaatttattgttaattattattgataaacccctttagaatttggattaataattaggatccagcagtgaataaatgcattatgctaaacacttagtacatgtagcatagatataagccttatattcaaaattcttatccttggacatcaaaaacatgatcgacataggtatccaaataagtacagcagatgggtgctatacagcaaaccaaagagtagttattccatatacactacatgaaacaatttgagggaaggtttgaagatttaaaaacacacacacacacacaaaagcactatattagaattggaggtggggaaaagcacaagaaaatagctcaagtcgggggtggaagcaagaaaaacaggtttcggtttagggaaacagaaacaaaaatcaaaaaaagtttaaggaaggtggtagatgggaggcagctggtggagagcttgcatttcatcacaagggaacagtgaaacttccatagaacgcctattcatcttttcaccacggtatcaccacagttgaccactgcctccttcttgaaatactatcctctcctagcttccacaactccatccattcctagctttttttttccactcaacctccaaatgttggagaacttaaggctgggtcctagactctcttgtctgttcctcctctaaagcattctcaaaattttaattatcatttgtatgccattaatcccagaagttatagttctacctcagaattctcctctaaactctactcatatatctaaatggcttctttgacaagtctacttgaatgtcccacctgcatcttgtccagaaaagggattctgacagataccagcaagcatcacttagaacacaatagagctaactcacaggcagaaggtctgcagcttgcatgggtctcttgtcctctagccatcctgtggagaggcatggttgggccggcatgccactggacacaccactggtatatcctcaaacagaatgacccttcctactattgctgttggtctttacacagctttgtgagcaaagagaaactatatttgggtcacctggttctcataaaaggtaccaaccagtgctgggaacagcgctgatgatacccgaaaatctttttgagaagggtaatgaagtgcaggcactcacaccaggggaaaaaaggccatcagtgatgtctcattgccagacaatccataggaggcgtcagggtcatccatcatccttcttgtctcttcatacatcccaagtttaacatgtccaaagctatatgctttattacctgtatcctaaacccttttccctccaatttattacatctccaaaggtactgccacatacttcttgcttaagctgaaattcaaggagttatccttaattcctccctctcccaaattcctcacatccaatccatcaccaaattctataaggatgtctggtccaatatggctgtcattagccacatatggcaactaagcgcttgaaaggtggctggcccaaattgaggtgtgctttaggcataaaatatgcatcagatttgaagatgtagtacaaaaacagaatgtcaaatagctcaataaattttatattgagtatgtgtttgtgaaaacatttttatatactgggttaaattattaagttaatttcacctatttcctttttatttttttaatgtggttacaagaaaaattaaaatatacatatggcttgtattcctggctcaaaataaatctattgggcgctgctgttgtcaagtgtatctatcaacttcttcccaaatctactgtcaccaccctaatccaagtcaccatcatttctggcctgaactactacaatggcttccttattgatctacacgtttcctcacttgtcccattccaaatgattcttctcacaagttactggactcagttgtaaatgtaaattccattatattttcctatttgcttaacaagtctcaatgattttctcattgtccttaaaatccaatcttcctttcacggactttgacgccctgcatgtaatatgtttccagccccccacatccccactcatctttatgacttcatctaaattctgctttgccccaccacttactattctccagaagcactgggcattcttccatttctaagacataccacacttatacccagtagggccttcacaccaaccatttcctatgtctgtaatgctctgcctcactcattggccatctccttcttatccttcaagtctcagcttacattttagctccctaagaggccattcctgattggccagtctgtttccgcccttcattctccaacccagaactgtttccttgtaacacttttctcaatttatagttacttatttatttgtatatttagctgataattgctctatcattctccgctagactgtaagctccatgataggagggaccaggtctgttcagcctagcaatatagacccagtattggtcaggaaattattttaggggcactgtatagaatatttaggagtaggggctgggcgcagtggctcatgcctgtaatcccaacactttgggaggccaaggcgggtggatcacctgaggtcaggagttcaagaccagcctggccaacatagtgaaaccccatctctactaaaaatacaaaggttagctgggtgtggtggcaagcacctgtagtcccagctacttggaaggctgaggcaggagaatcactggaacctgggaggaagaagttgcagtgagccaatatcacaccactgtactccagcctgggcaataaagcaagactccatctcaaaaaaaaaaaaaaaaaaaaaaaaaggaatatttaggagtaggaattagaagtgaaaaggttagaggcaaaagaaaagaatccaagaagagcaattaaagtccattctgatgatctagcaatcccactactggctatgtttccaaaggaaatgaaatcagtatatcaaaaagaagatatcattatgtcttcactcttgtgctcatgcagcattattcacaatagccaagatatggactcaatctaagtgtccatcaacagctgaacagctaaaaaaaaaatgtggtatatatacacaagcaactactattcagccttataaagaaggaaattctgtcatttgcaaccacatggatgaacctggaggacactatattaagtgaaataagccaggcattgaaagacaaatatattatctcacttacatgtggaatctaaaaaatacaaactcacagaagcagagagtagaatcagggaaggattgggcaaatgttggccaaaggatacaaaatttcaattagacgggaggagtaagtccaagagatccactgtacaacatggtgactctagttaataataatgtgttatatacttgaaaattgctgaccaggcatagtggctcatgcctgtaatcccagcaccttgggaggccaaagcaggcggatcactggagcccaggagttcgagaccagcctgggcaacatggtgaaaccctgtctctacaaaaaactacaaagaattagctgggcgtggtggcgcatacctgcagtcccagctactcggaaggctgaggtgggaggatcacctgagacaggaaggtcgagcctgcagtgagctgtgatcacaccactgcactctagctaggcaacagggtaagaccctgtctcaaaaaaaaaaaaaatgaatgaaagaaaaacaaaattgctaagaaagtagattttaagtgctctcactacaaaaaaagataagtatgtgaaataaggcatattttaataagcttgatttggccattccacaatgtatacatatatcaaaacatgttgtacaccataaaaaaaatacaatttttatttttgtcacttaaaatagttataccatggaatactatgcagccataaaaaggaacaagatcatgtcctttgcagggacatagatggagctggaagccattatcctcagcaaactgacacaggaacagaaaaccaaacaccacatgttctcacttataagtgggagctgaacagtgggaacacatggacacagggagtggaacaacacacaatggagcatgctgcagcaggggttgggggaggaagagcatcagaataaatagctaatgcatgtggggcttaatacctaggtgatgggttgataggtgcagcaaaccaccatggcacacatttgcctatgtaacaaacctgcacgtcctatcagtctttgataacctttccaggaagttccattatgctacatggaaagaaaatgggattctctggacaagctctgagctctattaattctctatggtgacctcctgagcccaaagaggcctcctggaatgccagtcttttccctataggtctcaaacagcacatcccttaaccacagcggtccaggcttgccaagtctccaatttacataaagacaagtcataaatgatatgtgatgtggaagaatgcttatcatatatttataaaaacaggtttaaaatagttattacataagaatccagtgtcaagcacaatagtgcatagtcagtgctcaacaaatatgtgttcaataatttaattaattttagccagaaaatgggtatttattttctacacaaaacatacatgcatggggaaaaaaaactagaaagttatattaaataatattaacaagtactatctcagggttattggaattataagtactttttgtgtgtgcgctcttctgtgttttccaatgttgggtaattacatgactattttgcaatcaggaaaaaaatattatttttataaacaaaccaacaaactatcaaagctactactgagctcttccatgctcccaacagcatcaatgttggcagtaactcagaatgtggtctttatataaatagcagtttgactgggaaaggaggagagggtgtacttaggttctctgaaggtcctagttgaccaagccattgccaaggtgtcacccttgctcacggactctagggaagaaaatataggagcacaaggcaaaacttacctaaagaagtattaacttcaccctaggggattgggagagggagagaatttctctatctgatgacagatctgttccagagtctgctgtcaaatcttcagatgtcaggtagaatttgaaccagaattcaacttgattagggcatgatgcagacaataaagacataacatcatttaactccagagacttcaacctcttttgtagccaccataacatctagggcatgctttgtacatatggtgctttataccgcatttattttacttttttcgaattctaccattttccctcacatatcaatcctcagatctagaactatttaccaaatcacagttaagtgggcaaggtcattaaagcagctattagatgccatgggagacccaagagcacatgcatttgtttgcaactttttctaaatgatggagaaatcaaggatagtttataatgtgcatataacatttagtctcacaacaaaatctgattccctcacttcagatgtcacaattaggatctctatttaaaaaaactcctaaacccccaaaaagatgaaaatttaagatcagttgcaatcatgtggagaacataccactttatgttgggttttgtgtacaaatacacaacaaataccaccacagaagttgacaggtgaaaattaagtaagaacagaagatttggcagtagtaactgaataagtataaagacattgctgtatatttttaagcattaacattgtgtaacaaacaaggtgttaaacttagatgaaaatgaaaaaagcaccctaatgtaatttcagaactaagacaatgaaaaatgaaaaagtggtacttgaaaaagaaagaaagagagagagagaggaaggaaggaaggaaggaaggaaggaaggaaggaagaaaggaaggaaggaaggaagggagagagaaaagaaaaagaataaccattaaaagaaaacagtttcagacattaaactaacagggaaatatatatatgcaaaagtatctgtttattttcttacagcttaaggctgacaacctacagaaaaaatggcacagtgccgacctcttttggcatttaaaggacgcttaatttagtttggattatcagccagatttagagctaattggctttagaaactgtacagcaaaacctctatctagttccccctacagttcatgaagttctacacacaagtaaacacagattaagacctaattttaatctttttaatcagttatatataatttatatacttgttatcacaaagttaaactttaattctgtgaataatttatcacattcagctaaaacagtaagctatagccagctgtattgtacttatatgaattgcaaacataaagcttcattcagaagggcttctgaagtagctgtgcaggtcagagagagaaattcaaacatacagagtgggataatgctgatctaactgcactaattttgtcatagacactttagttgatatttagggtacaacatgacaatcagttctccctaactgcagtaaagcaaaaaaaaaaaaaaaaaaaaaaaaaaaaaagattgcctctaacttgggtggttgcagcctactttccttggaaaaggaggctatatgtagctgtatgacagcgtaaacccaatccattaactaattaaataaaccagtgcttaacagggcatgggacttcataagagcctttgttttcttgtgacgaaaaggtcaaaatctaggttttttttttttcttctttaagagatggtggcttcctatgttgcccaggatggactcaaactcctgggctcaaggaatcctctcatctcaggctcccgagtagctaggaatacagacacgagccaccatgtctagctggaagttagactttatctgcattcctggaatagtaaaagcaaagcacgggtcagctgctttcggtaaattctagcccataggtccaagtcaagttccaggaagccccctatgaaaaagattctgatattagtaccagtgtttagttcatgtcatggcctgacttaagtataggtcattaagtgtaatgccaaggcaggggcttgagtggtttggagctcatgactgttccacttggaatttatcctggtgtatgaatacgaatctatcaatattttttttcaggtggcttcccagttctcccaacacttttactgaaaagatactgtctaactatttatgtcaatatagaaacataaagtcaaatatatttgtttagtagacttgaagagagcctagaaacacactcagagacatgtaaacagcatcagacgaagatggcatttcaaatcagagttgaatggatttttcagctttgctgaggtataactgaagtgtactaaactgcacatatttaaaacatataatttgatacattttgactcacaaaacaatcaccacaatcaagatgatgaatatatagatcactcccaaaagtttccctgtagtcttttgcagtcctttcttcatggccttcttcatccatccaccccatctcggtaaccaatgatctgctttctgtcaccacaaattagtgagcactgtctagaattttatgtaaactgaataataaagattttactctttcgcttctttcattcagcatattttgagatttgctcatgtagttgcatgtatcaatatttcattatttcatattggtgagtaatattccactgcctgaatatatcacaatgtacttttcaattccatgttgttccaatgtccattgggttacttccagtttttggttattccaagtaaagctgtttgaacaagtacaattatttgaatagacataaagcatggcaatgttaatttcaatgtagaattcaaaccaaaatgtattaactacaataagagagagctttatattgctgtctaccaaaaagatacaggtcaatagctttcatataagcctttacaacaactttccattgttgtaaaagatctattctgaacaaaacaccaggcccagataatttcaaagttgtgccaaactttaaagaaatgatcatttccagttttcaaacagtttcaaaacatagggaaaaaatagtaagcttccaaattatcttgaggctagcacagccccgatccaaaaacctgacaaagtggcaacctccttcccctattaaaaaaaaaaaaaaaaaaaaaaaaaatctatgtaccaaaactttcataataaaaggtaggaaggatctgtagaccaatctcccttgtgaatactaatgaaaatctaagtaaaatattagtaaattgaatagggcataggttttaagtaaaaacaaaaagtgatatgcagaaatccactgatgtcattcattaaatgattaagagattacttttaaaggattttttttcaaaaaccatctttcatccctgatttaaataaataaacccctttgtgaactaagaataaaaggatatctcttcaacctcatgataaataggttagctgagactttgtttctttgtattgttcaaagacttttacaatgattattaccacagaataaattcatttccaaggtaaacttttaaaagaaagagaattatggtgggcagaatttgaaggtaccttgagagctggtgaaagtggcactgggatattcaaaatggaaatgaaagaattagcatatcatcatactaaaattgttcataattaacataaagcaattcatgtacaaaagttcattaatcttcacataatatttctattaaggacaaataaatcccaaatactgatcagaaaaatagtgaaactgagacagaaaatgaaattccatcagtgtatcttctatttcttcccaaaatctaataataatacagtcctgctattctagctcgcttgtgccaaacttttcctgaactgtataacaatggactattaccaaagtttgtggctagggttctgccatcaacagttctctactggatctccactagatggtagcaagtaaggaggcattacagactaacaaggaaggagccagtagtcagggttttgttttgtttttttacaggaaagctatattgttggatctttagccatagaccatgtacctacccagccttagaaattatttaaggggagaaattactagtttaataacccaataaacccatctataaatattcactttttaaattccttcctgctaaattcatctggaagaaactcattttttttctttttaatctgtgatattatccaaattcttgcagttatttgaaagtgctcaaatttatggcaataatttagaatggtttccattaaaaatgaagttttacagatccatctgacatttggagaacggcaaaatgcagcactcttaatatttatattttctagaccaaaattttaagttataaaatataccaacgattaaaacatggtggtatgcattaacactacggaatactgaaataatctaggtaggattttcaaaaaattgctaatgtactaaaatttactcactctgaccaatggtgacaaattatggtttatccaaagaacagaatttcatgcagccattaaaaaatcatgttataggtaaatacttgattttgtaattagttactaaagaatacttagtatgttcaggatctattacactaaaaaaattataaaatagtttggtttcaaacatatatgccactcatctactcatattacatgcacgtatggatatgtctaccaacaaaaacaataggaagagtcaccaaaatgttaatgatctctgagagataagattatagttattttcttttggggggtttattttctatcttttcccatcataaacatggattttttcactcatgacaaaatattactgaagatttctgtaatttattttttgagacagggtctcacccttgcccatgctggagttcagtggcacagttgtagctcactgcaatctcaaacttctgagctcaagggatccttccacctcagcctctgaatagctaggactagaggtgcgcaccactatggccggcctttttttttttttttttttccctactagcaatgatatcttgctagtattacccaggctggtcttgaactcctgggctcaagcaatcctcccacctcggcctcccaaattgctgggattacaggcgtgagctgggattacatggctggccaatatttctataattctatctttaaaaaaaaagaattgactctcccttgatcagactcaaaccttaaagtatgacatgttaattttgcctgacaggcattatctgtttgtttctccaaagttttccttcccccatcccctactgcccaatgatcaagtgctgtactgtacttcagtgcaacccacattctctctggccacttgcaactatcgttgctataccatttctcatcagcccagctacaatcctatgatctgctgatgtcaataaactattatctcttctacccacctccttcaagtcccttatgagcttgttagattccaaaacaatacctcagaaaacactcgcgtacaattcagaagacttaagaaatcaatactttaagccataacagtaaaatgtattcccaatactactgtacccatacaatggaatattacttgccaaaaaaaatgaaatactaatatgtgctacatggatgaaccttgaaaatatgctaagtgaaagaagccagtcacaaaagaccatactgtatgattccatttatatgaaatgctcagaataaacaaatttatagacacagaaaacagattcatttttgcttaggcttgggggaacaaatggagggaaataatggggattcactaacaggtacaaggtttctgttaggactgcaaacatattctaaaactagattgtggtgatggttgctgctatggtttgactatccatcccctccaaaactcatgttgaaatttaatccccaatgtggcagtattgagaggtggggcctttaagaggtgactggatcataagggctatgtcatcagaaattgattaatctattcatggattaatgaattaataggctatcatgggagtggactggtggctttataagaggaaaagagacctaagtacattagcaatcgccatgtgatacactgtgccgcctcaggactcttcagagtccccaccagcaagaaggctctcaccagatgtggcccctcaacctaggatttctcagcttccataactgtaagaaattcattttccttataaattttccaataaattataaatgtattataagcaatggaagataaagttgcacaactctatatataaattgaactgtgttagactttaaataggtaaattgaatatgtgaattatgtataaagctgctttttaaaatactatctttttattatagctatcactgattgcatcattactatgtgcaagaaaccttagaggtgctttttcatttgattcctaccaactctggaaggtcaatttctggtgttacagatgagaaaaacaggtttagtaaatttaaaacattaacacaagttactcaggaatggtgcccagatacatcactctaaagctcttgctttctaaactatgccatgcttgccatcaaatagttaaccaaattataataggagtatcgttgaatatataaatggccttagaaaagcagacatattgtttttatcaatagtaggaataaggttttttgaagtatcactgatagcaaatgaggtttaaaaggttgagcaccattatgttatttaattcaaaaaccacatctagaaaacaaatgcctctggaaaacaattaaaattaaggtcatataatttgtctcacgtctttcagtttatgtcagagctagattgtatcttgaaaataccgacattatctgatttgccattttttaagtcaatgcctctgaaaattactctttaatattagctgaaatgccaacaaaatgcacagaaatgattatcatttccttaaactatattaggcaaacatattcctttatttagattttatattcacatttagttttttatgcacacatttaagactttataaacactaacattagcaattccagaagggtaggtagattttttaaatataattactcttataaaaggaagaaatagagactttactaaaggactgtatttttgacttcacctataatgcaactaatcatctacttagttgctatgttaatctatttgcttcttcagcaaattatcactgactcagtggtttaaaacaacacaaatttaccatcttatggttctgtgggtcagaagtttgacattgatctcactgggctaaaaaggtgccagcaaggctgcattcctttctggggactctaatggagaatctgtttccttgccttttcaatctttttttacaggcccccttcattccttggctcaaggtgtcttcctccttcaaagccaccttttaacttccttcaaaagtagttgtctttcttatacaggatcactctgacctcctcttttgcctccctcttcaacttttaaagatccctacaattatattaggccctccaaagtaattcaggataatctccccatctcaaggcccttaataacattttaaattaatcacttctgcaaaattcttttgcaatgtggcataacatattcacagttcctgagaattaaaaacattggcatccttaggcaaatctgcttaactttttcaatttagcttcatatctttttttactccaagatagaagagtgatgtttaaagtactcaagttacagccagcatttaccaattctttgattcgactttttaaagtacttatgcttgaatccagaacccgaggattttcgattatttgtgaaatgctaatgttttcttccatgaggcagtctattttatcattaaactttttctctgccaagaagatcacatctggatagcttaagacaaacttctgtacctcttcttcagtacatccaagagaaaacagcttctctttgatgtttgcgtagcttcttctggcatagtcattggaaaggtctaggatttcagctcctggaccacatatcagaaccagcagttcctcactgttcaaattgaaagttgaccgtaagaattcaatgttagctttcacccgcttggtgctctgaattaagataaaagggtttttaaaaattatctttctgacaaaatctgcgggatcattgtgacccaatgacaaaccggctgcctgcaaaaattcaaccatctgtttattcagatcaagactattggagaaggtacgaggggcattggtcaacaatcgacaaaggcatttacgggtcaatccaactgagtagaggaactttatattattctctaagtttaggttgttattggaccgaaaaaaggattcaggagaacgttccaaaatatttacaatttcaaggtctgatgtcacaatctttctccacagatcccaccgttttgaaagattctcgggagtacgtgttattgctcgtggatatcttgatatgatgctagcgatcacttctttgctagctcctttggaaagaaggaacatcttcaggtcctgctcattggtaatcatcctatgaaaaactccaggctgtcgtttccttgccatgtcaatatctactcccatagtaagtaagtttttcagtaggtcctcatttttcaaaggctcactgtctgtattatgacacttcacaccaaaaagcctaaatgaaactgatttgaagatgttttctgctgaaaatcgagtcatccaacatcttgaaccaaagagaaagttatttctcatatgccagaggtttcctggtgccataatggttaggtagttcaaaccttttgaaatgctgtgtaaaacaacacataaaatattacacaaatgcatgtgttaaacaactaaatgaccatattacaatcctataagcatcatggtcatttctatgagaatataccttcagctccagctctccagaactgtgttaataattcagccactgctgaattattaaataaatagtaaaactacaatttatatttgtcttagcctttgaaaaattctacatgttttataatataaacaatatgattgtactgtaagacatatataatcaataaacaaatgtacatatataactgtctctccctagctcactgcttctgttacctgtaagcacaggactgcttccattgttaacctaaagaaaagcaggtggggcaccattagtgccccagaattgttcttgcttttttcttgctctttttgtttacctttgcctgccttggctacctaaaatcagttgaccctctccatctctgctttgtcctcctgatttccaaactttttttttttgacacagggtctcactctgtcacccaggcttggagtgcagcagcactatcatggctcgttgcagcctcacctccctgggctcaggtgatgcttccacctcaaccacctgagtagttgggaccacaggaatgccccacacgcccagctgattttttatttttattttttgtagagacagtgtttcactatgtcacccagactggtctcaaactcctgggctcaagtgatctgcctgccttggcctcccaaagtgctgggattacaggtgtgagccaccatgccaggcgtggcttatttcttataatgacactttcatttctgcctcatatttcaattttccaggtcttcgaccttgccctgcccatagatactagatttctttgcctctggcctcctggttttcaaactctaaatctagccctgaaaaccaacacctcagattaatttccatcttgaacatcttttcctaaattcctgctaccctttatatccatgctaccattaaagccttaatttttcttagcttatatagacctctagtcaacagctcttgatcacaatctccatctcatttggtttaccctatcattccctacgttgtaacccaataattccaaaccaattttcatcttcaaaatgatctagttgtgatattaaatccacatggcccgccacatgtgaaactgtgctgaaagatggcatgtaaacattaaaacgttacctttaccattctccccttctccatcaccatattacacaagactaattctgggctgtttgcatctgttacacaacactttcaacttgcagcttctagcatgtgactaaaacctcaataactcattttcctgatcatttggaaatggggctcaaaacatacaaacttatttataatcataaccataggtccctactaaaatgagcatctctatttataagaaatattttatgaggaaagcaacagaaaaagtgttctgttattcaacctatctgatgatttgtttctaagctacttgtgcctgagtcatataacagtacatatatattttttaaactgtacttttgcctttttagaatatatagctgtaacaagttcgtgcttgatttctaattacttacaatgggctcttacttagaaaaggcatttcttttttctccttctcctaattaagcataaaacagaaaatagagatagataattccaacccactactaacctctttgggctaaagatactgctttcaagatcaatttcaaagaaagcctctttgtgtctgtcctttcaattactccaattttaactagaacttgattatgcctacaggcagggaacattcctgtggctcacataatctacagattctcacagaattgggaaaagatcccaaaactacagaatcaagtaatgttcaaagccaaatgcaaggtactcacaacataaacatcaaacaacaaaagcacatttcagattgatccatactctactgagctcactattcttcacttctccgtaataccacatactactctgtaattactcttccaaaaatgcatgaatttagaaactttaaaatataattatccttctaactgaagaatgacggctctaccttgcatagttcaacagcctgttttctcttccagatgctcgactgacctctactggaataaaggggcagaatgcgtcagctggaaatcagatcagtactttctagagaggtccaagatgatacaatgggatggaggaagaaaatagttaaaactacaatttgtatttgtcttagcctttgaaaaattctttctacatatgttttataatataaacaatatgattgtactgtaagacatatataatcaataaacaaatgtacatatattgtaggcatatttctattgacaatgtacacaatcaaaaaagtgtgaagactactagacagtgcactttcttaggactattagcatcatggtaaacaggctgaataagccacagaatgttcaacagaaattctattaataacaaactaaaaataggtgaaaatgtaagccaaaattcctaacaaaaagtaacaaatctataaacgtttcttctaaatctgtcacaagtaaatttcatgtcttgtgtataactcatcctccatggaagtttcttccacacaaacttaacatgccccaaacttgagtatctttcccagtccccaaatttgccctcttctgactaaagatatcattatcacaatcactatctaagagtcatttgtgataaaaatctaaaagtgagctttgctttcttcctcttcctcaactccagtcatcaaatcacgtagactcaacttctttggcatctctctgaaatccaacctcgctactctttgtaattctcattctgttacaagtcttcattctcttttacccagcctgtaacagccacctgatgtgcttctctgacatccatcactcgaaactgccaccatactgacatttgtaaaatgatgtgattatgtccctcattctctgattaaagaccttctgtagctctccccgaaaaaacaaaatcttcaaagtgatctttttctagctaccttttcagttagctaactaccttaccatctacttctaactacctttctagctatctcttctattgtaccacctcaatacctagcactatcgcctctcaaacctctgatcccaaacatccttgcccattcctgtctccctacctttgcttaagctgttctttcttttagaaaggcccatcctcctgatgcctatccataggacaaggtcccattcaaatataatcttccctcaaatccttaacttactttaaaatactaaccactgaaatcaaccatttgttttatgataatttattactaaggaatctaaaactaagctttctatttatagaaaacaagagctgaaatggacttacaactggcaactgaaatttggtcttgattacaatactaaaatgcaataaatttactctaaaaatgacatctaaaaatgacatgtgtggtctcagctaaacctagaaatttggtcttgattacaatactaaaatgcagtaaatttactctaaaaatgacatgtgtggtctcagctaaacttagaaacagtaattaataatattgactgttaatgaacatatgaggaaacagaggaaattctcaaatattgttaatggaccagaatttggcaccagctgccacaattttaaatgttcatagcctttaattcagcatttccacttcttggagattatccaaagggggaaaaaagggccaggggcagcggctcacacctgtaatgccagcattttggaaagccaaggtgggaggattgcttaaacccaggagtttgagaccagcctggacaacaaagtgagacccttattctacaaaaaatcaaaacattagccaactgtaacagcacacacctatagtcccagctgctcagaaggctgaggtaggaggactgcttgagcccaggagatccagactgcagtgagccataatctagccactgcaccccagcctggatgacagagtgagcccatctcaaaaagaaaaaaagacaatatgtgtttgttatgaaaaaggatgactaggccaagcacagtggcttcacacctataatctcaccactttgagatgttggccaggagtttgagatcagcctggccaacatgacgaaaccccatctctactaaaaatactaaaattagccaggcatggtgatatatgtctctaatcccagctactcaggtggctaaggcacaataactgcttaaacctgggaggcggaggttgtagtgagctgagattgcaccactgcactccagtctgggcaacagagcaagaatctgtctcataaaaaaagaaaatagaagaaaaagaaagaaagaaaaaggatgaccatcataacattatttgctataacaaagaagaagaaacccaaatggccaccaatagaataattaataaattgtggtacatctatgcaatatactataaaggtgccaaaaataaaggccgatctactgcaatcaaaagatgtcagatattctacatgacaaactgcttaacagtatggataatgccatgtatattaaaggcggggagggggacgttaatatatacagagggggaaagtggaatgacacttatttctgaaagattattagaggctatgtactacttctgaaatactgggactttatttaatgaatatgtgttactttgcagtcagatgaaaaaatttaaacaagtaaaactggcctttggtgtgaaaaacaatggaaaatacaaattatctttatctatttttcggtttctagtaccaaaaaagtcacacttcaaaattctccatgatgctttactcttagcaacggatctccattcaaaatactcataatatctagtagggtaaatgaacatctaaatagcctaatacaagaaagttagcaactttcctcacgtacaaatttcaaaaatggtacctattcaaaaattgacttcgatctatttctcaaattgactttttaattaaccaaaaccattatccaaagggctaatgttcaaacttaacaaacactgaaaatttctatgcttgtagtatgaggggtctaaaaaaagatttacgttcgcctctgccccacaactggcctgttaaaaaggctgttaatggaaataactaatcactggccctaaaataccacattccagctggtcttcttttgatacagcaagctaagtttggagatctttacatgcatttctcaccttgtttgtcctaaggaaaggctctgcatccctccagaaaggctggagaacagctatctctggaaatgacacacacacacaaaaaaaaggcaaaatatttcaggccttcctaatacaaaataagagatcgatcccagctaacgttctcgttgcattatgttctcgtgagatgcattacctcttgcaaacaacatttctcagacatacagaaaagaaaacggcaagtacatgcctacatatgatgggaaaaggtagcggaatcacgaatacgttttgtaccaaagctaagtgcttcatatatattgtctcgctttactccccacaacaatttaaaaggtaggcataagccttaaaattacaaaatctgaaacagcgccgagctcccatactagcctgccttcgctagctgaagcattagggttcgaacccaggtgggtctttcttaactcaaaaccaaggtaattccacaccgaaggctctttccatccctcttcctcctccaaagacaaatctgcaaagggctgcactgtacagcagtcacccacacccacttcttaacaaaaagaaaggaaagcacagcctcaccaccttcccaatctcaccctgaactgcacccatccactgtagttcgcttttacttccgcctctggggtccggagcggctaggaggagcggaagtggaaaagactaacttccggcctcgggtcgcgcgcagaggtgatgtcgttggtcctgcgccccctcgtggcggtacttcagcccttcgcagcccgacgctaggggcctggcagggggcagcaagagaccgcggtgagcgcggggtattgaacgccaaagaaggggtttggagggtggggtggggcctgggactcccagtcgcctgggcagatgtccgtggggaactgtaaggcatcttatagggatcctacagggggcatccactgccggccgacgacacgtggtggaaaagtagctattatttacatgcgtgttgcagtttttgataatgcgattgctgctgctaatgtgactaacgcgatgccgatgaacatctcggcgttttttggtgcaggataagcgggtgtagactctgtctgtttagtcccagattctcctcctttaatgaactaccgtggaaatcctggagtgtcactgctggtctgaattcagcatccgccttcaggctggaaatcaattctagtatacttcgatttccttacttgcagttcgaattcaaatatgattcttttgacattgtgagggtttgcgctatttaaagaatggaggcaaccgaaacctcatctccacagtggatgcatttttgctccctcccgaggcgttgccttaagccacgcggtcctgtcagcctcacctgcctagtgatggtgacaatggaagagataaagcttcaattcaaggcacttctcctgtgaccatcaaaagaaagataatatctacattaatgaattaattgtgtctgtcgagttatcctcaggagacgatggtgatttggtccttaaaaaaacacaggatcaacaggattgaccctgaattctacaaagaggaaaaatttcaggcattactaactcctccatgtacaagcctaatgatgtaattttctggccgggcgcgatggctcatgcctgtaatcccagcactttgggaggccaaggcgggaggatggcttgaggccaggagttcgagaccagcctggccaacatggtgaaaccccatctctacaaaaagtacaaacattagccaggcgtggtcacaggtgcctgtagtcccagctacttgggaggctaaggtgggagaatcacctgagcctgggaggttgaggctgcagtgagccgtgattgtgccactacactctagcctgggtgacacagtgaaccttgtctcaagaaagaaaaagaattttctttatcccatttctttctcctttttcttttttttttttttttttcctttagacggagtctcactctgttgccaggctggagtgcaatggcgcgatctcggctcactacaacctctgcctcccgggttcaagcgattcccctgcctcagcctcccgagtagctgggagtacaggcgcgtgccaccatgcccggcaatttttttgttttgttttttgtttttttgtttttttgtattttagtagatacggggtttcaccatgttggccaggatggtctcgatctcctgacctcatgatccacccacctcggcctcccaaagtgttgggattacaggcgtgagctaccgcacccggcgtgtttatcccatttctatgccaatgaaccaattacgttttaccatcactcttcccctttgactactcctagttgggttgttgttgtcactttgtttttaattaactctctgttttgttggtttagaaggataaagatttatctttgggaatttaaaatactaataatcagtctatctattaagtaaactacttactgcaattcctccaggtaaaaattagtcccaaaaaattggagatggcttttaaaatgtgaatttctaaaatctatattccttctgcatggaaggagctcctatgtctgaattaatattattatatattatgtatatacacacacacaaactgctttacaatcggcatgtaaaataaaatttagagattaaattaaataaaataacctttgagattattgagccccagccctctcattttacaaatgagaacactgaaacccatacagtaggaactagcaagagaatgcatgtcttatattttctttaccagtaactctaagatttataccacatactttgttgtattgatttagctatcaataattatttcagacttacttaggtaacatcacctatgttggtttttagtgatattttgtcggtaaaggcagattggttcttttgaaaataagttccatatttcccatcagaaattttctgattataaatctattttaattgcatattataaaatactgaaagtataacaatagaagtgtaataatggttgggttaggatgttgtataattaattaggtttctttcttattgtatttcttcagtgatttttgaaatgtcattacctccagtaagagaaatgactactgcctcatcgtcctttatgatgttttacaataggacctgtatatactttgcctgtatttcatttgtttattcaatgaacattttttcagcaccttcacattccaggccctgttttcaagttaggggacatagtggaaaccaagacaaagcccctgccttcctggaccttatttctagtggcaggtcttactctcagcctgaatgtcttctcctctacatgcctcttccatctccttccccaggaccatagcagacccatgtccctaccaagttgatgtaattaagaaaaataaagtggctgagtgtagtgattcacacctgtaatcccaacacgttggacttagatactcagaagctgggctgaaagtcaagtctgaagacagaatctgtgctgtattcagaagtgcctctgccttttataattaagaattttttgactgtgccaaatgtgcctgttcctctgccctggaagtgtccttcttgctttatgcaaatagatttctggcaaaccacagcccctcaattgaccattcattcatgtttgaatctcagcaagcccaattaaggtcaaaaagaaagtggcccttcattcctcccactcttaccttcagttgatacaacacccgcagactcctggattcagtagacaaatgcctgccccacccccacatcaacttcacagacagacctgctagcttcctatgtgacttacttgagggccctcagaggaccatcaggtctctacccaggactcccttattccattctcttgcctgcagctgttttggttgccaaaagcataaaatgtctcccagttgttcaaggctaattaaagtggtagataaagttacccagagagtctcaggttaacactttgttggcaaaaaataaaaaagattgcttaatttccccccttttcacaattgctttttaacaatttaagatttctaaagattttacttcaggcaactttatttctctgaagtgtgcctaaagacttcctgagtcagctttcatgctcccacactcattaccacaagggtctgtggcaaagaactggatacttagcctagcaaatttgctgattccagacctgatatgacagcaattcccatggtagttggatcagcctgacagagttggccaagagaaacacaataatcatttgagatgctatttagcctggtgagtttaagtaccttttggattgtttgatcctactgtaccaaaccttcaattaattaccgtgaaatgattcttagtcattggtagaaaaattagtctcaacagagaggaggggagcaaacattcacaagatgaaatactattttcactgtcgaaaactattttcctttctatttaaggcgtttcttgaaattcctcctttagagatttagtccttggtataaactgtgctgatttaaaattgcaaatgtatttgaaagggaaagcatattaagccaaaggtcagcaaccttttcctataaaggaccaaatagtatttcaggctttgtgggtcacatactgtctctgttgcaaattctcttttttctttccatatttcacaacccattaaaagtataaaaaccattcttagcttgggggctgctgggccacgggccatagtgtgctaagacctgcattaaaaacgatagtgaactactcacatataactaacttcatttgttgattactatattaaagacatccaaaaactaggaattttaagagaaagtacatggagagaaaaataatatttgaaaacatttatgtaatgctatctgccatgcacaattctaatcatttcacctctattaactcattttgttgtataatggaagtaatattatctccattttacaaatggggaaactgagatagagactatgtagcttccccaagctcacgcaggtagtaagtaagggagccagcattgcaacctaagaagtcaggctccagcgtctatgactgtattcacaatgctatgctgacactcggggagacataatactttaatttacgttagaaaatacaaataaagaagaaaggagcaaaaaaataataatttcacttataattccatcacctagaaataaccactatttatattttatttatattattttggtttctatccttccagaacatatgaaagaatataaagcaaaagaatataaataaaatatgtaaactaagtattttaggcattgtgggtgacatattgtgtagctgtaactgaagctaagttacagttatatgtgagtagctcattatagtttaatggaggtcttagcagactatggcctatatacatatacccatagagtatattgaatatttttattcaaccctatgaggcaggtatcatagttttgcagatgaaactgaggctcagatgaattaagtgactgtgtgtcttcgtccatttttgtgttgctataaaggattacctgaagctgagtaatttataaagaaaagaagttcaattggctcacagttctgcaggctgtacaggaagcatggcactgacatcttctcagcttctggtgagggcctcaggaagtttacaatcatggtggaaggcaaagggggagcaagcgtctcatgtggcaagagggaacaaacaggagacaggaggtgccacacacttttaaacaacaggatctcacaagagcttactcttacaaggacagcaccaagaatatgaggaatctgcccgcatgacccaaacacttccctccaggccccacctccaacactggggattacatctcaacactggatttggaggggacatccaaactatatcaaggctgtacaagaagcttggtgccagcatttgcttctacgcagagcctcaggctgcttctactcacagtaaaaggcaaaagggcatgcaaagatcatgtggcaagagaagaagtgagggatgggggatgccatgctctttttaacaaccagctctcatgggaaccaagagggacaactcactcattatagcaccaagcctgtatccctcccattatgccctacctccaacatcgaggatcaaatttcaacatgaggtttggaggctcaaatatccaaacaatggcattatgtcaggatcataaagctaatgtttgtgaaaccaggatctgaacccaagctattgcttctagaacctgtactcttaagcccttgcttatactgcatttgaaattatgcttcattgtataaaaagtccttttcacctcaagcttatagagaagtcaccttgttcttaaaaagtcctttacacttcaagttcataaagctcaggcacatatattttcttccagtacgttcattattatttttcttggttttcctttaaatctttgaatcatctggattttattttggaatgagaaatgaagtagaaatttatttttgtttcttttcagaatggctggtcaattgtcctaacatcatttaatgaatagtatttatttcccctttgctttgaaatactactttatcatatactaaattataaagtaatcttttattatcatttttgaatgactgcattccagttgtggaagatattactcaaagtctgttgtgattatctaacttaagtgttgatatgaagaaaggaaagtaggtttcagcctgatttaagaattttcctcctctccctctccctctccctctccctctccctccccctccccctgcccctccctgtctccctctctctctccctctctttctacgtctccctctcttgccgagcctggactgtactgccatgatctcggctcactgcaacctctctgcctcaggctcccatgattctcctgcctcggcctgctgagtgcctgggattccaggcacgcaccaccacttctgactgatttttgtatttttggtggagacggggtttcactgtgttgaccgggctggtctccagctcctggcctcgggtgatctgcccccctcagcctcccgaggtgctgggattgcagacggagtctcgctcactcaacgctcaatgttgtccaggctggagtgcagtggtgtgatctcagctcgctacaacctccacctcccagccgcctgccttggcatcccaaagtgctaagattatagcctctgcctgcccgccaccccgtctaggaagtgagcagcgtctctgcctgaccgcccatcgtctgggatatgaggagcccctctgcccagctgccccgtctaggaagtgaggagcgcctctgcccagccgccaacccgtctaggaagtgaggagcgtctctgcctggccacccatcatctgggatgtgaggagcgcctctgcccggccgccctgtctgggaagtgaggagtgcctctgcccagctgccccaaatgggaagtgaggaccgcctctgcctggccgccctgtctgggaagtgaggagcgcctctgcccggccgccccatctgggatgtgaggagcgcctctgcccggccgccaccccgcctgggaggcaaggagcgcctctgactggcagccccatctggcaactgaggagcgcctctgcccggccgccaccccatctgggaagtggggagcgcctctgcccggccgccccatctgggatgtgaggagcgcctctgcccggccgccccgtctgggaagtgaggagcgcctctgcccggccaccctgtctgggatgtggggagcgcctctgcccagccgccaccccgtctaggaagtggggagcacctctgcccggccgccctgtctggaaagtgaggagcacctcttcccagccgccaccctgtctgggatgtgaggagcgcctctgcccggccgccccgtctgagaggtgaggagcgcctctgcccggcagctgccccgtctggaaagtgaggagcatctctgcccggcagccccgtctgggaagtggggagcgcctctgcccagccgccccatctgggaggtggggagcacctctgcccggccgccccatctgggaggtggggagcacctctgcccggccgcccatcatctgggaagtgaggagcgcctctgcctggccgcccatcatctgtgatgtgaggagcacctctgcccggccgccccgtctgggaagtggggagcgcctctgcccggctgcccatcgtctgggaagtgaggagcgcctgtgcccggccacccatcgtctgtgatgtgaggagcgcctctgcctggctgccccatctgggaggtaaggagcgcctctgcccggccgccccgtctgggaggtgaggagtgtctctgcccgcccgcccatcatctgggaagtgaggagcgcctctgcccggccgcccatcgtctgggatgtgaggagcgcctctggctggccgccattcgtctgggaggtgagaagcgcctctgcccagccgccccatctgggaagtgaggagcacctctgcccagcctccccgtctgggaggtgaggagcacctctgcccggcctccccgtctgggaggtgaggagcgtctctgcctggctgccccgtctgggaggtgaggagcacctctgcccggccgccccgtctgggaggtggggagcacctctgcccggccgcccatcgtctgggaggtgaggagcgcctctgcccggccgcccatcatctgtgatgtgaggagcacctctgccgggccgccccgtctgggaagtggggaacgcctctgcccagctgcccatcgtctgggaagtgaggagcgcctgtgcccggccacccatcatctgtgatgtgaggagcgcctctgcccggctgccccatctgggaggtgaggagcgcctccgcccggccgccctgtctgggaggtgaggagtgtctctgcccgcccgcccatcatctgggaagtgaggagcgcctctgcccagccgcccatcgtctgggatgtgaggagcgcctctgcccagccgcccatcgtctgggatgtgaggagcgcctctgcctggctgccccatctgggaagtgagaagcgcctctgcccggccatctcatctgggaggtgtacccaacagctccgaagagacagcgaccatcgagaacgggccatgatgacgatggcgcttttgtcgaaaagaaaagggggaaatgtggggaaaagaaagagagatcagattgttactgtgtctggtagaaagaagtagacataggagactccattttgttctgtactaaggaaaattcttctgctttgggatgctgttaatctataaccttacccccaaccccgtgctctctgaaacatgtgctgtgtcaactcagggttaaatggattaagggtggtgcaagatgcgctttgttaaacagatgcttgaaggcagcatgctcgttaagagtcatcaccactccctaatctcaagtacccagggacacaaacactgcggaaggccacagggacctctgcctaggaaaaccagagacctctgttcacgtgtttatctgctgaccttctatccactattatcctatgaccctgccacatacccctctccgagaaacacccaagaatgatcaataaatactaaaaaaaaaaaagaattttcctttatagattatttttctttttaacaaaattaaaaggatttagttaagcatattttggttcaaactttccagttgttatagaagtgtgaaaaatgcaaactgagcttgaaggaatattgaatatcttgtccaacccccgttatttatagataaggaaactgaggtccaaaatggtaaaaattattatttaacaaataatgttgctagttagtgactattacacaggattctttcaattgcaggtggcagaaatgcacctcaagctaactcaacccaaaaagggaaacagcacaattattttctcctatgggaaaaaggcagagatgtcctcaggcacaactgaatccaggaattaaattagatccaccgctctctctgtatctcatctcagcttctctctgtacgtagtcctaattttctcaggctctcctgtgcaacaaggtatatggctaccagtatctctaaggttgcaaccttttaactggaaacgtaaaggaaagagagaaattctaactattagtctttgaacatcaaatccaaaataaatattccgattagcttctttgagtcatatgaccatcccattattttggaggtggggtggaggtggcaggatatgtaattggcagttccagaaaaaccatctggagttggagaaaggaagttaagggaaataggagctcactattactagcatgaaggaagggaggttggacagacaaaagcatctactgtccaccagggcagctggagaccctgaattggagttgggggtctttgatctttcattcaatcatcttttcatttctctatttattcattcaacacatagttactgagcagtctatgaggattgtatttagctgcaagcaacagaatctccagtcagtgatggcttgtatagcaaaaagtgtagagataggagttaactgttcacattgttttctaacaccatgtagtctcaccgtttctcaagcacacccttgcgcttccttgcccctggtcctttgtttgctcctcttctctccatctttacttgttagtcacttaacccacagggcaatatcgtctctccctgaaggcttcccaaatccacttctttcccacttttgtataaatcagaataaatatttcccaattctgtatgtatgtaacactttgttcaatcattataacactgaattcattctgccatgtgttaaaattaatttgttgcatatgtatcgatcttctccacagttagaaattccttgaggacacagacttttctccatttttgtggaatacaggtgtcaacatcctccatcctctgtctctgccagctatacatgctccctgctggagctagaacctaggaccactttgagttctgctaaagtaaaccacatcacctgtgaacattagtgagcattagtgagcaatatagacttcattgcaagtttgtcaaggggttacataccataccaaacagaaaaacaacattgagatctcctgttaaactcactggcctacattttcttcttactgactgattggtcctcaggcctccagactccccattattttgtcccaattcagctgtgccctagcctcatcttcacactggcacccccaaacccagtatgaggctcagcaaaataaagtttcatctaggtaataggccttacccttgttagtggatagtggggatttaaaatagcagataatattgtatttagtaatagttaatattttttaaggatttattatgtgtgaagtactactttccctgcaaggcagcttttattatccccgttttacagtgcagaaaagggagtcacaaagaggttaaataaatagccccgtatcacacagctaggaaataggaaccagaaattgaacccaggctatctaaatccagagcttgggccctaataaatataccctactaacctttatagaacataatgcagtgccttccctagtaaggtatcaatatgttagctggattaaatttacttgcataagagcatcagaaacactctaacctcttatatttctaactaacatgtcattatgtcattttattcatgaatatctaaagctttctgtttttactagtattatatgaatgaatgaatggatgagcctactaatttattgactctggaactcagattcctcatctgaaaattattttattggtcatataatatccaccattatatcattgcttatataatatcctccatgtgggtgccagagaaaccatgaaatataagaaatacctcctacttttggcaagtctagtggagatatttacagtctgaaagaaaaaggtgaaccaagtgatatcgaaggccccttccagctctaaaattctaagattctatttagtgggagatttgctcacattgtacctaagtggtagattttttattacaagaagatggctcatacttcctcccctcctaagtgcaaaaagagtaaactctgatacattttaaatgactactgcccttgctaggcacttgaagaggagacaagtactgcttgtcatataaccactgaggagtgaataatacagggctgcctcaaagcaaaataatgaagaataggaagccttactttattgcactgccccctgccagccttcctcattgctctactaactccaatacgtactaaccagtgccctccagatcccacttgacactagccacaccagccaaacgcggtttccccttctccagaactgcctgtacagcttccttcttcacttttacccatgaggtggatgcttgactctttcacctctgtatacttcatatcctgtggttctcaatcctagcttctattaacatcacctagggagctttgtaaacatacagaagcccagctgttcacccccagagattctgatttaatgggtttgacatgaggcccagatattggtctgattttcattgtttttctttttaatttccagcagattattctaatatatagccagaattgagaactactgcacctttgaaaccagagttgcttaatttttacctgctggttaagcccttactctggattctggggtcaattctgatctcagccagggagtattcaaggattcttaggccagcagctcagcggctcaactctcagagcttaatcccacagtggcctggactcccagttgcagtaattacaggctgttgttgttcattgtgactaagcctctcccccaaaggaacgtgagtgataaaaggagaaagagttgctgggcagacaaaatggcaggtgtttaatgccctcccacttctttctgcccccatcccctactctcaacattttaacaaacttgtactgagtaaatagtgtcacttagtgacaagcatgcataggaaatcatctgaccaaacatctcttcagccatgctttatgtcaagctgccaaatatttctctttatttcactacatacctctttagtgataccttaataatctctttcccacagatgactcatctttaatccccttccctttcttctccctcttttaacttgtacctagttaattccagaatcctctcctctcctttgattcatgtttacaaacctctcccccaatgctgactgtattcatgtctaagcataagactggtataaatgttatttttttcctttttcttggaaccccatatacattggaatatcagtggtttatttaaaccaaagaaaaagaaaactaaattttttaaacatggaattttgatatgaaaataaagaacatctagtgtccataaaagtactattatttgatacttgtttggcaatcttttttttttcactgttttttctgctttttttttttttaacaacacttcattggtgtgggttattctcagaacattagcaccatctgtaacactgtttaaattggaaattctactctaagtaccaaagttttggaacccagctcatctgtaaattgaggactgcatgaatatgcctaacagcatgctgggcaccacattaactaagaaatccactttgccagtgtcagagggaattgtttttaaggtttgccaaaggagaggaatgcatatgaaggcagactttaatagcatatgtttctgtggataagactgatgactggccgggtgcagtggctcatgcctgtaatccaagcactttaggaggctgaggcgggtggatcatttgaggtcaggagttcaagaccagcctagccaatatggtgaaaccccatctctactaaaatgcaaaaattagctggacagtagtggcacatacctgtaatcccagctactcggaaggctgaggcaggagaatcgcttgagcctgggagacggaggttgtgataagcccagatcacaccactgcactccagtctgggcaacagaatgagattctgtctcaacaacaacaacaaaaaagactgatgacttcccagccatcagtgaggtatagggagttattctcttgtttgccctagcagaatctgccatatatgatgttcttagtgccaagcactaagacacagcaccagtgaacccattaattactatgagaatttgtcgaagcagttcctattatcatgcctggaactattctcagaaaggtgcttttaaattttaagtatttgtataattaaagtaagtactccaaagtatgttcatttttcctgacattaaatataaacctaaccttgattctgttctctattttgaccaggcagtgtgatcctctgtgaacattagcagaagaccaaaaaaaaaaaaaaaatcaaatgttgaaagcacataaacaattaatttttttctattatgcagtgaagtgtatgttctgtattgcccttgaaaataatgcaatcatgatttgtgatctgtatgtatttttagtacatattcaaattagccattatgaatcaagtatcctaaaatcatttaattaattagctgcattatttaaacccctacttaaatttcttccctagacatattattcctacagactaaattattcatctcaccaaactttctagactgacaaagccacttgctttctagctaaaatgatattgtgaaagtgagtatctgctcaacaaatactttttcttttattaaaagataagggtaaagagccatcatgtctaaaaatagctacttggagcttaaaatctgtcagaccatatgttgtaggactccaagatccaggaaacaaagacattcttctcctggggatatgtgttattacaatcattctagaagattaagtgccagttcatttgtataactgtccagtcatgtaaacatcctcagaagagaaacagatatgaattcctggggatggtgaaggaaaaacattagtgaattggaactgaactgatctgcatgcttttgtgcctgtgttgtgagaatccatatgagcatgtgattttttttctagtatccttaagatttattttcaggaaaaaagttttacttttcttgtttctcattgaatgtcaatgggatggccacaaaatataggatttgagatagtctttgcctataagcaagatagcattttacaaagcattatagtgtctttgtaattcttttttccacattgaaattttaacattttttttcttcgttttttcacttttgttttttgagacagaatcttgctctgtcacccaggctggagtgcagtgacatgatcatatctcattgcaacttcaaattcctgagctcaagggatcctcctaactcagtctcctgagtagctgggactacagatgtattccatcatgactactttttaaaattttttgtagagacagggtctcattttcttgcccaggctggtctcaaactcctgggctcaagcaatcctcctgcctcagcctaccaaagtgctaggattacagatgtgagccactgccccggcccacttgtaaagtttaaaaacttattttaaagctttgacataagttctcaaacatattgccattaatctctaaatatgtcttacatatatagtgcacattttataatgttttacatattttgtgtggtgttcacttaatcatcttcagaaatttaattacaatatgctattagataatcattctgagactgtgtacatagtacattgaagcggtgtggcaggtactcagtttggaccacagacaattgcaacctccaaatgggatttttttctacattagtaactatcaaatctccacttctctttagatcagagagacccaactacattggcatatttacaaagccaaacactttttaaatgctgaggttgagaggtccaagtcttctccaattacttgggaatgattgtgcagactagttgtaaaggtagaaatgtatattctttgtcaactaataaaagaacttaagtccttttcaagtgatggagaaggtgggaggaaatgaatttcatttcagtgtgttacttctaggtcatgaggccatatttgttttagtttttaaaattatatgtgtgtgtatatggatttacatacacatgataccaaaatacaaaagcatgtataataaaaactaagtctctctacctttcctctactttttctcttttcccaaaatgggaaaaagttactcattttccctctttggaagcaaacactatacccagtttcttgaagattcttccagtgacaacctattcatttgccaacatacctgcataaattttccctctttttctctttttctctccctctccctcacccccgactctgtcctttcacacaccagatagtatatcatatattttgctctgttccttgatttttcactcttggcaattgttccaaatcagtatatataaaagtcattattcaagctagtagctgcatagtgatccattgtatgaatatatcataattcatctaaacagtctctatgatgagtgtttagatgttttttcatcttttactattgcaaatactctgcaacaaatattttatttgcatatgctttgggttgcacatatgcaagattatctatacaataaatacctaagagttgacattattagatcaaagagtatgagcatttttaattttgacaaatagaaccaaattgccctccaaaaaagttgtaccaattttcatttccaacagtaatgcatgagaaggaagtcatatttttgactcattttatatttgtgttcaaaaggaataaaagaacaaaatattctttttaggttataaatgttagcaaaatgcagcatttgaaagatagaaaatatgaagtaagagatagcaacttgactgcactgtatatagcaaccatttcagtttgttgacaagcaagaaaataatagtcatgttatatgagaaaaggttttgaattataattttcgaaaccatgcaaattgttatatctatttctattattattaaaagtaatagttattaccaataataataataataatagagaaaatattgcatggatacacaaaactttgacacataaaacaagtatataattagactatgactttttaaaaatctgtgctaaaataatagacatcataatattacaagactctaaattaggcctcaagttgataaatagatattctggaagtacaacttaaaatttttttagaaaaaaaaacacttaaagattgaaaaacttcagtagagtatacaacttttcaccaggaggccaaatactgtgttacttcataatatgaaaaaagttttacaaacttatagaaatggtaaagcaaaatctaagcacatagttttggaggtaagagtcttaaggaatattaatgtcaaaaaaaaaggattcctctcttaataaagtttctaagagcaccaggtgactatttcactaaggaaaattaaagtatgcctcagctaagctcatattgtcacttctggatatttgggatgttaacagataaaaatgtgttttttatgaagaattgacaaagtaagataatagtgacctattctataaaatttctgaataatatgaattataattacaaaattaaaaacagaaatcatctcctttattaagaaaagaattctcaaccatctttttgtcattcacaattcattttgtcagtcaaaattaaggctgaactaaaagtcaattccactatgtggatttttcttattaccttacagtgattggactagatattcagtggaaaacctcattactgaaactctgttattaaaagtgggtgaatgaatcatttttatttatccataatatttgtacatatttatgggatatgtatgatattttgctacatgaacagaatgtgtaatgatcaagtcaggatatcgtttttatgtgttaggaacattgtaagtctcctcttctagctatttgaaatgtgcactgtgttcttgttaactatagttaccctactctgctatcaaatattaaaacttactccttctatctaactcagtgtttgtactgataaaagaaaaacttcgccaaattaaatttaaaggaatttaattgagctatgaacgattcgcagattgagcaccctgccatgccagagtaggctcagagactccagcgtagtcacatggtgggagaagatttatggacagaaaaaggaaagtaacatacagaaaactgaaatgaggtaaagaaacggctggattggttacaggttggcactttccttatttgaacatggttccaacagttggctacatttgattggccaaaactcagtaattggcacaagtgtaggcttcggtctgtttacagctccactagttatagttcacgatgtacataaaaacccttaacctgaacttaaaatatgtaaggaggtagctttaggctaatcttgatttaacagtgcccactaaccaacgtctcacattccctccttcttccagaacaaatagtttaaacccacacagctggttattaaatttattataaattgtgtctacaagataacaaaggaaacgatttggtcaaataactactggtcaagtcagttaaacatagtcagttaacacaggtttgggcatagcctaagcctcctatgcctgaagattaaatgtggaagtggtgcatgaagtactcagcatggtgaccagggcatattgagcacccgataaaatccttactataaaaacaaaaacataaaaccagtcaaaccagtcttttgacatcatataaaagataaactgtcattcgactgaatttttcatatttcacacaaatatttttcatgctataatctcagccctaatctcagatgacagagaaaaaggtagcaaaaacactactttatagtagatctttaaaattaatctaattatgtaactctgtggcatgtttcaccacaacagatgagtcaaaaaacatgactcctataacgtaggatgcatctcacatgaaaattaaatagcactgttctttaagaatgaacaagaaatgcactgaaatgattgaacacttgtgtttaacactaatattaagtactctatccttattgactcacaatagcatggtcattatcatcatcatcattatcatcatcatcatttctagcataagcatcatatgtgataccaaagcattaagtaatttttaagcttaaatgatcaattctccatcctattgtcttttcaacactgattttatttctgcagctacttgaggttgggcatctttaggttattctggaattttacacactagtatcttctctctgaagaagttaacattacatacaattcgagagtacaaagagaactgattatatatttcttcagataaacaagtcttcttatacaaatgtagaaatcaacctctggatttccgaaataatacatcttgaatgttccccagatgctgctactatggtgacagactaactggtaacattctggagtgctttactgtaatggctggttctgttatttcttaaagcagaaaaatggttttaaaaagtaagactaaaatgaaatatttcccaagttgttaccccttttttctgtttatctacaatgctgtctcagcaaaacacaaaatctagaccaaattaatatcccacagaaatttctaatgtgtaatttctataattttcttccttcttatattagtcttttaaaaggcattgaattcattaatgaacaggatatttagctaccctgacaactaatatctgtacaatcaattaaaaatcatccatgctggtgactagattcagttgttaatatatccattaaaaaacagggtgaagtatttgttttccagattaagttttcttttgtttttgtttttttgttttttgtttttgtttttttgtttctgtttttgttttttttttgagacggagtctcgctccgtcacccaggctggagtgcagtagcatgatctcagctcactgcaacctccgcctcccgagttcaagcgattctcctgcctcagcctccccagtagctgggattacaggcacccgccaccacgcccaattaatttttgtatttttagtagagacggtgtttcaccatgtcggccaagctggtcctaacctcgtggtcactcctgacctcaagtgatccacccgcgtcagcctcacaaagtgctgggattacaggtgtgagtcaccgtgctcagccatgtttattttttatttatttatttatttatgtatttttgagacggagttttgctcttgttgctcaggctggagtgcaatggcaggatcttggctcgctgcaacctcctcctcccaggttcaagcaattctccagcctcagcctccccagtagctggaattacaggcgccccccaccacgccaggctaattttttctttttttttttttttttctgagccagagtcttgctctgtcgtccaggctggagtgcagagggccgatctcagctcgctgcaacctccgtctcccaggttcaagtgattctcctgcttcagcctcccaaagtgctgggattactggcatatgccacagcacccggcctaattatttttgaagcaaacattatcaaagaaagaaattagccagacatctaattaaatttcctttacactttgcaaaaagattctcacataagattacaatgattaactttctataaaaataactgcaggtaatgagtactttatatacattaactcacttaagtcttataataaccctgaaaattagaaattattatcttttctttacaaatgagaaaattgcaggttagaagaattaaataacttgtctacagttatacagttagtagaggcagagctggacttgcaactagatctactccaaatactatgatcacttattcgtgagtgaaagcaaagatatttcgtagatattcatctccagagaaaagaaaaaagccagaagaaattatttaaggctgggcgcggtggctcatgcctgtaatcccagcactttgggaggccgaggcgggtggatcacctgaggtcaggagttcaagatcagcctgaccaacatggagaaaccctgtctctactaaaaatacaaaattagccgggcatggtggcgcatgcctgtagtcccagctactcaggagactgagacagaagaatcgatggaaccgggaggcagaggttgtggtgagccgagattgcgccattgcactccagcctgggcaacaagagcgaaactccgtctcaaaaaaaataaaacaaacaaacaaacaaaaaagaaattgatttgaattatgatggggagcattgaagttagcttatagagagtgctatgttatcaatgaggatgagatgtggaaaggaagcactcagggagatacaaaggtactggtaatgctcccgttattaaattgggtggtggtttcactggtgctcattatgtcaccatactttatcccttatgtatgggttacagtctcagtgcatattaaaatattatgtaacaaaaatattttaaaaaatttgtcagagaaatgagttattgaggaatgttgtgaagtctttgtctaagtatcttaaaaaataaaaaccaatattcttttcctctgagtaccgcataatccatgagagggttggatgctaccatggcacacacagaactcctgactgtacacttaactgtcattactgtttctttgctatttctgtgttagaactcaaatgactccactgggtattagagaaaatctgcccttacaataggattagaacaaaaatctcaagaggatcagtgcttccaggaaggtcattttgattcaagtggacaacttgaatttggattatagcctttgagtaattcctattacgccaacagctacctttccttgatattaaggtactagactgaatttttagaatggcaagccattgcgacatcacgttaaagtgcaaacatgggccgggcacggtggctcacgcctgtaatcccagcactttgggaggccgaggcgggcggatcacgaggtcaggagatcgagaccatcctggctaacacggtgaaactctgtctctcctaaacaaaatacaaaaaattagccgggcatggtggcaagcgcctttagtcccagctactcgggaggctgaggcaggagaatggcgtgaacctggcaggcggagcttgcagtgaacctagattgcgccactgcactccagcctgggtgacagagcgagattccgtctcaaaaaataaaaataaagcgcaaacatgtccatgttctcaaaaatagtagtttctctcttttagctgatgtgttctctcaaagtgaccccaataagaactgattaattcatgatttttttttttttttagttctatcctgttctcacagatatctgataggccaattgatcttattcatttatttttattgtaaaagcagtcatggctatggtcataaaaagtccaccccgaatcccacttttcagaggtaaccattgtctcttaccatccttgtttagttcctttattatttccataactctaagtgacatttctctaatattattattatttgagacagggtcttgctctgtcacccagtctggagtgcagtggcatgatctcagctcactgcaaactccacctcccaggttcaagcgattctcctgcctcagactcctgagtagctgggatgacaggcatgcaccaccatagccagctaatttttgtatttttagtagagatggggtttcaccatgttggccaggctggtctcgaactcctggcctcaagtgattcccccacctcagcctcccaaagtgctgggattacagctgtgagccaccacacccagcctatttcttgattttagattaacttttacattttaagttttatgtttatcaaaattcatttatataacttaagaagtcatatagtactattaaattgataatggacaggaacctgtgagtgtcctattcctctcaatctttcatgcccagcctccagatttaacttctttcaactcttttatctctttctttagctatttacacttatatttctagctaatatgcatatagtgctcttttaattattccatgttagatatttatttctcaatttcttatgatgaaaaatttctttttttattttaagacatttatttcaatatatctaagacttcattgcattagaatatcaaattggctccttttctcctttataacagctacagtttgttcagctgcaaatagagcaaaaaaagatgatcaacaagtattacaacaaaaatactagatttttgctgtaattcctgtctatagacagacttttctataatactatctgggaaactatctcaatacacagccaagtaatttaaaatttctttcaagccaaattgctactaggtcactatgctcagttactaagacagtagctacatagtcattctacctactccatctttgttcttcatttgatctcagtctttttttttttttaactcattttttttattatactttaagttttagggtacatgtgcacattgtgcaggttagttacatatgtatacatgtgccacgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgtggcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatagtatctcattgtggttttgatttgcatttctctgatggccagtgatgatgagcattttttcatgtgttttttggctgcataaatgtcttcttttgagaagtgtctgttcatgtccttcgcccactttttcatggggttgattgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttcgtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggacccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatggctccagctttgttcttttggcttaggattgccttggcaatgcgggctcttttttggttccatatgaactttaaagtagttttttccaatgctgtgaagaaagtcattggtagctttatggggatagcactgaatctgtaaattaccttgggcagtgtggccattttcacaatattgattcttcctacccatgagcatggaatgttcttccatttgtttgtatcctcttttatttccttgagcagtggtttgtagttctccttgaagaggtccttcacatcccttgtaagctggattcctaggtattttattctctttgaagcaattgtgaatgggagttcactcatgatttggctctctgtttgtctgttgttggtgtataagaacgcttgtgatttttgtacattgattttgtattctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctgattgccctggccagaacttccaacactatattgaataggagtggtaagagaaggcattcctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctgttgattggaatagtttcagaaggaatggtaccagctcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctcttatggtagtttgtatttctgtgggatcagtggtgatatcccctttatcattttttattgtgtctatttgattcttctctctttttttctttattagtcttgctagtggtctatcaattttgttgatcctttcaaaaaaccagctcctggattcattaattttttgaaggcttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttgttttcaaagaacatctttatttctgccttcatttcgttatgtacccagtagtcattcaggagcaggttgttctgtttccatgtagttgagcagttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatgttctgttgatttggggtggagagttctgtagatgtctattaggtccgcttggtgcagagctgagttcaattcctgggtatccttgttgactttctgtctcgttgatctgtctaatgttgacagtggagtgttaaagtctcccattattaatgtgtgggagtctaagtctctttgtaggtcactcaggacttgctttatgaatctgggtgctcctgtattgggtgcatatatatttaggatagttagctcttcttgttgaattcatccctttaccattatgtaatggccttctttgtctcttttgatctttgttggtttaaattctgttttatccaagactagtattgcaacccctgcctttttttgttttccatttgcttggtagatcttcctccatccttttattttgagcctatgtgtgtctctgcccgtgagatgtgtttcctgaatacagcacactgatgggtcttgactctttatccagtttgctagtctgtgtcttttaattggagcatttagtccatttacatttaaagttaatattgttatgtatgaatttgatcctgtcattatgatgttagctggtggttttgcttgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgatcgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccaccactaataccctttcttccagttgatcgcatcggctcctgaggcttctgcattcttcacgtggttctcgagccttggttttcagctccatgagctcctttaagcacttgtctctattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgcgttttagagtttccagtttttctgttctgtttttttcccatctttttggttttatctacttttggtctttgatgatggtgatgtacagatgggtttttggtgtggatgtcctttctgtttgttagttttccttctaacagataggaccctcagctgcaggtctgttggaataccctgccatgtgaggtgtcagtgtgcccctgctggggggtgcctcccagttaggctgctcaggggtcaggggtcagggacccacttgaggaggcagtctgcccgttctcagatctccagctgtgtgctgggagaaccactgctctcttcaaagctgtcagacagggacatttaagtctgcagaggttactgctgtctttttgtttgtctgtgccctgcccccattggtggagcctacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagccagactccgtgggcgtaggaccctccgagccatgtgcgggatataatctcgtggtgcgcggttttttaagccggtcggaaaagcacaatattcgggtgggagtgacccgattttccaggtgcgtccatcacccctttctttgactcggaaagggaactccctgaccccttgcgcttcccaagtgaggcaatgcctcgccctgcttcagctcacgcacggtgcacgcacccactgacctgcgcccactgtctggcaatccctagtgagatgaacctggtacctcagatggaaatgcagaaatcacccgtcttctgcgtcgctcacgctgggagctgtataccggagctgttcctattcagccatcttggctcctccgatgaaaaatttcgattggctcctgtacatcatttcctcacattcttatctaacccaaccttacaatttttggtcaactcagtattcattttacatatgcaaatattgttcataactaagccacaaagtgttatttatgtatttatttattttagagacagggtcttgctctgttgcccaacctggaatgcagtgatatgatccatagctcactgcagcctcaaacccatgggatcaagggatcctcccactcagcctcctgcatagctaagagtacaggtgcacaacaccaagccctgctaatttttttttttttttttttgataaagacaggatctcactctgttgcccaggctggcctcaaactcctggcctcaagcgatcctcctgccttgtcctctcagagtgttgggattataggtgtgagctaccatgccagacccatctattaccacctttttcacaaaatctccaataggactatagaagtcctctcattaagagcaaatatatcaggggagctctcagttctggttctgttttttttccccccttggtgacatcttttttggagtccagatcctcctgctcctgtctggactggttgctctctagaccttctgcatagcaacagcctaaagttttccctaattatcatcttgggttttccctttgtctttcctctatgttgaaatccgtgtttcctggaacctatgtcttcctatttcttggtttttcttcctcattttagtggatatatatcatctgatagcttcctaagttcatgagaacaatacttttgaaatcttgcaaatctgaaagtgtcttcaatttaccttcatgccctattaagtttgactggatatataatccagggatggtgcaaatcatttttccttatatttttaaggccttgatcttctgtctttcaccttccaatgttgagaagcatggtgccattctgatccctgaatctgttttttttttctctataggagcttttataaaatattcatttatttacaaatatttattgaacagccattactgtgccagggtctgttttagatgctggggattacagcattgaaaaaagaaagccacacctacattcctacctttgtggagcttacattctagtgggggaggcataataaataagataaataagtagaacatatagtatattaggtagtgataaatactcaagaagaaaaggagaatatgtagtgtcaggggtagaaatttggataagggccttatttaaaagaaaacttttaagtaaagacctgaaggtagtaaggtaccaagccatgctaatatccagggaatttcctttctgggcagagagaacactaagtgcacaggctgtgagacagaagtgtgactggtttgtttgaggaacaagaagcacttgtttgggaagccactgtggctggagcaaagtgaacaagatgaaaggtagaaggcaatgagttcagagcaataagatgggccggatcatgtgaggaaatgggtttatactctacaagagatgagaggctattagagaatttttagcagaaatgggactaatctgactttggcatcaagcaaaagaatcgcctgagggaagaggtaagggtgaggacttagaacgctattgcagtaattcaggtgagtagcaatggtggcttgcaccagaatgatggtagtggagatgtaagaaacggtcaaattctggacatattccaaaggtagagctaacagtatttgttgacttaatgcaggtagaaagtgagagaaaggagtcaagcatgaaaaagttttggcctgcaaaaaggaagaaaggagttgcccttaactaagggtaactaaggacggagaagcctgtgagaagaacaggttgggagaggtatctgtagctcagttctgttcatactaaatctgagatgtcaactggagatatcaaatagacagtctgggagaagtccaagctaagatataaatgtaaaacttctcaaagtatcaatggtatttaaagtcttgtgattggataagatcacccagagagtgtgagtaggtacaaaagtccaaggcactccaacatttagaggttgaaaagatgaaaaggaatcgggaaagaaaaaaaagacagagaaggagcagctagaaaattaagacacaaactaagtgtaatgtgtcctggaagtcaagtgaagaagtgtctcaaggaggagagagtgattatctgtgtcaaaagctgttgataaatcaaggaagaggaggcctgagagatagccatcaatttaacatcatggaggtcatcagagactttaggtagagcagttttgatggcatgatgctgatgaaaacatgattacagtgggtttaagagagaatgggggatgggtggagagaaattggcaatggctagagtgttgctgaaaagggaaacaaaaatggagcagaaactggaaatgtgggtttaagaaaaggctggctttatacacacacacagagagagaagaaaagaagagaattgctggagcaacctccttgagtaagcaagaggggatgaaatctaatgcagaagtggagaaattggcctttgctagaagagttcatcaaaagtaacaggggagaaggcagaacataggcccccgtgatgcaagtagaaggatattgtggtggtggaagtttgtataagatctcttttagttgtttcaaaacctttcttagcaaaagacagcaacattgttagcttaaagggaggaagctggcagagttggagtttgatgagagaggagatggtataaggtggtcactaggagcaagaatgaaccttggaaatatggcatgagtaaaacagcattagaccagaatctctcattctaattcttgggattagtgtcattaatttaaaattatgctagtcagtgtggtttttccacagttttattcagctgtggcagagagtagagacaaagagtgagctttgagttggatttaatccaagttgtggttttctcaaacaaggacaaagaaggaaaaaaggcaagggagatgaaggcacaagatctctttatactcagagttctgtaatttttcagtgattgccttggtataggacatttttcattcattgtgctagacaatctgtgggctctttcaaagtggagtttcattctctttagttctggaaaattctcttgcattatttctttcataatttatcccctccaccttctctgttatcactttctaaaacttctactagctaggcctctaattttcttattatttcttatctatttccttctctgccttgttttgtttacttcctgggtaatttcctaaaggttatcttccaactcttctattgagttttttttttttcactactctgttttactttccaagagcttgttcttggtcattgaatattacttttttatagcctattgtttttgcctcaaatgtgcaatcaatatcctctctttatctctgaagacatacattttatgtacttaaaaatgtttttcttcactctctgcactgtctctgttttctctaagtttcggtttcagtttattttggtgtctttttttatattaaaagtttccttcaaatgtctggtgattctttttttaaaatctctctctctctctctctctctctgtgtttgtgtgtgtgtgtgtgtgtgtgtgtgtgtgtgtgtgtgtgtgtgtgtgtctcacagggtcttgctctgtcacccaggctacagtgcaattccataattatatctcactgcaacttcctctgcctcctgagctcaaacaagtctcccacctcagcctcccaagtagctgggaccacaggtgcttgccaccacacctagctaattttgtagagttcaggtttcaccatgtttcccaggctggtctcaaactactgggctcaagctgtcttcctgcctaggtcccccaaagtactgagattacaggcataagccatcacggccagcctgtctggtggttcttgattatctgtttgcttgtgtgtatattggcactgtttaatgataagtgggttcctctaagagtgatgtgccaggactattgagtcagagggcctccaaaaaggaccttctcatcttgtctcaggctgattcatttccttggagaggatttctggcaacatcgcatctgggagtatatgtctagcctaaaaagttctggaagccaagaaggaaaacagaggcagggaggtttactgactcttatatcagtttgacaccccatccctaatctcagctgtacctgatgtctccaagaccagagcctctctaattcaaaatttctagatacagtcccagaagacttatgtcttctgccaaaatgactttgctcttctgcagacaatagggatttcaaatttatttttatctactaaatcttttactgagatcaactttctatcttctaaaatttttatgatatctctggcgtgatgtcatctcctctcacattccttttatcctttaaggtttgtatctttttaaaggccaaagcttctatttatgctttttggtgaagcatattccatgctcttccctgactccatagtagagaagacaatatttgagataataaaagttagaagtcccaagaaaatggccatctatattaatcatagactggcactgtggatttgtgtccctccaaaagatgttggagtcctaatacctagtacctgtgaatgtgacctaacttagaaatatggactttacagacaatcaagttaaaatcaggtcattagggtaagccctaatccattatgactgtgtccttataaaaaggggaaatttggacacagagacagagacagacatgaatggaagacagattatgtgaagacacacagggagaatgccatgtgtcaataatagcagagactgaagtattgcatctataagccaaggaatgccaaagactgccagcaaaacatgagaagctaggagagaggcatgaaacaaattctcatagccctgagaagggaccaacccggctgacaccttgatctcacacttctaccctccttaactgtgagacaatacatttctattgactaggccactcggtttgtggttctttgttatagcagccctagccaactaatttactggatgttgggaatgcatgagctcaactcttcctactcttctcctttgccttatttttccagcagagaggataggaaatgaatggcaaacaatctgggtgaactaccaaggcaagatggagctagactgaacagaggatactgaggtgagataattataaggaaacagatttgtagcctctgaaattcattctgatacctttgaacactggctggcaccagagtcctggtaaaaatattagtctgattagctggagtgtggagacacatgcctgtggtcccagctactcaggaggctgaggtgggagaaccgcttgaacctgggaggcagaggttgcagtgagctgagatcgcaccactgcacagcctggatgacagagcaagactctgtctcaaaaaaaaaaaaattagtctgttgttctcctgttctttctgaatatttttcctacccacgtgtcttttctgaccctaggccctcattcagtcgatgtccaaaatttatccttttcaaccacagacctctcctctcatgctcaaaatttcaatcttttttccatcaaataactcatcccctacttcttcaataacactactacttccttgaagatagctgtttttatgagtggtgatctgatttaaagtgaatgactgatggaatttaaaagagagataggtttgggcttcaggacctttcagtgttctttgctgattacccttcttgtttttttctgaagtagttgtggtaaagtgctgtagtgactcagagcttggtttgaattctagctctgtcagttattatccatgcaataaaatagaaaacatttcaactctctcagtttccatttctttatttgtaagaattattggccaataaagtttttctcacagggttttagtgaggattaaatgaataatataaataaaacccctagacagtgccctgtgctgtacaagcataaaaatgaaagctagctctcatacctaagcatttatcttacgcagtttgacccagaagaaggagcgtgaaatcagtcctgccctaacaaactatccccctccattcatcactgctttccatgtctttataagaaaaattccacagggagtccgtaaaactaaagaaaatgactgaggctcatctcaaacaatttagaggtttattttgccaatgttgaggatatgcctgggaaaaagagacacaaaccataataggatgtgtggcctatatgttttccaaagaggatttgagggcttcagtatttaaagggggaaaaatgggcaagaggggaaaggggaaagaaaataaaagagggaggatgtggtcaaatgcttgtgaggctttagttagaactcactgaatccacatgttgcatgtgaaaaggggaaagtagatagaagagtccattatgaattcctctagtgctcagtgaatctgcatttttacatgagataatcacaaagtaggggaagcagtcaaacatgcatttgtcttagatgaacagagggataacttctagccctgtcttcgtctcctgcttgtgaatataagctgttatttacactgtcagggtgaaattcaacagaactcagttttagggaattgtgagggaggcctcctgaggagataggtgaccttctagtcaatgtctttgcagtggccaggcgcggtggctcatgcctgtaatcccagcactttgggaggccaaggcgggcggatcacaaggtcaggaaattgaaaccatcctggctaacatggtgaaaccccatctctactaaaaaaaatacaaaaaactagccaggtgtggtggtgggcgcctgtagtcccagctacttaggaggctgaggcaggagaatggtgtgaacccgggaggcagagcttgcagtgagccgagatcgaaccactgcactccagcctgggcaacagagcgagactctgtctcaaaacaacaacaaaaaatgtctttgtagctatctgtttaggagcaaaaagacagtctaacttttctccttggcatagtgagtttggggtcctgagatttaattttcctttcacatgtcataatttcaagaaagatcatgggtgggtccagggcattgtggatattcctaaactccagttggaatctttgtgagtagacagcatcctgcttgagcaatattcgagtcttgatgaatgtagttcttcattacaatcacttagtgtcctgtgttatagacatagataatatgagaccctttgggttgttctgtatctccccaagatgtatctcagcactgaatctcttgaataaatgcgggatatcagtttcatgtatttttccttacctgtgtctcataaggcagagaatttgcatttagctctatgacttgctgagcaacaagtacattaagattttaaaataaaatgaagttttctctcaagccattttcttttcaataattcctttatgtatttaatctccccttttctttacgttttagaactattcaaaagattcaaatgcttcagtatctgtggccacaacttccttgttattttaacccactatctagcttatttgctcatggagaagaatcattactatcttttacactttgggaatcattgaagaaatagtagtttttcagtaatcaagcaacttactacattttatgctttttgttggtcattactgtctggttttgctgcattcttgaatgtttatatgatctaagtaattgaggcatggccactaaacatatatctatgtaagatttacgtaagaaattaagaagaattcaatagagcaacaattctttactcctatctcttcccattccctgaccttcagaaaaggaatggcaaactgtaaatgctatttctattttttgagaatgaaggaaggaccttagtataatagtgaaacttcatgaactgaccaagaactatattcagttaaaatatttttggggagttttcctgaaacttctttaggcaactggctgaggaggaggataaggctagtctctatttctatggctttactaaatgttttctcaaagcctctgaattttttcttatttggaagaaaagttatttaatcttttgaaaccactttctcatggaatagttttaattaatgttttgacaattacgctatcactgtctttcaaagagtaaaaggataaaattgcaaaactgaaaatattctagttatctttagcaagtttcactgtacatattatacaacatcttctgaattatctgagactctatatcttataaacagattataactgatcattattctgagatattttttccagatttattaaggtgtaatagacaaatattattctaatatcttatacaaggttttaccactatttaaatactaagacaaggacagattatggaatgtgttaagctacagaattgcagtgtagtccacacaaactgtgattattagccacaatatcttccttcagttcaaagtaagattgtcttttaatttttatgaggaaatctagtatgtgacttatagtttataagaacaccccatgaggtcagaaattgtcaagattcttttcatatatttgtttggaaaaaaaaaatccctactttaaacccaataaaattctcatgcattgtcctgtggtgacaggggaaagtaaacatggccatggtaagggcactaatcttagctgtctgacagacccaggatcaaggtctgcctctacaaaagttgcttaacctctctgaaactcagtctcctcatagcaaaatggaaataatacattcctcatagagttgttaggattatgtataaaaagtttagtacatgactgatagatacttggaaggcactcaacgagtattagttctcacaattatttttatggtatgcaatttgaactttttcagcatgcataatttcttcttattttagcaagtactattttattttcttttagagaccaaatttccagaagctatataacatcttgttctttactcatatctgtcctcttgtttacctttagaaccaacacttaacttttataagtgtacattctagtttatcattgctaatatttaatcaataacaaggtaaatttccttaatatgcctattttctcatgttgatgcttccatgacaaactattttgggtcattgtagaatcccattgggtgagatgtgggatgtaacaaatcacataatatgaaattattatatcactagtgtcattcaaaactccaaataaaatgtatttttcattttcttgattaacccaaccagggtagctaaaacaaatagtttatttttctgacataatgagaaatcgaagtggacaattactgtagtggttcaatgacttagcaaagttacagtgagtatctctgcatttctcttggtctttctgcatagacacaaatgaaagtggcaactccaggaatattgtctaggaagaaagggggatggctgaagggtatgtgagctaccactcttccttttttttaaattgtgatataatttctatgtaatgagattaatatatcttaaacataccaatcaatgaatgttgacaaatgtatatacactaatgtggtcattacacaaataaacatgtagaacattttcatcactcctgaaattcccttgtgctactttacagacagtacccttacctgttccagaagcaactatagttataatttctataagtaaaggcttgttttaactatttttaaatttcataacaattaaatcatacagtatgtatacttatctggattttttcactcaacataatacttttgagattttcatatgtgtatcaatagcatattagtctgttttcacactgctataaagaaatacctgagactgggtaatttatttaaaaaagaggtttaattgattcacagttatgcatggctagggaggcctcaggaaacttacaatcatggccaaaggcaaagaataagcaaataccttcttcactagatggtaggacagagagtgcatgaaggaggaactaccaaacacttgtaaaaccatcagatcccagcacttcgggaggtcaaggtggatggattgcttatggccaggagttcgagaccagcctggccaacatggtgaaaccccgtctctattaaaaatacagaaattagcttggcatggtggcacacacttgtaatcccagctattcaggaggctgaggcaggagagtcactcgaaacctggaggtggaggttgcagtgagctgagatcgccccactgtactccagccaggacaacagagtaaggctccatctcaaaaaagaaaagaaaagaaaagaaaaaaaccatcagatctcatgagaactcgctcattatcatgagaacagcatgggggaaaccatccccatgatccagtcacctcccaccaggtccctccctcaacatgtggggaatatggggattacaatttgagatgagatttgggtggggacacagagtcaaaccatgtcaaatagattgtgcctttttattgtgagtatattccattgtctgttcctttcttatcaggataccaaaagctttcctagaaactttcctagtaaatgtattcttggatctcttgagatgggtcatatctggtcacacagtcactccttgctgcaaaggaggctaggaaagcatttgtgtttctagcttctatcatgggagactacaaaggagaatcagactgggaatggcttttgagtagccaaacaacatccaccaaaatgaatttcacagttttcaattatatgatgaaacttaggttttattctttctattaaaaagtgctcattatcttatttataaactactattattatttgatatatgcatatgtggtcaggcacggtggctcatgcctgtaatcccagcactttgggaggccgaggtagacagatcacctgaggtcagaagttcaaaaccaccttggccaacgtggtgaaaccccgtctttactaaaaatacaaaattagcctggcatggtggtacatgcctgtaatcccagctactcaggaggctgaggcaggagaatcacttgaactcaggaagcaaaggttgcagtgagctgagattgtgccattgcactccagcttgggcaacaagaacaaaactccgtctgaaaaaaaaaaagaaagaaatatgcatatgtatatttcaaggtaaatgtaagtttaacttggaagaaaccttctaaagagtgggttagagagagaaaaattaggaaaatttaaaaatgggaattatgaagctgtttgctccacaatttaagaaaacaattgtaaatacaataaagaaatttaaaatagaagtataaaattatgaaatgtggctgggcgcggtggcttacgcctgtaatctcagcactttgagaggccgagaggggcggatcatgaggtcaggagatcgagaccatcctggctaacacggtgaaaccctgtctctactaaaaatacaaaaattagctgggtgtggtggtgtgcacctgtaatcccagtgacccgggaggctgagacaggagaattgcctgaaccctggaggtagagattgcagtgagccgagatcgtgccactgcactccagcctggtgacagagcaagactccatctcaaaattaattaatcaattaaaataaaataaaattacaaaatgtgtaattggaattctaagccatcacattctataagactacactgtccagtatggtagccattagccacaagtgtctatttaagttaaaattagatgaaattaggccaggcatggtggctcatgcctgtaatcccagcaccttgggaggccgaggcaggcagatcacgaggtcaggagattgagaccatcctggctaacacagtgaaaccccgtctctaataaaaatacaaaaaaaattagctgggcatggtggtgggctcctgtagtcccagctactcgggaggctgaggcaggagaatgctgtgaacccgggagggagagcttgcagtgagccgagattgtgccactgcactccagcctgggcgacagcgcaagactccatctcaaaaaaaaaaaattagattaaattgctgggtagagtggctcaagcctataatcccagcactttgggaggtcaaggaaggaggattgattgaggccaggagtttgagaccagcctgggcaacatagcaagactgtctctacaaaaaaaaatgttttttaaaaaattagccgggcatggtgtgcacacctgtagtcctagctactcaggaggctgaggtgggaggattgcttaaattcagcaggttgaggctgcagtgagctatgattgtgtcactgcactccagcctgggtgacagagtgagaccttgtatctaaaaaaaaaaaaaaaaaaaaaaaacaaaaaaaacctaggctagagatgtggtagctcatgcctgtaattctaacactttgggaagccaaagtgggaggatggcttcagcttaggaattcaagacccgcctgggcaacacagtgaggcctcatctctacaaagaaatttaaaaattagccaggctcaggagtttgagaccagctggggccacacagtgagatcttgtttctacaaaaaaatttaaaaattggccaagtttggtggtgcacacctgtagtctcatctattcaagtggctgaggtgggaggattgcttaagcccagcaggtcaaagctacattgagccatgatcatgccactgtaccccagcctgggtgacagaatgaaactctgtctcagaaaaaaaagaaaaggtaaatgaattaaaaatttagttccttcatttgtgctagccaaatttgaaatgttcaatagccacatgtgactagtgactaccatattagtgagtgcagatatagaatatttctttaatcattgtggaaagctgtatataataacacttggctaataaagagaaagaaaagaacaaataaagatcatttccatcattagaataccatcttaattgatttggggaactatcaaagaatgttgagtagttttactacaaaaagatttagtatatatttaagtgactatcaaaaagcaaaagacggggagagagagaactaaaagacttcattctttcagtaaatatttactgagcacagaccatgtgccaaactgggatacggcaatgaacaaaataaaaaaagtcactgttttggtggaacttctggtatgagttgagagagaaacaaaataaacaaatgatgtgataaaagaaaaaccaaattaaatttaaaggagtttaactgagcaatgaatgattcacgaattgggcagcccccagaattatagcagattcacagagactccagcgcagccacatagtgaaagaaaatttataaacacaaaaaagggaaataatgtacagaaatcagaagtgaggtacagaatggctggattggttacaagttgccatttgccttatttgaacacagtttgaacacttagcagtgtatgaatggttgaagtacagctgctgggattagccaagactcagctattgttacaggcacatactcctaaattaggtttttaaccttgtctacctattaagctaggttgcagtttgtccacaagcactcaaatatagaagtacagagtccttctcaggctatatttagttagctttaacagatgtcaggtaagttttttgtggcaagtgccacacaaaataataataataataataataataataataataataataataataacagagctggagctgggtgcacttggaatcccagctactctggaagttgaggagggaggatcacttgagcctgggagttcatggccaacctgggcaacatagtgagactccgtctctaaataaataaataaacaaataaataacactgggcaaggaatgggagagaacatgtttatagggtgtgtaggaaaggcattctctgataagatgataattacacagaggccagaagggataaggaaatgagccatttggctatatggagaaagaacattctaggcagtaggaatagccaagtgcaaagaacctgaagtagatcatatgcttggttttttggagaaaaagtaagaaagtcagtgtgcctgggtcagagtaggactagaggatacagtaagactaaacattttaagtaagactaaaaatacaaaatattagccaggtgtgatggcatgtgcctgtagtcttagctacagatgaggtcagagaccaaatccagaaggccttataaggattttaggttttactctgaatgatatggaatgccattgaaagaggttttgttttgtttttgagacgaagtcttgctcactctgtcacccaggctggactgcagcagcatgatctcggctcactgcgacctctgcttctgcttcctggcttgaagagattctcctgcctcagcctcctgagtagctggtgcccgccaccacacccagctaatttttgtatttttagtagagacggggtttcgccatgttggccaggctagtcttgaactcctgacctcagatgctccgcccatctcaacctcctaaagtgctgggattacaggtgtaagccactgcacctggcccattaaagggttttgagtggaggaatgacatgatgtgacttacattttacaaggattagtctggttaccgtatgaagaatatattacaaggaagcaagggtagaaacaaagatatcagttaggatcttggcaaaattcaaggtgagagatgatggtggcttggaccagggtagcatttgcagaagtgaaaacaactaatagggttatggatctatttgaacacaatttactattagactgactatgggttataagagaaacagaagagacaaggatgactccaagattatcaacctaagaaactcctaaagtaggactaccatttactgtgataggaaggacgactggaagaggagattttggagggaaaaccaaaggttggttttaaacatatttaaatgtgtgttactcgttcaagtagagttggtaactaagttgataaataatcagataaacaaatttggagttcaagggaaaggtccaagttagaaatataagtagacagcctatcagtggaattttaagcaatggcactatcagggaacctgcccccgatagtcacgtagcttcttttctattttccctaagtgttggccgggttgagaaataaagggacagagtacaaaagagagaaattttaaagctgggcatctgggggagacatcacatgtcggtaggttccgtgatgccccctgagccataaaaccagcaagtttttattagggattttcaaaaggggaggcagtgtacgaatagggtgtgggtcacagagatcacgtgctttacaaggtaatagaatatcacaaggcaaatggaggcagggcgagatcacaggaccacaggaccgggcgaaattaaaattgctaatgaagttttgggcaccattttcattgataacatcttatcaggagacagggtttgagagcaaccggtctgaccaaaatttattaggcgggaatttccttgtcctaataagcctgggcgtgctatgggagactggggcttatttcatccctacagtctcgaccatagaagacgtccacacgcaagggggccagtttagaggcctaccctcaggggagcactctcttactcagggatgttccttgctgagaaaaagaattcagcgatatttctcccatttgcttttgaaagaagagaaatatggctctgttctgcctggctcatcagcggtcagagtttagggttatctctcttgttccctgaacattgctgttatcctgttcttttttcaaggtgcccagatttcatattgttcaaacacacatgctctacaatttgttcagttaacgcaatcatcacagggtcctgaggtgacatacatcctcctcagtttacgagatgacagaattaagagattaaagacaggcataagaaatcacaagggtattgactggggaagtgataagtgtccatgaaatcttcacaatttatgtttagagattgcagtaaagacaggcataagaaattataaaagtattaatttggggaactaataaatgtccatgaaatcttcacaatccacgttcttctgccatggcttcagctggtccctccgttcggggtccctgacttcccgcaacaggcactagatgagatcactcactatcaaagtagtgaaaatctgaggacttatcttggtcactgcaacatttagaggtcagaaaaataagaaatagccaactgtgagcactgaatttgacaacatgttggccataggttactctgacaagaatagtttgggtagagtggtgaaggtgaaagccggcttcaagtgggttcaagaaacaataaagaaacttgagacagtgagcacagacaactcttttggggtgttttactgcaaaaggaatcacaaaatggtgtggtggctaaactgccctgccacatggggttgaaagtttttgtttgtttcttttcagataggaggttgtcatttttatatgctgatgcaatgattgatctattaaagaggaaaccgtaggtgaaagagggaacaattactgaaacagtgccctagagcaagaagagggaaagggaggcaatggaagggttggctttaaataggagcgatagaatcatttatttttacatgcaggaaggaacttgtagagtaagcaaaatgtgggtacatgtgcagatatgtcaactgatatggtggtgggagaatgtgaacatttcttccagttatgtctattttctaagtaattaagaatcaagctgggcatggtggctcatgcctgtaatcccagcactttgggaggctgagccaggtggatcacctgaggtcgggagttcgagaccagcctgaccaatatggtgaaaccctatcactactaaaaatacaaaaattagccgggctgtggtggcatgtgcctataatcccagctactcaggaggctgaggtgggagaatcgcttgaacccaagagacggaggttgcagtaagccgagattgcaccactgcactccagcctgggagacagaggaaaactctgtctcaaaaagaatcaagatcattacctaaaagcaggaactgtgtagaaggtattggaagtttatggagaaaaaagatattaattcagtcaacaagataaattgttaaaagaattgtctatgaaaacgtagtaaatttaaaataagactggttaacataattgagtgctttgtttttagccaagttcagctgctggagtgaattttattcaaggtaagggagggagagaggcaaaatcaagagagataggttatatgcaaggagtgaatatagtgatggtccataaacctaagctggataaggcaagaagtaaggatttaattgggtgcaagaagatattaaggtcaacagattaaacatcattatataaagaattattgggagttagggtccccaaggaaatcagctgaaaaataagagggggtatttgagaatgggatactttaaattgaaattaaggggtacagacattagtaatgacaaagtctacaatgtaacagtaggtaagggtggcttaggtaggatggaggacaaaatcactggaagatagaaggtcaagtaactgaagccaggcgcggtggcacatgcctgtaatcccagcactttaggaagtagacacgggcggatcacttgaggccaggagttcaagaccagcctggccaacatggagaaactctgtctctaataaaaatacaaaaaattagctgggcatggtggcatgtgcctgtaatcccatagtcccatcagctcgggaggctgaggcatgagaatcgcttgaacatgggaggcagaggttgcagtgagctcagaccgcaccactgcactgggtgacagagtgagactgtctcaaaaaaaaaaaaaaaaaaaaaagaaaaaaaggtcaagtaactgaggggtcagggtactggaaggatcctctacatgaatgttgaaatcaccgagaattatgatagaaattatagtaaaatgagtcaatgagggcaagtctaaaattcaaggaatgaggggctgagatctgcaatagaacggttgatgggtagtaccgtctgatagcatgaacttcagaagggatcacggtctgtgacacagtaaagggtaagactcttaccccacctctaagcccagtaacactacggctttgggagagaaacagctcccacatgagaagactgcagggaaagcagtatgctaggggagagctgaagggagaaacatcagaaaaaaggttttgagatatctaggattttgctaactataatacaatcgtgagttctaaagggcacattggaaaggtttggtttgaaagatgaaagagattgggggaggaagcaaaagacacgggttgtattacagaatgcgcgaaaggttctcttgagttgtttagttttgtttaaaaaaaaaaggacagtagagaattgaagccattagctagatgattcagttgtttgttctgctcaagtattctacattattatgttaatctgtttagtttgtcttgtgcagatataactttcataaattatcaaagatgaaacaaaggagattaaagagaagagatcaaaactgtatacaggctctgttaattcatcgtttccactactttctcatctctagttcctagggactgcagtgattgctatagcaatttggattaaaatacatagaatggaaattgtcataagacatttattgaaaatcaatttatgtttttcattatctgaacaggtaatggaaaaaagagtaatcatgaaaagtacagcaatactgatactaaagtgagttatctgtttctaattttatgtctttacacctgagctgttttttttttttttcatgaatcccttggtcagtctatgcagaattgaatttcattgatatacaaatctacattccctcctgtataagaatgcaaaactaatcaaatcacaaacaaggacaaattttgtgaaatcattatttataccagtatagtataacacgttaaaaatacatgtatacaaataagttgtatattttatattataagttctggagagctatttggtcatgagtacatttgtaaataaaatgaaaatcaaatactggttggcaaaatgctcaacctaagactttacaaccaatgaatatcatactaaaaaatacaatatttatatagtataaggattgggaactggaaatgcttgatggtgacctcttgtaacagtcaaaatgaatgacttttgagttataaagtgtattctgtgaacatcacctttattagttttttgctgataaggacacttgcattttacatatccacctcaccttatatggtaaacgtaattccttaccatcatctaatacccagtccattgcattgtctcaaaaatgtattttttcagttgtttgttacaaacagagttcagaagatgcctacaaactttatttgattatgtatctatgtcttgttattctaggactgtccacttttccccctccattagagaaaacagttgtacgagatctagtcatgtagaatgtctcacattctagatttggatgactgttttctcatggtgtcctttaactcattctttcaccacttggattccatataaactggtgtttggctacagaggcttaattagattctggttctttttcaaggcacgaacactacacaggtggtactactgcacttcctgttgcatcgcattatgagtcatgtaatgtctggttattccactctgagtgatagtgagtctgatcagtagggttagatggtatatcctgatcctttcattagaaaattttcaatcagtcttacaactaatggctttaacacccattgataaatgttgcccagatccattatttctttggggtttgcaaaacagttatttttgaattctatcatttattttgcattttatctttcctcagtgtttttatgctactacattggtgtacagtggcattagtatttttaagggattcttttttgtttccattttgattaattttgttttttaattatgtaaaacattgcatttatgtacattcagagaagtctacctttacatcctttctcatctatcctcttctctccctccctttataggtaactgctttttaaagtgattggtggcagggtgcggtagctcatgcctgtaaatcccagcactttgagaggctgaggcgggcagattgtttgaacctaagagtttgaaaacagcctaggcaacatggtaaaaccccatctctacaaaaaattaaaaacttagccaggcgtggtgatgcatgcctgtagtcccagctacatgggaggctgagatgggaggattatctgagccctggaggttgaggccgcagtaagctgtgatcgcaccactgcactccagcctgggcaacagagtgagaccctgtctcaaaaagaaaaaaagtgtttggtttaggtttctattgtttcaaatacatacgcacacgcatataacttcttttgtttacgtgaaactgtcacattataaacacagtcctataccttgcttatatcatctaataatattctagagattgggtcatatcagcatacagagattgagtctatttcacagctgtaaagtaccctatgtgtggatctaccaaagattattcaatcagttctctattgaaaatttggtttgtttgcagtcatttgtcattatacacaatgctgcaatgaatagacctgtatatacattattgtacatttttgccagtaaatctgtgggttggatttctagaaatgggattacaggattaaagagtaaatacatataatcttgctagtttctgcaaaatcctccttgacaggaattatgtcattttgcattcttaccagcacatgtaagagtggctgtttccccaaaaccatgccaacacagcatgttgcaaacttttggatttttggaacctaattaatgtatatataaaatggtatctaagtgtagtttcagtttgcgtttgtctcattattgggcaaggtccagcaatttttcctgttaaagtactatttacatttctttttctgtgaattgttaatatattttgcctgattttcaaacctagattatttaaagatgtgcttcctctattaggaattataacatttataattctccccaagtttgaattctataacaaagactataattaatatcataaaaaataaacaataatttcgcatgtgtgttgatacatatttggcaaatcattacttacagaatagaaggcttgccttcagaccacctgcatcactggcactgccatataggctacttgttaaacatgacctgagaaatttatgttcctaataaacactccatgtaatccactagcacattaaagtttgggaaccactgtagtagaagatatgaaatcaataaatcaacccatgtaattcatatgttaacataatgtctaagtttttttaaacttctatagaatgtataaagattaaagttaaaatctgtctcgtaaaggaaaatcagcaaactttacaactctaaataataattctacctgtagacttaaaaattttgtattttaaatgattaaaaaacagtgctatgtcagaaccagaaataccattttacccagcaatcccattactgggtatatacccaaaggattataaataattctactataaagacacgtttccacgtatgtttattgcaggactagttacaatagcaaagacttggaaccaacccaaatgcccatcaacgatagactggatgaagaaaatgtggcacatataccgcatggaatactatgcagctacaaaaaagaacgagttcatgtcctttgcagggacatggatgaagctagaaactatcatcctcagcaaactaacacaggaacagaaagccaaacaccacatgttctcacgcataattgggagctgaacaatgagaacacatggacacagggaggggaacatcacacactggggcctgtggcagggtgggggaaagggaagggagagcattaggacaaatacctaatgcatgtggagcttaaaacctatttgacaggctgataggtgcagcaagccaccatggcacatgtatacctatataacaaacctacatgttcagcacatgtatcccagaacttaaagtaaaataaaattttttttaaatggtactatatcgtatcctagtttatttgtcaatacagatgtcaaattcaatactttctttcaaacttttaggtagcttttagtaaatcattgctgcagagatccaaatggtactccagttgtcggactagaaagataaatttatgattgttggctgataacttactctgcaagactctttagcgaggttctatagatggctacactcacacagaggagtgtataatcaatccagaattacctttcataccttcacaatggtgaattctattactggtttcttggatgaaggatggggggataaagactgatatgaaaacatgtcaattctgaagatatagaagagtttaaatattttatagtgtttccctatttcaaaaaaatggcattacagtttacatgagatctatttgttaagctctttaaagacgcaaagaaaagctatatccatatcacctttggcaatggaggttttgtgcaaggacacagtgggatgtaaggtagccccggatgttatcttttcagttatagagtttctctaagcacttccaagatgggaagcaatagtggagcaggccttatggaaaactggaatcatgcctaaactctaatgacctgaattctcttaattcacaatgcgtcttactttccaagacagagagaatgttattagatccaaaaatcaccattcaaaatggagtgccaaaattggcttgaattttatgccactctagctgacaggaggtcagcctccttcatgtctagtctttatagtgtccaaacatttgtagaccaggataaacaaggctggcttcactgaaaatcaacacaagccatagtacctaggggcagttttcctaagaagccaatgtaacaatagtgagtatttggcatttcacagactgttgactgaaacagaaagactacttgaaatttcttttcacatttaaactaaatatatcttgactctaaaaaacaacatggacacttgacacaactcatttgggaactcatttagtttatattatgtgactgcttggcaatatgaaaatccttggagatctgaaattagtatgtatagactattattcagtaatcaattgcaacatcttggaatataggcttataattaaatcctttcataatagtaacaccttaaatttctctaacatttcattagattataggtcattttaaaagaatactcgtttcataaatcattatttcaaaagaattatcttttgaaacctaaaacactaatgaatttgtcctaagttttctttaatacattctgtaagaaggtatttactccttttaaactctaaactggtttcgtttggagacgcagctgagcaaaatggagcaagacttaaatcagggggcctaggactagaactagctgggacttttgctacccatccatggaaaattggtgagtcatttaatctctcaggccttagtttcttattctataaaatgtggaagatgtactattgtgcttcttcctattttatttatatacctttcacttctattagtaagaataaccatttttggttttagcatttgatgtccttttccttccgtctaaccctagttacaaagggcaccaatcatatttgcaaaataagctcaattggacgtccgataaaaactgtaacattgtgtatggatttctggcattgttcagaatgtgattaatcagtcatgcacgtggagcccaatgagcccctgtctgactagaatgggaaattggtgagagggagcagctagagttagggctacacagttaaactagggcaaatgatagagggccttgaatggacagatttaggaatttgaagttcattttatgggtagcaagaagtaattttataataaaataattaaatgaaatttgcattttagaaagctaacctgacagttatgaggaccagaatgcaatggggaagaatgaggcagacatattgcttggattcttctggaatttttgaaatatgagataaaggactagtctaccatggtggcaatggaaaaggaaattttgcaaaggagtcagatgctggggaaaagaaaagcccacagggcatagtatctaacatgatggatgatgtagaaaggaataaaatatatgacttggctgggcatggtggctcacgcctgtaatcccagcactttgggaggccaaggcacacggatcactagagggcagaagttcaagaccagcctggcaaacatggtgaaaacaaatctctaccaaaaaatgcaaaaattagccaggcgtggtggtgtgcacctgtagtcccagctacttgggaggctgaggtgggagaattgcttgaatccaggaggcggaggttgcagtgagctgagatggcaccactgaactccagcctgagtgacagagtgagaccctgtctcaaaatgaaaaaacagagataactccaagatatcaagttgaggagagtggaagaagatcattaactgaaatagtttggaagtgttgccactggagggaagaacttgtgcacagtttgaggtggtttgcatggcaagtgaaggttggaagtgtttggtggaaatactaactgacaatgtcttctaaagagaagcaaagccatgaagatagacataatggttaaacaactgagtagatcattactctacctagtttagaaaaaaaaatcatagatgcaagtttcctctgaaaaattttggtcctgtttataatcaaataacagttttattaccataggatcatttatctagatctttggtatattaatctagacttcaaaaattgaaggaagtaattagtaaaatcctagggaatgaagacaggttgattaatgagcacaaataaacagtttggagaaataagaccatattttgaccatatcaaaataatgtttgatatgtcagtagggtgactatagtgactatagtttacaataatctattgtatatttcaaaatagctgcaagagaataattcgaatgtttctagcataaagaaaagacaaatatttaagggggatatatttaaatatttaaggtggtggatatccctgatttgatttttacaaactgtatgaatattaaatcatcacatgtaccctgaaaatatatacatctattaaatattaatttaaaaaatttaaaaataaataaatacttctgaggaatgagaaagatgaatatctgtttgtgaagagtcattcatgagatgtttgagggaacctgactcagtacaagataacattttaaaaatggtttgtataacaagatacagcattcactagtgggtgaggtgccttaaagaactgggttaaattttaatagcacatgtacattttagagattcaaggaaaatggtatgattgaattacatattgataatttactcatgtgaaaactccagaagaccacatgctaaagaaaaggcaaaaccagcattgtaagggaaaaatgtgatcttcatttaaatgaaaatgaggttaataactcaatcatgttatattgcttttaaaatatgtgtgacacaaataggaattaagcatatatgaaacacaagtatgctatggagagacacataattcaaatatttaatgacaatcatttggttacttaaattagttatttgagaatttggcagagattcagagaatagcaacaaaaatgatcaaatatattttaaaaagacctagtaagaaatggccaaagaaatattatttaatccacaagaaaataggctaaagacaaactgtaatgtctcgcctcctgatttaggaggtatattttgtcccagacaaaataggagagttttttaaattattattattcttgacagaatctaaggaattgctttaattgctgctgcagcttttgtgaggtcaaggtttaagtgatatgtattggtgactaaaatgaaatgactgataggttgtacctgactaatttgtgaaagatcaaataacatggaaatgacaacacatcctgggagtagggtggtggggtggtggagaaagctcaaaatatttaactacagtattagaacaatcttgtttgctgattcacataggtatcctacatacactagtttgctatcttaccaatgaagaactagtaccattcaagtggaaaatataaaaagtatctttagaaatcttgaatttaggcctggcacggtggttcgcacctgtaatctcagcactttgggaggccaagaagggtgtattgcttgagctcaggagttcaagaccagcctgggcaacgtagggagatcccatctctacaaaaaaattttaaaaattagccaggtgtggtggtatgcacctatagtacctgctactcaggagcctgaggtgggaggatcaattgagcctggagggttgaagctgcagtgagccgtgatcgtgctactgcactccaccctgggcgacagagtgagaacctgtcttaaaaaaaaaaaatcttgtatttaatctctcaggggaaatgagtgttgtgcggtattcttactattggaaggcacatcaacactaaaagaaatgtagcttaattaaatcatgaattttacagatgttataaacagaatcactagaatgtaaccccaatagaggagaccaattagattttatttcccttttcaattctggtccattggacatgactgccagaggctctttattgagaaggatactgaagcagtgcttgcactcatttggaaataattaatgattgatttacagtgccttctatggaagcctccagtgaccttcaccttgctatatccaatcctcattttacgtgacctattagtagcagttgtcttggttcatcactccctcctccttcactttcttcgcttggctactgattcctttcacatatctagccactgttctcagtctcatttgcagattctgctcaccttgcctccctcttagagttgaagtattccaaaactcagtctttgtaacacctttctatctaaacttgctccttaaagcagcatggtccaatagaaaaataatgtgagccacaaatgcaagccacatatgtaatttgaaactttgtagtaacttcatttaaaaaaaaaagaaactggtgaaattaatatatattttattaaacccaataggtcccaaatataatcattttaataatataaaaatagtgcaatattttgttattttattttaatattaagtcttccaaatccaaagtgttacacttacagcacatctcaattcagactagctaatagctgttgtattgaatagcatggccctagattatctcatccaattccttaacttaaaataccatctacatcctgaatactgactactctcacatttctatttctagcttggacctgtctcctgaatccagactaactgatgtcttagggtgacatcagttcttggatgcctaatgtgtatgtctaaattaccatgtccaaaactgaacacttggtccccagattttctcttctccattttggttactggcaacttcatcacttcagttgctcaagccaaaaatgttggagtcaaccttgacttttctttttgtctcaaacctcatatccaatatacaactcctatgatactattggttctatgttcaaaagatatccagaatctgattccatatcttttcctccactacagtactatggcccaaattcccattatctgggattactgaaataacatccaaactgatccccctttctcctcatagcagccaaatgtccgtgaacaacataagccaaatcatgtcattcatctgctcaaaattctccaatggctcctaatcttacccagagtaaaagctgaagtccttacaatgacctttagaactctacaggatctgaagccgggcatggtggatcacctgtaaccccagcactttgggaggctgaggcgggcggattgcttgagctcaggagtttcagaccagcctgggcaacatggtgaaaccctgcctctacaaaaaatacaaaaataagctggctatggcagagtgcgcctgtggccccagctactcaggaggctgacgtgggaggattgcttgagcccgggaggttgcagtgagccaagattgggccactgcattcagcctgggtgacacagtgaggctccgtttaaaaaagaaagaaagaaagaaagaaaagaactctacaggatctggccccctgttacttttctgacttcatctcctactatttcccttgtttattccactctagccaccctcacctcctactcttccttgagaaggtccatcatggtctcgcttgagggcctttctttggatttgctgtaccctcaactatctccgtggctctctacccccacccaccacctgcttgttttttgggacagtgtcacctgttgtctaggtccttactctagagtgcagtggcacaatctgggctcactgctttggcctcccggcctcaagtgatcctcccgcctcaggctctggagtagctaggactacaggctcccgccaccacacccagtattttatttttatttatttatttatttattttgtagagacagggtttcgtcatgttgcccaggctggtttcgaactcctgagcttaagcgatccaccccgctcagcctcccaaagtgctgggattacaggcgtgcaccaccccgcccagcctcctcatctctttcaagtctttgctgaaatatcttctgaaagaatcacctgagtaagtgaatgacatgacatgaattaatgattggtatgacaagttatgacagaataggtgccataaggaagagtcagaacactagtgcccaatgcttgctcttctaatagaagttaacacaaatctaactttcaacattgattgagcacccattatgtaaactagacatgtatatgattggctgctatcagtgaaggaaacattgaaataatcttgttgctttggaaggtattcttgaacattctcagcacctacaaacagctgacttatttagtcaccgagaaagcagtatcctttaacaaacaggaatagctttggataccctggggcttccccctcctaggcaatcagcatctacactcataatccctcaatccaggcagtatttaaatcactgcactattagaacacttagttctagtccttactcttaatttgatgggtgactaagtaaatcacttattgcctcaattctttcatccctatgataaaatgtctaattttacctggttcctaattcaggttgagataacaggacaatatgcacttggctgttagaagttggcagaatgtatgcattacggagcttaagaaaaaaatcttttttaaagctaagatttctaaatgagggctatttaaaactcatcttcagtttgtggtagacttaaggtctttattatctccttttttgttttttaacctcaatttttcacttaacaccacttctacgcttgaactcattttagcctattttttgttcacaactgctagtttttcagtccaacctagctcaaagcaacggagaaacatgataaatctgagtaatcaaccagagacattaaaatgtgtagttcactccaggaatggatgtgagcattggagggcagggagacgaacacaaaggactgagggagcacatgtcggggaaacaaggaaagatagtaatgttaaatttataaacactgctcaattcaatccaaaaagcgtttattgagtgcagagctctgtgctggtcattttagtaaagccaagatgagcaagacttatgatgagtctctgtcatcaaggagctgggagtatgagctgaactaagacgcacacaaattattaaaatatggtgcagggtacttaaaggaagtccaaggagaaataaagctgacattattcaggacgttttaatatgtcagggcagtcacatatattaacaacccttccaaaaattccaggtaggctcagggaggataggtaacttgtcattaacgctagaaagttagtgtagtctggcattgtccctaaccgaggttctaaagctcaggctcctttcagaacactactgttaaagggaagccccaaagagtcgggggaggggactaagttttgactggatgtgtctcggttgccgtggagggaacaagaggtcagaaaagccatttggaggcagcgtgtgcgatgggactataaggatgaaccggagattgagtgggaaccagtggagggaagagggagggacttttcaggctaaggaagtaataagagcaattagctgctctcataattcttgagtcaagcagttaatgtaggtagaaaacctggcgtccgcccccccaccaccccccaccggaacttttccgttggagcttgtaggtgttcgccaatttcaccattaggtgtgttagttttgtaacctgaaggaaaaaaaaaactcatgttttaatagcagtggattcctcggacggagggtgggggtcaggccaggagcctctggcacactccgtctctcctacccctcagctcggccgccacctgtgagccgttgatgtgcgggaagggcgctctctacggcgggatcctcgctggtaggaggcaggtcccaggcctggcaagggttgaccccggagggctgggccggggcggcaccccaggagcacctgcccacgaggcggctgcgcggacagacgttccagcccctcccgcctcgccgtgtgtttacgtggagacgaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaaggtaggagagcccgaggcaaccgggcctgcggtgggaggcggtggctagcacggggtgggagggggcctgggaagcggagttcgccgcagccccagtgcactgcccgagagggaggtgctgcagggtcttagggtctgcatctctcctcgccctcctcctttcccctttttccagttgggggacaaagccttgtgctagctgataatacttccgcgaggattgaatattgtggctcctttctcgtgaatgtccaaataaaactccccttttactgtattgctgtaaactagtgtttagttgcttctaaacctccgatctttcatttttttaaggagttttctgggtggtgcaggcattgtgctttccagggtggggatttagggcttttctttattgggttggggatttgtgcgctgatcatcagcttgtcttccttaggtagcacgctggcactcttgggtgtgtgtgattggcctgtgacagctgtctcagcagtggcttgtgtgtgccacaagtgccagctgtgaacttggctttaggggcgtttttagaagcgtgtctttgtatgtttgtacttgaaggtctttgtcatggcatgcgcttttgtgtcctatggaatgttaatgcagtctgtgaatggaacttctgaggaccgaaaggttccatatgccaacacctatagaattcctgctttaaataatttagttgttatatatctctctggcgaatcctggttgtgtgtgtgtgtgtgtgtgtgtgtgtgtgaacggttatggaaaagcctgtaaagcaaacaatacaatacacaattatacacaggcatcgttcattgggcttcatgagaaatttaacatatacagaatataagctgcgtagcatatttcttttaaaaattacatatttgagcatatattttgtctgggctcaaaagcccccttcctcccttcaatgaagtcttcttttatggattatattatttttagagataattgttagcagtcatacttggacaaaaattgtattacaggtaactgtttttcctctcttcctttctcttctcctcacataaacaaaggaaaccaggttagtgatttattatcaatgaagggccataccgcagagatgcagtgatagaagctcaacacaagtttgttaaatgaatatatatataaaaactagcttcatatttctaaaatatagttgactttcctataagctccctctatttaagatcaaggtttaaatgcttgtatatagccaggtaaatttttactttcgaatctataaatggtgggaaaggggaatcagggtatctttagaagtccaaagcctacacttgtgcaatctgaggggctgagcaagctctatgcatctacggaagtagtggaggtgaagtgtgtgcccctccaaaagcattgaagatctgattagatgtcttacttgtctgttacctcacaatttttattgcctgcccccagaaatgtctttcctgaatatatgtgaagcagtcctacaaaacatggtttactttggacatacacatttcataatagaggatttatttaaattgcttgcagttgtagttgatgtggcaaaatacaattctagtttctttgtgtgtttctttatctttcagaattctatgtatggggtaaaaacctgtttaaggtgaatttttgttgtaaaagattatcttcttttagaatttagccctttttccagtaagatataaatctatgagacttgtaaggcaaggtgtgtttgctgcaacattagctatacaatataaaaatgctgacattgggagcctggggcgagaggattgcttgacaccaggagttcaagaccaacctgggcaacatagtgagactctacaaaaaattaaataaaaaaaaaaaatagcagggcatggtggtgtgcgcctgtatgtagtcctagctactcaggagtctgaggtgggaggatcacttgagcccaggagttcgaggctgcagtgagctatcatcatgctactgcactccagcctgggcaacagaatgagatcctgtttcagaaaacaaacaaacaaaaaaaaacccctggaaataacttttaaagacaacacgaagggaatcattttctaagttatataaatatgatggaatattttaaagccattaagattatgaagactgataggaatatgaaaaatagtgtgaaaagggcattatcaaaaatagtatgtacattatttcatttgtataaacgtgtgctttcagattagaactgaaaaactctggattataattttattcagcaaacgtatattgaatccctattttatacctagaggtggtgacagtgtctgctctcaagttgctcactgtttagtgggagagacagactctgggtgataagtacaaagagggatgagctgcagtaggatttgggggatattcttccacgttttgttaaagtgttttaaatactactatgtcattttatagaattactaagaaagctttactattgatattaatgcaccataatataatgcctttcaaatagttattcatacatatttgcttaatgaatgaacagaatgattaatgagtcattaataagtgttactttcctagcacggttgtaatttaataacattaatctagaattctcttaatgtgaaatccatattgctggcatcagaaacaactttaaatgatcattttccaaagtttatctgagacttcattctgcaaatgtctcatttgttcactggacttaagtattgtatttgataatctagttttgcaaaccacaacttacaaatctttttgggggtaatttattgataaacagttccattggaaaattccctttctgtatctaaaccttataaatgatcactttttaaacagtttgtcatgtatgcagtataatatatagtatactgtataaaatgttttatactaccccaaatctgtaataatgggttaataaattatgatatgtaaaataattctacaaagactttttgagtgtggaaaatgcccacaaataatgccaggttaaaaagaaaaaagttaccaggaaaaggtatatgtacatatttaaatatgaagacacctgaaaaaaagcaccaagatgtaaatcgtggctatctctgggtggtggcttataggcaattttaattttctttatacttttagtattttccaaattcttgatacaatgtatctcttttatgaccagaaaagaatattcaaatgccattttttttttttttgagacagcctgtctcccaggctggagtgcagtggcaggatcttggctcactgcagcctccacctcccaggttcaagcgattctcctgcctcagcctcccaagtagctgggattacaggcatttaccaccacgcctggctaatttttgtatttttagtagagatggggtttcaccatgttggccaggctggtctcgaactcctgccgttaagtgatctgcctgcctcgacctcccaaagtgctgggattacaggcatgagccactgcactcagcctcaaatgccattttttaaaaaacataaaggcttatcaaatacattatattaaacacatgttatagtgtatgaccattatccagaacaggaaaatgaggcacagaataactaggtttcctattttagcgtaggcctggaattgtaattgctatttcagtgcagagtgtataatatagttgggattatattgttagacattttatagatttcctttctgtttttgttgtgcttattctttccttgctgttagttcgtattgctatgggcatgctcttactcctcatctgcctcttttcctaatttgctgttttagatttgctacgactaaggaacccagaactgaggttgacagaatactatgtaaaaagaaaaaacaacaacaacaaagaccttaggcggggtgtgatggctcactcctgtaatcccaacactgggaggctgaggtgggaggatcgcttgagcccagaggttctagatcagcctgggcaatgtagtgagaccccatctctaaaaagaaaaaagtataaaaaacaaaacaggtggggcgcagtggctcacacctgtaatccaagcactttaggaggttgaggtgggtggatcatctgaggtcaggagtttgagaccagcctggccaacatggcaaaaccccgtctctactaaaaaatacaaaaaaattagccaggcgtggtggcaggtactaatcccagctactggggaggtggaggcaggagaatcacttgaacccaggaggtggaggttgcagtgaaccgaggttgtgccactgtactccagcctgggtgacagagcaagactctgtctcaaaaaacaaaacaaaacaaaaacagaggccagtgtagcctgcccagtgggctttagggcagtttagtttttctgctgcttgttggttgttttggtttactgttgggtcctcagctatttcctcagtattgatgttgcaagaagcatgaccctgggagatgtgagacattactgcattatgtattaagtaaatattttcagagctgggctagctccctctgcagtgttttgacgaggatggcactacataggttgtccttgtgttgaaccaaactattttaactccattttaaatgacttcatttttttccaagtataattattcatggcacgtaaaggaagtattgtaatttaagtgaacagaattaaatagaggacagttgtatatttaatataaaattattactcatgtaaatttgcattaggtatactttttaaagttattcagtattttatataatgggcattatttgctgaataattataaaaaactactgtctattatattcagtaatttgtaattacatgacttttgtttaacaaacattttcagtgtgaagagtagttccaattgtgtacaaaaaaaaggatggtgctccatgcaagctgtatattgattattgatagcaggacttttcagttactgtttccactgtgatagacaaagctggttatggtgtaaaactgttctttgcatatttcagatactttgttccacagctaagaaagtgttttcccttcctgttttaagcattctagtttttcatacttagatgtggcagagcttacttagcattccgagtagatgcagcagtttgatagcttcatcaacatttattgcagcaatagtgcagtgcctgtgacttaaaactaattcataaccttcaggctttttttttttttgagacgagatctcgctgtgttgtccaggctggagtggcagcctgccttgacctcctgagctcaagtgatcctcctgcctcaacctcctgagcacctgggactacagatgtgcaccaccacacctggctaattgttaaaatttttttgtagagatgggatttcaccatgttgcccaggctggtcttgaactcctgggctcaagcaatcctcctgccttaacctcccaaagtgccgagattataggggtgacccactgcacccagcttaggctttgtcggaatgaagcaaaacatggtgtttagagagagaatgtggaggaaggaacgtgatgccctgtcagtgaaactgaaagttgaatgatagctcatggaaagaggaagtgaaaaaggtaggatacatccaagtgattgaaatatgacaagaatggaacaaaaattttttcaaacaaaaacatctcttattttataaataaaaaggttcatagtaaaagctaaactatgtctacaaaatatctattataggctactgaatattgaaatgtaaatgaatttcttctaatatagctagaaaaggttatggtaaattgctaaacaataagggacattatttatattcatttcttagtaagattccactaaaattaagattagtcactttatgtaattgcttaacatccatttaaaaactataatttggaaaagctacggaatttttcaaaacttatttataaaagtggtttggtgtctggggtgtgtgtgtgtgtgtgcgtgtgtgtgtgtgtgtgtgtgctggagagagggagaaagagaatttataatactgctatctggtctggtagaaatggcactaggactttggagacatttatgtgttcatttgttcaaccaacatttttgaatgcctacgactgcagctatgaacttttacttagcaagcatttttttttccccccgagatggagtctcactctgtcacccaggctggagtgcagtggcacgatctcggctcactgcaacctccacctcctgggttctagctattctcctgcctcagcctcccgagtagctgggactacaggcgcccaccaccacacccggctaggtttttatttttagtagagacagggtttcaccatattggccaggctggtctcaaactcctgaccttgtgatccgtccaccttggcctcccaaagtgctgggattacaggcgtgagcaaccgcgcccggccgcaaacatttatttaaatgatcacaaattctgtgccttattgtctgttggaataatcttatgatgtgtacctcaacaggtgttttgaaggataaatgaaataatggttgggagctttttgagttctctaggtgctagatataaagaagctataattttttttaattgaggtgaaattcataagcaaaattaaccatctttaagtgaacttaacacagtggcttaacacaatcttatgcaactactgcttctgtctacttcccaaacatctttccatctcaaaatataaccctgtgcccattaagcagatattcttcattgcttcttccctctagccactaacaatcaccaacgcactctctggatttaccagttgtagatatttaatatgaaaggaatcatataatatgtgaccctttgtgtctggcttctttcacttagtatgttttcaaggttcatccattttgctgcatatatcagtacttcattcctttttatggctgaataatattccattgtatgtatataccataatttgtccaatgataggcatttgggttgtttctgtcttttggctattgtgaatagtgctgctgtgaacatttgtatggatgtatttgagtacctgttttcatttctcttgggtatatacctagtagtagaactgagcaaggtcatatggtagttatatttcaactttttgaggaactgccaaactgtttccatagtgactgtaccattttaccttcccatcagcaatgtataggacattccaattttcccataacctcattaacagttgtgttttctgttttttttgtttgtttgttttgtttttttgtttttttaatactcatccttgtgggtattaagtggtttctaattgtggttttggtttgtattttcctaatgaataatgatattgagtatcatcttttaatgcactttttggccacttgtagatttctttttttttttttttttttttttgagatggagttttgctcttgtctcccaggcttgagtgcaatggcgcaacctcagctcactgcaacctccacctcctgggttcaagtgattctcctgcctcagcctccctagtagatgggattacaggcatccaccaccatgcccgattaatttttttgtatttttagcagagatggggtttcaccatgttggccaggctggtcttgaactcctgacctcaggtgatctgcccgcctcagcctccccagtagctgtgattacaggcatccaccaccatgcccgattaatttttttgtatttttagcagaaatgggatttcaccatgttggccaggctggtcttgaactcctgacctcaggtgatctgcccacctcggcctcccaaagtgctgggattacaggcctgagccactgcgcctagcccatttgtagatcttctttagagaaatgtctattaatatcccttgcccattttttaattgggttgttaccaacttcttttatctaatattaattatatatgtatataaaatatatatatatcctttccgtatgtgtggagagagagagaacgtgtgcactcaagcaccagagaggaatgggtagaaatacgtatccccagtgggattatcttccatatatatatatttttaggctttttgggctttgccaaaatttaaattgttgcttcctttgagtgataggttcttggtgagttgataacagcatgatgctgaagcttgatttctttgttggccagtgagtcattccattccatgagcagctgttttacaagtgcatgcagttggttaaaggggcacctgttggatttttggcttgatcattgccagtccatttacactgtgagaaaaaagtaacttagtgttcaaaaatgaaaagacctgtcattttaaacatgggggatctgtagctacttcactagtatgagatgtctttgttgtcatattgacaccccttttattttttgtcttagtcatcaccaaactgtaacttacaacacttagtgcccttctaggtacattgcataaagctttggttgatttttgcatgggtttaacagtattcaaaagtgttcaatattcagagtattcaaaaatttaacattatttcaggagtagttttgcttaggttctttgtttaaatttatagattcttttgtaatatgtaaaattcctttttcctccttgttcactaacaatgtagtgtttgttttcagttaccatcagagttaagattcttattgtggtttactgttctctgagatttttgtgtggtgtgaaagtttctctgtaaaagtctaagagtttttcccccttttaagaaataatttcttaaagcccccaagattattgttttgatgattcagaactataatcaactttactatacaaagtcctaatctgtaaagattgatttcataggttctctgatttacagatctctgaaaaactaatagggtataaaatctaggctctctctcctattagtactgaacacactataaaattccttgttgtttactaggattgctcattgtgggctctgtggttaggctgtatttattcctccagggtctcacttttttttttttttttttttgagacagagtcttgctctgtcacccaggctggagtgcagtggcactatctcggctcagtgcaagctctgcctcccgggttcacgccattctcctgcctcagcctccccagcagctgggaccacaggtgcacgctgccaagcccggctaatttttctgtatttttagtagagacggggtttcactgtgttagccagtatggtctcaatctcctgacctcatgatccgcctgcctcggcctcccaaagtgctgggattacaggcgtgagccacaacgtccaggctagggtctcacttttattcaagttagtattgccttattagttgtttccccagagaagatagtgacagggatcaattataactaaaatagtagttctccatatgtatcatgaatcaaattttgtgtgtggagaccttgtggggattgcagtgggcatggggcagagatctcagttaattcttacgccgtttatatcctctactccatttcttgagagccaaataaattagtagatcttcttctaaatggcaagatattagaaaatatgttaaaactgcattaggaaatatctactaggagtttatatatgaaataatgagttttggctgaaagttacagaaactcttttctattcatatacaacttaaaaatactggaaattcttttggtgtgaaattttttatatttgccaaaataatatttaattttaatttgtataaattcatttcacaatgaaaattcatatctgagcatttctaatgactcaacaagagaactctcacttttccactttaaacaaccattagtaatttttataataaagtttgagaaaaagaaaagataatttgaggttttttttttagttgagaagaatgcgtaattttttaataaattcaaagggtgaaataaggtaggcaattttaataagcctcagaattttaattgtatggcaggagagtctgtctactttttctctaggatttgtacttaaatttttttaatgttctaagctttctcttctttctttctctatctcactctctttctctctattttcttttatttctcttttttttcttttctttcattttttgagacaggatctcactctgttgccccagctggagtgtggtggcatgatcacggctcattgcaacctcgacctcctgaattcaattgatcctctcacttcaggctcccgagtagctggggctgcgggggctcaccaccatgcctggctaatttttaaattttttgtagagacagggttttgccatgttgcccaggctggtcttgaactcctgggctcaagcggttctcccaccttggcctcccagtgtgctgggattataggtgtgagccaccacgcccagccaattttctcttttctgtctcatgtatcatcatattttctaggctcagtagtttagttcatacctattaatatattcagaaagcatcttgattgaaagatcctttgaattattctgtgattattttcctttattctatatactcataaccacatcctactttttaaattaaaaatttgtctcacacgcttgcagtgagccaagatcatgccactgcactccagcctgggcaacagagtgagactccgtctcaaaaaataaaaataaaaaataaaaataaaaaaatttgtctcccacttaacctttttctttctattctaatattgcagtccaataaaatcaggcccacatcccctcatctgtctagttcccttgcctctattcatcttctctggttcatcctatatattgtcactgggttcatcttaaaacacccttttcattttgttaatcctctactccattcttttcagtctttcagatcaaatcctagataacttagtatttactcgagcctctactttatgcaagtcagtgggaattcagagatagtcacaagcttgcctctgatactttcacattcgagtagaaagtcaatcacgatacaataagttaagtattcagagtgatctacagggagctatttatttactcattcagtaaatatgattgaacacttactacttgctaggcactttgctaagatgataggatatgagagacatggactctgccaagcataagcattatttagttagtaggcagacacataaagagataattataaatacacaatgggtaatataattctgggtccatgaaaaacacagaagagggatatctgattctatcttggcagttagggaaggctttctggatggataaacactgaatgaagccttaaaggatggggaggaactgcccaggtgagaagggagtggaaggtgagtagaagcttccagaagaatgagacaaaatggaaaaagcacagagatgtggaatcgtttgacttgttttggggaaggtattgtattacctaccttgtttggtattattggagtataaagctattagcaagatgtggcaagaaatgagactataggctagggctccatcttgaaaatccttgaatctatgttaaggagattggattatatcctgtagattgtggggatctattaatgaggggtatttttgtgttttatatattttttagaggcagagtctcactctttcacccaggctgcagtgcagtggcgtgatcataggtcattgcagccttgaactcccaggctcaagcagtcctcctgcctcagcctcctgactgaggactacaggcatgagccaccccacctggcttattgatgagtgtttaagctggggaataatatggttagctagatttgcattttagatagatgtatttgacagctgtgtggaggataggttgaggaggataaaaccatttacgaggctgttgaaagtacaaatgacagacagtgaggcaggaacagaggggatacatcagtaaatatttagaaggtaaaatcagcagaacttggtgactggctggatctgaaaggtaaaggatagtgagcatggagaggaggtttctgttactactaagaaaaatgtggtcaaggtttcagttgttgacctaggcaagattgtgaaatcagttttgtacattttttaattagaagttctttattatacatctaaatggaatttttcaaagattttgaattgataattgtagtggttatgaggttggactggaccagaccgtctaggctcaaatcctgactgccatttactagttttttggcatcaggaatttacttaacctctctgttgctctgttcctcctctggaaaatgagaacaataatagtacctgccttggtacttgcggttgttgtgaggattcactaataagtctaaaacatttagaacactgtcagtctataagaagtgttcaagaagtgtcagtcattatcatcattatcgtcattctggagcatagaggattaagctatatagcagaaaatgggattggagaactagggatcagataatgaggagccacatatgacatttaaaatggtgtggatgttatcctaacagtagtggaaaactgttaaagaatgtctgtcattgataacttctaatgttatttctttaccccccgccccccaccacacacaaaaatctcatcttaagataggtatgctgccaccaggtggcagttatatgttatgttgtacaaatgaagtagtaaaaaccattatgtgtttcttttttaacataaaatatttacttgattaaaatagccaagtgtaagcagtctaattctagtaggactcttttgttccaaaacaaaacaaaactcgttaagcgaaggagagaaaagagagggttattgtaaagatgtggagatttcagaggaaggtcagtgtatagctgggtctcatggaaactgaaaagccattggaaactggtgccattctctccatcattttttctctcactttcacaatatgttatactcctctgtttgtagatcagcttccttgcctgcatgtcagtttgcacatgaccaaaattatgggatgagtctccaaatctgttctatccaatggaattgtttcctactaaatatacccttatttatttattttgagacagggtctcactctgtcacttaggctggagtgcagtggcatgatcattactcactgcagcctcaacctcctgggttcaagtaatcctcccatctcagcctcccaagtaactgggactacaggtacacaccaccatgcccaattattttttatagaggcagggtctcactatgttgcgtaggttggtcctggactcaagtgatcctcccacctcagcctcctgaagtgctggggttatgggcgcaagccactgtgcccagccccagtaaatatactttaaaaagaaagaaggggaaaataaaaattatataaatcatagaaacacatctactcatagagtaatcatctagcctagaggctcccaaattttgctgcatataggaaacacctgggaagctttacaaattttttgatgcctacattacatcccataccaaaatcagaaaatctgcagtgtcaggcctcactattttttgtaaagatccccagtgagcaatagactttaggacccactaacatagccactttacttgattctacaatactgtgccagctactttacttggtgtggaactaaaggaatagggatgattcaatgccagaaggaaaattgactatgttggatacaaagagaagtgttttatagtctgtaacatgtttaataggttgattatataaactgtactttatagatgattttaggagtatctgtagattgatatgattattgtatgacacactcattttagaatcctttatataagatgaatctcctcgtgttatctttctggacagcttcttacctccttgttccctaattctaagagaagaatctaagtgactgacctttctttccttatcaaacttagggtgggaggagaggcaggggtgtcatggatgggagaagctatgagcactgaccagttccctcagaaggaagttctacttactttaaaaatacttaaatatttcttctaaaaaagaatatatgtaaaatgtatgtataaaataaagactgatgataaaaagaacacctctatacctatcaccctgctgaagaagcatacacatacgaatatatttgaaacctttcctcatctaatcccaacccctcaccacttgaggtacctatagttctaaatttgtttatttccttgcttttctataccacatatatgtacacatacaacatactagttttcctgtgcttgaacttaatggtatcatatgaagtcatcagtgatttgccttttgttcagtatcatgtagagcatgttcacgtctgcatagtattccattataggaatttacgtcagtatccattgtgaggtcagtaagtatttgggttgtttccagtttttgctattgtaaatactgccactaagtgacatgatcttggcttgctgcaacctctgcctcccgggttcaagtgattctcctgcctcagcctcccaagtggctgggattgcaggcacctgccaccatgcccggctaatttttgtatttttggtagaaacagggtctcgccgtgttggccaggctggtctcgaactcctgacctcagatgatcgcccaccttggcctcccaaagtgctgggattacaggtgtgagccactgcacccaaccgccttgaatttttttctaagtttactttttattttcaaaaaattattatgtatttcctcattttccataagaacattttagtagtgtttcctcatcaataaacacaaaaaagagtctttactatgctattttcactattaactttaattcagtaataagcaaatctttgttaaaagtagagatggaggctgggcgcggtggctcacgtctgtggtcccggcactttgggaggctgaggcgggcggatcacgaggtcaggagatcgagaccatcctggctagcacggtgaaaccccatctctactaaaaatgcaaaaagttagccgggtgtggtggcaggcgcctgtggtcccagctgctcaggaggctgaggcaggagaatggcgtggacccggggggcagaacttgcaatgggccgagattgcaccactgcactccagcctgggcaacagagtgagactctgtctcaaaaaaaaaaaaaaaaaaaaagtagagatgggatttctagcctcctaaatgccagacaaacaatctaacataaaatttaccttgaataagatatatgatattgattctgagctgctttgtattttttctaactttggcatctgtatcttggtgctttctattagactgatagagttttagaacctaaggagtatgcattgtacttcagcgcttttttcttcattactttctgtgtatatagacagcatatttttttttgtagaacattaacccagattgctaatagcttcatgttatggcattcttccacacagtccagattgatttaaggaaaagcagaaatggaagtcaaagtgtgttataaattgagactgaaaaacgtgctctaaaaaaatagatttaatttcttacactgtgaatagccattgtattgttttgtttctgataaatcagttgttttgggcttctatttttgaactgttaaaaaattttgatgctttttgtggataaaagtagtgcctctctttatacaactgatggggttttgaaaagtatgtaagttgccttttttgttaaacttattttaaatgctttagtatttaaagggtatatgtttttaattaatctgcatatttaaaaactttttgtaacgcgaataactacttcctgatttacatctcaatatattctcctttcatttgcccaattaaaaaaatatgtagtctctattattgctgtttactaatagttttagatcccaatgtgtattagaattatagctacaaaaagttgcaagtaaaatttaacaatttcctattgaaacaggatctcattattatgtttttaaatgtgtagaattaacactttaaataaacaggtgtgaaaattgtaaaggaatatatatgacaactattttctgtacattaacgtccaaacattatacttgtttttcataataaaaaacattttgaaacaaaatttgctgagtttagcataaaagcatctttgaattatttctgagtttcctaaaatatgcaacattttaatcttggcatatctaatcctatgtgctgttctataagaggtacactggacttctaaccactatatgtatttagtagaataatggaatcacaaaggaacaagaattccagacttatagtttgaaatgtatcataaacaaccctttcatattttaggttagtagctttggatagctatttaacacagatgagtacagttagctttatatatattatcctctgagtcttatctatgacaatgtatatttagattaaatatgttcctcctgtaactaaagttgcatctttgcaaatgatgaaagttcatttcagcagacacaaattctttaaaagatttgggctataaactaacacttcaaattttgtaataatcagtatacttttatcaagaatgaaattatttcatgcttaattaccctccttattttgtttccataataaaactattttcagaaaaaaaaatactgcccctgtgctatttttttctgttctgacgtacagcacatgccaagggtttagagatatgcagagattatgatcccaaggtccttcagtccttggggagtagtgactacattcaggaatggagtaagaagagggagtgaagtcaaaagcaaactgatattcatgtgtttattacatgcctggtttcatcacataaatgatctctgacagatgtccatgggagctgatgatggatacctgatgtccatcaacatggatcactatgctgaccagatgcagcagttcttttattttttagtaaatatttcctgcaaaaatatatccatatgaaagggaataatgtataatgtaggtttataaatgagttaacctcagatggtaaactggcatgcattttatgctgttgagagagtgtctatttgttacaaatataccttgctttgggcattctcctttacataaactgtgcagtgttatttgttgtttatttttaatgggattaaacttaataatatacttagggtagataacgttaggggtaaagtgccgttcttctcactgttcattgttagcagtaactgagatgactgtaaaatgaagcagagataggataggtgacatctaaacagcactttctttagggataagatttctagtaggtatgtagttgtatatatcctttaaaaatagtgatattagcatatgggcccacgataattttattagtaaatatactttagagttgtgtgagggaggcaggcagtaaagatctttcaaagagaaaaacaattacctgttgtgttataacctgcaagtaatgattttgaatagtttgttgtttattctttttcttctatgcataagtaaaacgttacttaaatcttactctatatatgcagctttgttcttttttatccaagtttatgttgagagcatttttgctcattaagattttttttttgaaaacatcattattattattattattattatttgagacagggtctcactctgtcacccaggctggaatgcagtggcatgatcttggctcactccattctccacctctcaggctcaagtgaccctcccacctcagcctgccaagtagctaggaccacaggcctgcaccaccacgcccggcaaatttttgtattttttgtagagatgaggtttcactatgttgcccaggttggtctcgaattcctgggcttaagcaatatgcccacctcagcctctcaaagtgctaggattacaggcatgagccaccacactgacttgaaaacattatttttgacagctacatgttattacattgcatagttgtgcaatagtgtaaccatggacctgatattcaccttggtttttaaaataattttaattttattattactactatttttgagataggatctcactctgttgcccaggctggagtggagtgcggtgatgtgatcctagctcactgcagcctcgctcctgggctcaagcagtccttccacctcagcctttcaactagctgggaccacaggtgtgggccaccactcctggctaatttaaaaaaaaaaaaaaatttacttttttaagagatggatcttgttatgctgttctggctggcctcaaactcctggcctcaagtgatctttccactttagcttcccaaagcacatactctttttgaaacattattttccaacaaacatttgtgtctactatgtggcaggcagtgaaattgtgttaaaatatgtaacattaagatggttccttaagctgcagaatttgttttctttttagacatgacggtggtccaaaacctttatttaaaaaaaaattatattaaatgagattataggctataagtaggactggactggtcactcaatatgtaaagtcctgtggtcttttccattcctgattccctcaggcctgtttggcactgttattttccaacagtttgtatctttgtgatatttaagaatactttaaagcatccttaaaatgttgcttttgtcttctttactttcagttgccttacttcaacttcatttacaaatggtctttgggacaactgttataatctttttatttccctagttaggctactggagttttgttgtagttgtttgtattagcattcatgtttatcattcattaaggaatactaaaaacgtttaaaggcagcattgacaagtatatatagtcatcataattagaattaattggtatttcttagcttttctacagcaaaaacaaaaaacagctctatttactgctatttttgaatactggagaaactaggtaacacatttaagtaatattttgtaccattctctcgagtatatttgtttcatcgtgtttgtttttattttctctccagtcttgtcaaaaaagcacttgtctgtttggtgatatcacttgctcatgttctttaagttactgttctaggattggggtgtaatgacagatgaatgaaaagcaggatgagaatgcatggaaagcaaatggtataatggaaagttggattttgagtcagatattgttgttccattttattttgctgcttactgcttatgatcttgggcagataacccatattcatctttaaatcttggtttccacattctttcaacatttcctgacttctccccacacgaccccatttaaattaaattttttctgtgtgaggctctcctaatacctttttcttcaaagcactttttatcacttgagatgatatatttctgtgtttatctatatttaatttgtttttcccacctgtattacaattcatgagagtagggtttatacctcttttattcctcactacatgtcttactttagcacaaagttgcatgcatgatgggcagtcaataaatatctgttgaataaataaactacttactacctgacatatgccaagttattttcttcacaggtaaaactctacaaccacatctcttttggaaagacttatatgaagaaatcaggacaagggaggttcccataccacctccttaaatatatataggactgctgagtttatgaaattgtgtattaacttttatctcatttatttctcacaacttgatgaaatgagagactgttattaaataatagtagactaaagggtcctactgttaagatcatatattttgacacatgtctagcacagtgcctggcacataatgaacaatgaacactcaagaaactgaagagattccaaatagttgatttttttgaattgacattataaaaacttggctttttttttttgagacggagtctcactctgttgcccaggctggagtgcagtggtgccatctcagctcactgtgacctccgcctcccgggttcaagtgattttactgcctcagtaaaatcccgagtagctgtaatcccgagtagctgggattacaggcgcctaccagcacacccagctaatttttgtattttagtagagacggggtttcaccatgttggtcaggctggtctctatctcctgacctcaggggatccacccgcctcagcctcccgaactgcagggattacaggtgtgagtcaccacacctggccaaaacttggcatattttatacagcattttgaaaattcattgttttattcagaatgatcatttgttaagttaaaaatattgagtttggctgggcgtggtggctcacgcctgtaatcccagcactttgggaggcctaggcgggcggatcatgaggtcaggagattgagaccatcctagctaacatggtgaaaccccatctccactaaaaatacaaaaaattagccgggtgtggtgccaggcgcctgtagtcccagctactcgggaggctgagtcaggagaatggcgtgaactggggaggcagagcttgcagtgagctgagatcgcgccactgcactccagcctgggcaacagagtgagactccgtctcaaaaaaaaaaaatcttgagtttaaggaataagttattatttgtattaagtcatttattcatgttctgatcagggtaagacatttgcttgagatccgaaccagttttgaaaggcaattatatatggacataatatctttccagtaaatcttgcaactatttctgtgactacatatgttaacatttttataattggcttccaaataacaaacacagatggctgtagtctgaattttcaccatgttttagaataaatgttttctcagaaatttaaagtgcatcatttcagtataagatgattacctaattgagtagaattttttccttatctgctagcttgccatttttcagattgagagtaaatagcttaaatatctattagtataagaaattggatatatatgatcttgttccctctctcacatttttaccaaacagaactcttgctaaaaagttattgtagatattatttttctgagaatttaaattttgttttgctttttgtcttttggtggaggagggagattataattttttgtgttttaattcatttaataagtaactagaaatttgttaattttgaaaccatgagtttttaatgtagtagaattaaatatgcccgttaaactgttttggttctcaagtcttgtgaagtggtgcttgaaatcattgcttagtggtgacttttctgtaaaagataaattatctttttttactctgaatattattttaggctttgtatatatagcagagaacaaaagaaagccctaaccctcagtgaacttaccttccggttaatctgaaaaataatatgacttcatataatcagtaacataggcctaaaacaatgccatggtaatttaatgtccttaaaagtgattcgttctaagcactataatagaaaaattcctattttgattccatatctatccattatctttttaatttgggttcatttagtaatgaatattattgtttcagatttttaatcgaactgtttatgatgcaaagttttagtttttctcatttattatgtgtttgcacatctgaataaatattaaatataaattatgtataccctaattacagttggaatctcaaaccaaattttcacctttgccctgatatattttgctgtctaaatgtattttctaatgcagacaatgtggaattttaagtttctgaaattgagcataaatatcaaaaatgctattaatttcttttggttttgcattctctctgagggatcttttctttttaaacaatgcacctagaattctgattccatttacagataatatatttagcagtattccagttggtttatttttaagaatgaatttgctaccctccaaagtagtttaagtgcattccagtttcttaatgtacaagtagaggcaactggtcttgcacctgttcctcaaggagacatgaggtggaataactgtgtagttgctgaataactgggaaaaaatttaaatataatttatttttatatcctactaggctagtgattagctatttctgatttataaattagatgtctttattaagtaaatagtacatatgctttccttcatccacagcagacaaaataagtataaaatatgttgtgtgttattctgtagataacatatttgtcacacacacacacacacacacacacacacacacacacacacacacatatttttgagacggagtcttgctctgtcgcccaggctagagtgcagtggcatgatctcggctcactgcaagctccgcctcccggattcacaccattctcctgcctcagccccctgagtagctgggactacaggcacccgccaccatgcccggctaatttttttgtatttttagtagagatgtggtttcgccgtgttaggcaggatggtcttgaactcctgaccttgtgatccgcccgcctcagcctcccaaagtgctgggattacaggcgtgagccaccgcgcccagccatttgtcacatattttgatagtaatatgagcatcattaaaaattgctttatttttatgataaattttctggccattgttgtaactggtctaattaatagttatattaatactagtagtatatttcctttttttaaagcacaacaaagcttacaccttttcttattctttggtttctctcctctcagaatgaccaaagagctcaaattcaatttaggaataggtggctaatagttgcttcttagaaaaattagaaaatctattgcataacaaaaggaaatttcacattagcaaaaggaaaaatacctgtaatctcaagtcagagatacaccaaagttctcagttatattcttccagagtttctctatgcctacaagtacaatgttattaaaattcaagctagatacgattgttgaaggatgtgagtttgagtcctgccttctctgttaaaagaagtgtacattatttttttcataaaaatagattatgcagcagtaatatacctactactgtgtcatgaacatctttgttagcaataatggtttacataaatattttaatatggcgtcatcatagttaacctaatgttgcctaaagcatgtaatacatacttctgatgttaggtggtgatattttaggtctatcctgatccagtattaaaaacattggataaatgggtacaatgtacactatttgggtaatgcctaccctaaaaactcagacttcaccactatgtaatatatcgatgtaacaaaactggatttgtaccccctaaatctataaaaataaaaaaatagaaagagaaaaacattagatagtattgtaagaaagttattatgtttgccagttttcttttagttcatctgcttgtgatagccaagagtctgtttgatactcatatatctttaacacccttttaacacttgcccatttctctcatacccttcaacaaaatctaactaaaattttaataattttttcattgtatttatttttgtttacttttctaaaaaagaaatgacagtgatactgacttttagtttgtgccaaggatagaaagtctccttttagaataaatttactttaaaatttttattgttatgtaatgtatatattttgggaatacatgtgataatttaatgcactcatatagtttgtaaggatcaaatcagtgtaattgggatgtccgttagctttaattagtgaaatattcaaatattttttagaaatattcaaattattttattctagctattttgaaatatttagtagttttttgtaaactatagtcaccctaccaatctatcaaacactaggttttatttcttctgttaaactgttctttgtatccattgtcagcccctcttcatcttctccaccttcctactcttcccagtctctggtaaccaccaatctactcactatttgcatctactttttcagctcccatatatgagtgagaacgtctgatatttgtctttctgtgcttagcttatttcacttaacatagtgccctccatttgtgtccatggtgctgcgaatgacaatttgttctttttttatggctgaataatattccattgtgtacataccacattttctttatccgtttatcaattgatgggcacttaagctaatttcatattttagctattgtaaatagtactacaaaaaaacatgggaatgcagctatctcctttgtatattgattttctttcttttgaatatgtcccagtaggggaattgctggatcctgtggtagttctatttttagttttttagaaatcctccatacagttttccatagtgtgtgctgatttacatttctgttaacagtatacaagggctcttctctctccacatcctccccagcatctgttattccctgtctttttgatgaaagtcagtttaactgcagtgagataatatatcgtggtggttttgatttgcaattctctgatgattagtaacattgagcattgtttcagatacttgttgaccatttgtatgtattctcttaagaaatgtctgttcagatattttgcccatgttttaatcagattatttgctcttttgctgtccagctgtttgaacttcttgtatattctggttgttgttaactccctgtcagatgaatagtttgtagctattttctcccattctgtgggttgtctcttcactttgttgattgtttcgtttgctgtacagaaactttttagctttaaaaacattttttaaattatttattttttgtagagatagatctatgtctcactatgttatccaggccagtctcaaactctcaggctcaagtgatcctcctgcctcggcctcccatggtgctgtgcttacaggtttgagccaccacactcttctgaaactttttagcctggttccatttgtctgtttttgtttttgttgcctctgcttttgagatcttagacaaaaaaaaactttccccagaccaatgtcctagagtatttctctactgttttctttttgtagtttcaggtcttagatttttaaatccattttgatgtgattttttttgtatgtggtaagagatacttatgtagtttcattcttctacatatggttatccagttttcccagcattatttattgaagagattgtccttttctcagaatatatggtctattctggagaatgttccatgtgctgaggaaaggaatgtgtattcttcagcagttggataaaatgttttgtaaatatcaatttagcctatttagtgtgtagtttaactctgatgtttattttctgtgtggatgttgtatattcttggcacctttgtagaaaatgagttgactgtaagtgtgtgaatttatatctgggttctctgtttcgttccattggtctgtgtgtctgtttttatgccaagaccatgctgatttgtttgtatggctttgtagtatattttgaagtcaggtaatgtgatgcttccagctttgttctttttgctttggctgtttgtgatcttttgtggttctatcaaaattttaagattgttttttctatttctgtgaataatggcattggtatttcaatagggattgtattgaatctgtaaattgctttggatagtatcatttttacaatattcttctaatccacaaacatggatttctttccatttttaatgtcctgttccatttctttcatcactcttttatagttttccttgtatagattttttacttctttagttaaattgatttctgggtattttatattctttgtagctatagtaaatgtgattactttcttgatttctttttcagattgtttgctgttggtatatataatttctattgatttttgtatgttgattgtgtatcctgctattttactgaatttgtttatcagttctaacagtttttggtggagtctgtaggtttttctaagtataagatcatattgtatgcaaataaggctaaattgaccttttcctttccaatttggttatcttttatttttttctcttgcttagttgctgtggccaggacttccagtatgttgcatgaaagtggacctccttgtcttgttccagacttagaggaaaggcttttaatttttccctattcagtgtgatattagctgtgggtttgccatatatggcctttattactttgaggtatgcatcttctgtatccagtttgttgagggtttctatcctaaaggcatgttgaattttaaattttttttcagcgttaattgaaatggtcatagggttttgttcttgattctttcaatgtgatgtatcatatttattgatttgcacatgtttaactatccttgtgtctttgggatgaatcccgcttgatcatggtgaatgatctttttaatgtgttgttgaattcagtttgctagtattttgttgaggatttttgcatctatgttcatcagtgatattggcctgtagttttcttttttgttgtgtccttgtctggttttggtatcaggctaatgttggtttcatagaatgagtttggaagtactcccttctcttaagttttttgaagagtttgagtataattgttattctttaaatgtttggtagaattcagaagtgaagccatcaagtcctgggcttttctttgatgggggattttttgtgtctgtgtgtgattgggtctcctgttgcctaggctggagtgcagtggtgtgttcatagatcactgcaacctctgcctcctgggctcaagccgtcttcccatgtcagcctcccaagtagctgggaccacaggcatgtgccaccatgcctggctaattttttgtattttggtagagacgaggttttgccatgttgcccaggctggtctcaaactcctgagctcaagctcaagcaatccacttgcttcggcctctgaaagtgctgagattacaggtgtgagccaccgctcccagcttgatgagagactttttattaaggctttgatttcattgttggtttgttgaggttttctatttcttcatggttcaattttggtaggttctatgtgtccaggaatttatttatctttttcttctaggtttttgaatttgttagcatatagttgttcataatagtctgtaatgatttttgtatttctgtggtctcagtttttacatcttctttttcatttctgattttatttgacctttctccttttatgaaaattagtatagctaaaggtttgttgattttgtttatgttttcagaaaagcaactttttgtttcattgacttctgtattgactgttttggcctcaatttcatttgtatctgctctgatttttgttatttcctttcttctactaattttgggtttggtttgttcttggttttctagtttcttgcagtgcgttgtttggttgtttatttgaagtctttctcatattgttttattggtataaacttccctctcagtactgcttttgctttatcacatagattttggtatgttgtatttccattttcatttctttcaagaaatttaaaattttctcttttaatttcatcattgacccatttgtccttcaggattatgttggttttttgtttgttttgttttttgagacagggcctttctctgttgcccaggctggagtgcagtggtgtgaacatggttcattgtagcctctacctcctgggctcaagcgatcctcctgcctcagcctctcaagtagctggcaccacaggcgtgggacaccatgcctagccaatgttttgaaattttgtaggtttgagaccaacctgggcaacaaagtgaaatcttgttgcccaggttggttttgaacttctgggctcaagcattcatcccacctcagccactcaaagtgctgggattacagacatgagccaccatgcccagcaggaacatacttaattattatttgtttgtgttttctgaggtacttcttgtgactgatttttagttttattccattatggtcagaaacgatacttgatatgatttctaccttttgaatttgttgagacttgttttatgacctaatatatggtctattctggagaatgctccatatactgatgaaaacaatactcttcaggagttgggtgaaatgttctgtagatgtcagtttggcctatttggcgtagtgtatagtttaattctgatgttttctttaattttctctttggatgatctgtccaatactgggattggggtatttaagttccctatattactgtattgcagtctatctctccctttagatctattaatacttgctttttatacttggggctctggtgctgggtgcatagatatttataatagttatatccgcttgctaaattgacacctttatcattatataatgaccttctttgtctctttttatagtcttgactggtagcctattttatctgatacaagtatagctactcctgttcttttttggtgtccagttgcacggaatatccttttccaccccttcactttcagtctgtgcgcattcttaataggcgaagtgggttttttgtgggcagcttatggttgggtcttacttctgtattcattcagccactctcgccattttaattgaagaattgagtgtatttaccttgagtattattattaataagtgaggtcttactaatgctattttgttgcttgttttctggttgttttgtaattcctctcttcttcctttcttactgtctttctttgaagttaagtgatttttttttctggtagtatgtttgaatttgttgattttttatttgtagtgaatttattatagtttttggcattgtggtcaccatgagacttaaaaagacataggttcaagcagttattttaatgatatgacaacttactttagatcacaaagaaaataatggaaacaaaagaaaaaaaaaccctctatactctaactccattccctccacattttgactttactttgtctcaatttacatgtttttatattgcctatttcttgataggatgctgtagctattaatgtttttggtaggtttgtcttttggacttcatcctagagttatgagtgggcgctacaccacaattacagtattagagtattgtgggtttgtccacgtacttaattttactagtgggttgtatacctttacatgttttgttttttcacattagtgtttttttctttcagattgaagaactctctttagcttttcttgtcagacaggtatgtgttagtgaattctctcagcttttgtttgtctgtgaaagactttgttcctcttctttgtatttgaaggatagctttgctggatacagtatccttgggtggctgtttttttccttcagcactttgaacatgttgtcccacatcctcctatatggtttcttcctcctgtatgacctgtatggtatctgttgagaagtctgttgccagacgaattgtagctcttttatacattgtttgcttcttttcttttgccacttttaggatcctctctttgtccttgaccattgagagtttgattattacatgctttggagtaatcttttttgggtcaaatctgctttgttctctaacgttcctatacctggatattttatctctttctcaagttttaaaaagtttttattatttcttgaataagatttctacccccttgcattaaagttaggcattatattatgtagtgctgaaaaacaggcggtgacatggtaccaaaaaaaagatacaaaaacaatacataaattgcaaagactctctaagtgaacacattcagtaaaaaacaagccagacagtgaagactagaactcccttttgaacactgataattcttagatttgatatttcgaggtaattttctgtgtcttctaggtgatctttgttccttttcattctttccttttctcctctgtatttttaaatagcccgtctttgagctcactgattcttttttctgtttgatccattctcctgttgagagcctctaatgattctttctgttcagcaaatctttctcagttccaaaatttctttttgatttataaaaaacttttaatctttgttaaatttttctaatacatttctgaattgtttttctgtgtaatggagatcactaatttcctttaaactgctgttttgaattcttgttcacagagttcacatatttctgtcttgttagggtcattcactgattcactggttctttgtgctttgtccatttgactaagtcaaggtttcccatttgctgttgtttcttgtggatatacatctatttctttttttttttttttttttttttttgagacggagtctcgctctgttgcccaggctggagtgcagtggcgcgatttcagctcactgcaagctctgcctcccgggttcacgccattctcctgcctcagcctcccgaatagctgggattacaggcgcctgccaccactgccgggctaatttttttgtatttttagtagagacagggtttcactgtgtcagccaggatggtctcgatctcctgacctcgtgatcctcccgcctcggcttcccaaagtgctgggattacaggtgtgagccaccgtgcccggcctacatctatttcttaaagtgaagattttgttatttattctagtcttctctgtctggcttgttttagcttttactggatatgtttgctcatagagtcttttatgttttgcctctcttttttttttttttttttttgcactatgtcactgcctctgtttcagtactacataatataatgtatatgatgtctttagccccagtttgcttcagttctagtaaacaatcagtgttatccatccttgatcggtaaggtcccaaaggcccctagtctggctaggggctcgtgcccagaggacctgtggcatgaacctcttacagtgtgatgctgctgaacagccagtctgatttggcgtctcctttggccaagttacaaagcagggtttttcagggctaggaatggtagtcttgccttcccgctttgtctctggctgttaggaatatttctcccttcagatattcccagtacttcctggttgtccctggttgagccagggacagatctcctgtcaaggagcccaagttgatggagaagctggttgtccaccttgatctcactttttccagtgtagaaactgtgagtcaggggaatattttccatgtttggtgatgggcagattaggagaatgggaatcatgaaaatcaaagtctaattcttttaacttctgctcagagttttttcacttctccatggtcttgaatactgtttcttcctcatatttgagttctgggatatcgccagtaataatctaagctctgtatatttgcttttggttttctgttaggggaagcgaaggcaacttgcttctgtgccaccattttggagctattaggttggtgcaaaagcaattgcagtttttgtaccgacctaatggaagcctctgttcttaaaataaatttaaataagaaaactacattggttaaaacatgttaagtaaatgatacataaaggtggctctaggataggacaaaaatcctgatgatgatatgtaaacgattaagggctggaaagcactgctgtttgatatttaagttatttccagttttttttcccattatgaataaggctgcagtgaccactttatatagctaaatctttttgcatgaactaaatctttttagtatatagtaatagaagacacagaaattccagaaagcaaattcatgtagtgctctgtgtgtgcatgtgtgtatgtgtgtgttttcatataatctaaaatccagagcttggccagcacactggctcacgtctgtaatcccagtattttggggaggctgaggcaggcgaattgcttgagcccaggagttgaagaccagcctgggcaacgtggcaaaaatctgtctgtacaaaaaaatacaagaattaaattagccaggtgtgatgacatgttcctgtagtcccagctacttgggggctgaagtgggaggatctgtggagcccagaaagttgaggtgagctgtgatggcgctactgcactccagcctggatgacagagtaagaccctgtctcaaaaaataaaataaaatcttggtgagattatattctcactaagcagtgaatgacagtgcctgatttcccttattctgcctaattctgggcttattttcttttatttagacatgacattttcagttcttacccctcaatatttcagtaggtttattcagaaatgtttctttgcattccagtagttacattaaagactgtaataattgttctttattttttcatttttatttagtgatagtttgatctttaaaagagagactcccaaagctgcttttttcttggtggcaataaagaaaaattatctttgacaataacggttattttcttttttcttagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaagtaagtattctcccagatttttaatcattatggttctcgatggaaagtagtcataacaacagtcattagcaactgtgcgcaatttgatcatgatttttatgtcctcttgaaagttttagtagtatggtaactaaacagtcataactaaaatatttgatcatctcagagagggagttttgtgagtttaatttaatatatgttgaacaactgcagtacaccaaagactgagcaccagagttacaaagatggatatgactatctctgccctttaggaaaattattctagtggagaaggcagacttaaaggtatgcagtgtgctatgattagacctttgctagtatgagagatagatgtccaacttcattttttttgtttgtggctatccagttgtaccaataccatttgttgaaaagactattcttttcccaatgaactgtcaatgaatataaaggtgagggtttatatttatcccctcaattatattctgtagatctgtatgtttagcctttgctactatgcccccaagtcttgattaatgtagctttataacaacttttgaaatcagtaagtgtgagtcttccaactttcttctcttttgggattgttttggctgttgccttgcatttccgtatcaattttagggtcaggtttttctgtttctgcattaaaaacaccacggattttgacagggattgcattgaatctgtagatgaatttggggagttttgtcatcttaacaatattaagttttcaacctatgaacacaggattttttatttatttaggtttttaatttttttaatgttaccttgttttcagtgtaaacgtctcacatttgttttgttaaatatactctcaagcattttatttttattttaattttcatttatttactttttgagatgggttctcactctgtcaccgagactggagtgcagtggcatgatcttggctcactgcaacctctgtcacccaggcccaagccatcctcccacctcagcctcctgagtagctgggaccacaggtgcatgctaccacacctggttaatgttttgtatttttggtagagatgggattttgccatgttgcccaggctggtctcaaactcctgagctcaggagatccacccaccttggcctcccaaagtcctgggagtacaggcatgagccaccgtgcttggccttgtttttgttattttattttattttagttttttgtagaaatgtggtctcactttgtgtccaggctggtctcgaattccaagacttaagtgatcctcccgctctggctcccaaagtgcttatgcctgtaaagttttatttacaggcatgaaccactatgcctggccaccaagcattttattgctattttatttctaagcattttactgctattctaaatataattgtattcttaactttattttctgattattcattatccatgtatacaaatacaactaaatttgtatattgatcttgtctcctgtacccttgcagagctaactcatctgtaagttctaataggttttttgttttgttttgttttgttttggtgaattccttcgatttttcctgtatgcaagaccatattatctgcaactaaactagaaatgttcaacttcttcctttccaatgtcgatgttcttttttcttttttgtaattgccatagctggaagatataagacaatgttgaaaagaagtgttgaaagcagacatccttgtattatttctcctaataaggggaaagcattcaggtttttttttaaccattgagttttatattagctgtttttgttttgttttgttttgtttttgtagctatcctttatcagattgaggaggttcccttttattcctggttcattaagtgttttcattataaagaaatgttgaggtttttttgttttgtttttattttttagtttattggtttgttttttgtttgtttgtttgttttttttttttttgagacaaagtctcgctttgactttgcactccactgctggagtgcagtggggtgatctcagctcactgcagtctccacctcccaggttcgagtgattctcctgcctcagcctcctgagtagttgggattgtgagccatcacgcccaactaatttttgtatttttagtagagatggggtttcaccatgttggccagggtggtctcgaactcctgaccccaagtgatacgtccacctcagcctcccaaagtgctgggactacgggcattagccactatgcccatccacttattttattgttttttgagacaggatctcactctcgtccaggatggcatgcagtggtgcaatcatggctcactgcagcctcaacctcccagacttcagtgatcctcccacctcagcccgacaagtagctgggactacaggcccatgccaccacacctagctaatttgtgtatttttttgtagagacggagttttgccatgttgcccaggcttgtcttgaactcctggattcaagtgatctgcctgccttagcctcccaaagtgctaggattacaggcatgagccactcactgctcccaacctgagtgttgagttttgttaaatgctttttttgtgtctatttgcaatgactttaatacaaaaaccatcactagggacaaaagatgttacagcacacattttacattatataaattcagccttttaaaatattttgggtatttaaatggtctaacatatagtcatctttctgttcttcagagtggataattgcaattcatctatcttgaagtttgctgattctctcttcctacttagatctactactgagtccttctagtggcttttcatttattttccttttcaattccagaatttttatttgattattttataatttcttcgttttattgatattcttcatttggtgaggtgttgttcttacaatttaaattttgttttgttttgtttttagattttatttcctttagttatttgactgtatttaaaatagctgagtcagaatctttgttggccaggcatggtggctcatatctgtaatcccagcactttgggaggcagaggcaaggggattacttgagccgaagagttcgagaccagcctgggcaaaaaagggatattctgtctttacaaaaagtaaaaaaaattagccgggcatggttgtgcacacctgtggtcccagctactccagaggctaaggtgggagaatcgcttgagcccaagaggtggaggctgcagcaagctgtgatcacaccagtgcactccagcctgggtgacagagtgagatcctgtctcaaaaaacaacacaagggccgggcgcggtggctcatgcctgtaatcccagcactttgggaggccaaggcgggcagatcacgaggtcaggagatcgagaccatcctggctaacacggtgaaaccctgtctgtactaaaaatacaaaaaattagcggggcatggtggtgggcaactgtagtcccagctactcgggaggctgaggcaggagaatggcatgaacccaggaggcggagcttgcagtgagccgagatcacgtcactacactccagcctgggcgacagagcgagactccgtctcaaaaaaagaaaaaaccaagacaaaaccaaaaataactttgtctgttaagtacaatatctgtgttcctcagggacggtttctattgaccattgtttttcttgtgcatagactatcctttcctttttttgtacatcttgtaatttttgttttattaaaactggaattttaaaaataatgcagtgtggcaactctactgcttgatttggctcaaaggtatattatttattttttaatataacaaaccaatatttgggttctctattctatagttttagcattttgaatgcaacaactgtcttattcaccatttaattctcagtactaccgtttctagtacacaatatgcacttaatgaatatgagggattgtatcatgaaagtatttcagatttaaaagataatctcggctgggtgcagtggctcacgcctgtaatcccagcattttgggaggctgaggtgggcagatcgctagaagttaggagttcaagaccagcctgggcaacatggtgaaaccttgtctctactaaaaatacaaaaattaactgggcatgttggtgcgtgactgtaatcctagctactcgggaggctgaggcaggagaattgcttgaacctgggaggcggaggttgcagtgagccaagatgatgccgctgcactccagcctgggcaacagagtgagactctgtctcaaaaaaaaaaaaaaaaaaaagagaatcttatgagttaggaaccactgttaataggattttagattacaggcaagtttatttttgttcttggcctcagttactacttcatggagaaggtagttttagaacttagacttgaatgttgaatagaatttccataggtgtagatgagaaaggagacagtgacagttaatatttgttgaatgaaagggtgaaactctctggagagggtcaacagtgagaatagtacttttggagtcagaaaatttggatttgttccttgactctttctactacttcttttagggaagcttgaaaaagctactcacttcatacccaaatccaggcatgtgatagtgaaacaagaatgactttaaaagtgcttttgtaaactgtaaaggtgttataacaaaagtggttattttttctttagttattactttttttagcatcatgatgatatgatttttctttcagagaaattgaacttttcttttttattgatttattttaattattattattattttttaaagacagggtctcactctgtcacccagaccagagtgcaatggcatgatcttggttcaccacaagctctcccttccaggcccaagcagttctcctgcctcagcctctcaggtagctgggattacaggcatgcaccactaccgcctggctagtttttgtatttttttttttttttttttttttttagtaaagacgagagttcaccattttggctaggcaggtctcgaactcctgaccttaaatgatccacccacctcagcctcccaaagtgctgggattacaggcatgagccaccacacctggccgaacttttctaacagtagcattttaggactttgtttcattttaaagaggtacggtagttcctccttatttgtggagagttgtatcattccattttcatgctgctgatacagacataccggagactaggtcatttataaagaaaaagaggtttaatggactcacagttccacgtggctggtgaggcctcacaatcatggtggaaggcagaaggcacatcttacatggcagcagacatgagaaaaatgagagccaagggaaaagggaaaccccttataaaaccatcatatctcgtgagacttactaccacaagaaccgtatgggggaaactgctctcatgatttacttatctcccaccaggtctctcccaaaacacatgggaattatgggagctacaattcaagatgagatttggatgggggaactcagccaaaccatatcaagagtatagtccaacacccccagtggagacctgaaaccacagatagtactgaactctgtatatactgtgttttttcctatactcatatacttatgataaagtttaattgataaattaggcactgtactcttgtgctttggggccattacttgaacacaagcactgcaatactgcatactgccataatgtatgatagtgcatctgataatggaggtggctaccaagtaactgttgggcaggtagcatatactgtgtggatatggtgtacaaagggacgattcatgtcctggatgggacagagtaagatttcatcatgccacttagaacagtgcacaatttaaaacttatgaattgtttatttttggaattttccattttaatattttctaaccacagttaaccatgggtaactgaaattataggaagcaatactgtggataaagagggggctactgtatgaggattggaggaatggtgtcttacttcatgcttttggcttacaaatgatatgtatataagaccctgtatgaaagtacctcttgatacttttatatttagaaaaatgcctactggtacattttggttgcattattttgccattgttatttataattaaatgaaaattttaaagatttgagtaatttttactagttttttagtggtattttatgtgacttttctatcatatgttaccaatagtaatggtttagtaaagtatgatatttagcacaaaaaagtcataattatatttggtttttatttttgttttagctggaaagtgaaatttcaaccacagcagatgactgcagttcagaggtaagactaaattatattgatttctaatatcataaatgtatatttatattattattgaaatcattgattgttgctacttgatttcttgtcactcatgcttctattttatttttataaatataatgttaagtgactagaacctgaggattatgtattactgactttttttttttttttttttttttcagattattagctaaggtcttaagtctggttaaatagcttggtctctgttttagtttctggaaagtatttgatattgggtttcttagacatgtgactgttacaaggcatccatatttagcacagtaaaaatatcaaaaattttttgagactttgaataggatatttcattttgagtaatgcttttttataaatgcttgaattctagttaatcatatgaacttgtttattgaaattaatgtttcaatagtagtttttactttaggtgataaaggtattgtccactttaggaaataccctctttgtgtgttggtaaaagtatatgtcattttgttatctttttcttattcttttagatgtgattgtcatttctttactccagaatttgaggagactataaactattctgtactctgaatggtttagcaactcagtgtattcagtaagtctcaatttattgtaggtttctaataggaaaaaaaaactccatgttcttaaatgaacgtattactgttttagattgctaatagcaataaaaactgctactttagaagttaatgtgcttaaaagttggaatatacttactagtaatctggccaggaaaataattagccaacattaaataaacacattggtgcctgatttaggctaaagttgcctctatgggaagtatcttgatttaaaatcactgcttaaaattcagagtctgcttttgtgacattaaatttggggcgcatacagttggccctccatatccctgggttctgcatttgagggtatgaccaaccacagatagaaaatattctgaaaaaataaaaaataacagtacaacaatagaaaatatataacatttaaaaatatagtataacaactaagtatatagtaatcttagagatgatttaaagtatatgggcagatgtccacaggttgtatacaaatactatgccattaagggtcttaggcatccgtgattttagtatccttaggggagttcctaaagctaattcacttgaagacaccaagggattattgcatttgaaaactttttttttctttataatgctctaatttttatatcttgtatttcttttttttttttttttttttcaccaagatggagtctcactctgttgcccagactggagtgcagtggtgcagtgttggctcactgaaacctctgcctcctggatctaagcaattctctgcctcagcttcccaagctgggactacaggcatgtgccaccacacccggctaatttttgtatttttagtagagacggggtttcaccatcttggccaggctggtcttgaactcctgacctcatgatctacccacctctgcctcccgaagtgctgggattacaggtgtaagccaccgcacctggctatagcttgtatttcttgactgaaagtcataaatgctttggtgcttaaactgcctgtatctctgggggcaccccagagttccacgaagtgcatttttctctttacactaaagtgaatattttttaatatgctagtggctgtaggtcagaccctcccatatatgcccatgaaatttggttacaatttgtatagctgttttctcacattgagataatagagcaaattttaatttaatttttttgtcattctaagtattttacgtacgtatgtatgtatgtatgtatgtatgtatgtatgtatgtatgatactttaagttctagggtacctgtgcacaatgtgcaggtttgttacataggtatacatgttccatgctggtttgctgcacccatcaactcgtcatttacattaggtatatctcctaatgctatccctcccccagcgccccacccctcgacaggcccccatgtgtgatgttccctgccctgtgtccaagtgttctcaatgttcaattcccacctatgagtgagaacttgcagtgtttggttttctgtcattgtgatagtttgctcagaatgatggtttccagcttcatccatgtccctgcagaggacatgaactcatccttttttatggctgcatagtattccatgatatgtatgtgccacattttctttatccagtctatcattgatggacatttgggttggttccaagtctttgctgttgtgaatagtgccacgataaacatacgtgtgcatatgtctttatagtagcatgatttataatactttgggtatatacccagtaatgggatcgctgggtcagatggtatttctagttctagatccttgaggaattgtcacactgtcttccacaatggttgaactaatttacactcccaacagtgtaaaagcattcctatttctccacatcctctccagcatctgttgtctcctgactttttaatgattgccattctaactggtatgagatggtatctcattgtggttttgatttgcatttctctgatgaccagtgttgatcattttttcatgtgtctgttggcttcataaatgtctgcttttgagaagtgtctgttcatatcctttgcctgttttttgatggggttgtttgctttttttttctttcttttattattattattatactttaagttctagggtacatgtgcacaacatgcaggtttgctacgtaggtatacatgtgccatgttggtttgctgcacccattaactcgtcatttcatttggtatacctcctaatgctatccctcctcctgcccgccaccccacgacaggcccccatgtgtgatgttccctgccctgtgtccaagtgttctcactgttcagttcccacctatgagtgagaacatgtggtgtttggttttctatccttgtgatagtttgctcagaatgatggtttccagcttcatccatgtccctgcaaaggacatgaactcatccttttctatggctgcatagtattccatggtgtatatgtgccacattttgttaatccagtctatcattgatggacatttgggttggttccaagtttttgctattgtgaatagtgccgcaataaacataggtgtgcatgtgtctttatagtagcatgatttataatcctttgggtatatacccagtaatgggatcactgggtcaaatggtatttctagttctagatccttgaggaattgcttctaaaatatctactaaaaataacaaaaattatctgaacatggtggcgcaagtatttttgtatttttgttagagatagggtttcaccaactgtcttccacaatggttgaactagtttacactcccacaaacagtgtaaaaccgttcttatttctccacatcctctccagcatctgttgtttcctgacttttaaatgatcgccattctaacttttgtgagatagtatctcattgtggttttcatttgcatttctctgatgaccagtgatgatgagcattttttcatgtgtctgttggctgcatgaatgtcttcttttgagaagtgtctgttcatatcatttgctcactttttgttggggtttttttcttgtaaatttgtttaagttctttatagattctggatattagccctttgtcagataagtagattgcaaaaattttctcccattctgtaggttgccttttcactctgatggtagtttcttttgctgtgcagaagctctttagtttaattacatcccatttgtctattttggcttttgttgctattgcttttggtgttttagtcatgaagtccttgcccatgcctgacctaaaggttattgcctaggttttcttctagggtttttatggttttatgtctaacatttaagtcttcaatccatcttgaattaatttttgtataaggtgtaaggaaggagtccagtttcagttttctgcatatggctagccagttttcccagcgccatgtattaaatagggaatcctttcgccatttcttgtttttgtcaggtttgtcaaagatcaaatggttggagatgtgtagtgttatttctgaggcctgtgttctgttccattggtctatatctctgttttggtaccagtatcatgctgttttggttactgtagccttgttgtatagtttgaagtcaggtagtgtgatgcccccagctttgttccttttgcttaggattgtcttggcaatgtgggctcttttttggttccatatgaactttaaagtcgtttttttccagttctgtgaagaaagtcattgatagcttgatggggatggcattcgatctataaattaccttgggcagtgtggccattttcacaatattgattattcctatccatgagcatggaatgcttttccatttgtttgtgtccttttttatttcgttgagcagtggtttgtagttctccttgaagaggtccttcacatcccttgtaagttggattcctaggtattttattctctttgtaggaattgtgaatgggaattcactcataatttggctctctgtttgtctgttaatggtgtataggaatgcttgtgatttttgcacattgattttgtatcctgagactttgcttaaggagattttgggctgagacaatgggttttctaaatatacaatcatgtcatctgcaaacagggacgatttgacttcctcttttcctaattgaataccctttatttctttctcttgtctgattgccctggccagaacttccaagactatgttgaataggagtggtgacagagggcatccttgtcttgtgtcagttttcaaagggaatgcttccagtttttgcccattcagtatgatattggctgtgggtttgtcataaatagctcttattattttgagatacctcccatcaatacctagtttattgagagtttttagcatgaaaggctgtggaattttgttaaaggccttttctgcatctattgagataatcatgtggtttttgtctttggttctgtttatgtgatggattatgtttattgatttgtgtgttttgaaccagccttgcagcctagtgatgaagctgacttgatcacggtggataagctttttgatgtgctgctgtatttggtttgccagtattttattgaggatttttgcattcatgttaatcagggatattggtctaaaattcttttttgttgtgtctctgccaggctttggtatcaggatgatgctggcctcatttaagttagggaggattcccccaccccctttcttttttctgtggcggagtctcactctttcgcccaggctggagtgcagtggcatgatctcagctcactgcaaccctcgcctgccgggttcacacaattctcctacctcagcctgctgagtacctgggactacaggcgcgtgccaccatatctggctaatttttcgtatttttattagagatggggtttcaccatactgttcaagctggtctcgaactcctgacctcttgatctccccacctcggcctcctaaagtactgggattacaggcatgagccacctcgcccagccaattccccctttttctatttattggaatagtttcaggaggaatgataccagctcctctttgtacctctggtagaatttggctttgaatctgtctggtcctggactttttttggttggtggtctattaattattgcctcaatttcagagcctgttattggtctattccgagattctacctggtttagtcttgggagggtgtatgtgtccaggaattcatccatttcctctagatgaaagaaatgggacctgctgagccaggcacgggagagaatctcctggtctgccagtttctgagaccattggaaaagcgcagtattgggcgggagtgtcccgtttttccaggtacagtctgtcacagcttctcttggctaggaaagggaaatcctccaaccccttactcttcctgggtgaggcgatgccctgccctgcttcggctcaccctccatgggctgcacccactgtccgaccagtcccagtgagatgaaccaggtacctcagttggaaatgcagaaatcacccgtcttctgtgtcgctcacgctgggagctgcagaccggagctgttcctatttggccttcttggaacggatcctcacaaattttaattttaaatattgatttgaaaagctaaagaggtcaaaagatggtgattttcaggttttctgtaggaaaatgttaattaatagtatgggaaattcttgttataataagacagtcttcagctaaattttttaaattaaaaaactggtggagattatcaggttccaaaaaatgtattgaacctatttatctgagatgcctagtaaatatatgttttaaggtaaggtacaaatagtatttaagtgtaagtactaccgataaaacttagaacagtatttatcatacttgttgaccatagctcatggtgagaaatatattttacatacgtttgtaatttcatatatatacatatatagttacatatatttatagttatatacatgaataattatatatgaataaatatatacatatgcatacttttttccaaacaagtttttggaaagatacttattcttacagtatgacatatcttgtgatgatacagtttcttgttaatgttggtcaaaaaaactaaattgatgagctatcttaccgtgtggaataaacagtgatttagaagattacattgaaaaaagataattatgagccaggcacggtggctcattcatgcctgtaatcccacactttgggaggccaaagtgggcggatcacctgaggttaggagttggagaccagtttgaccaacatgctgaaaccccatgtctactaaaaataacaaaaattacctgaacatggtggcgtatgcctgtaatcccagctacttgggaggctgaggcaggaaaattgtttgaatctgggaggtggaggttacagtgagccgagatagtgccattgcactccagcctgggcaacaagggtgaaattctatctcgaaaaaaaaaaagaagaaaaaagataattatgaaataatttttgacagatttgacctggtttgaattataaccctagtaatattttgtgtgttatgtatggattcacaacggattatactttgagaaatttatagattcactatgtctagagaaaacgtagaagtaaagttgatatttggtgaaatgtttgatatgtgtcatcaaaattgctaagatggatactagttggatctgtgatgctctaggctagttttgaggcttgaattcctccatttaatgatattagactggcttgactcaactagaattacaggagacttctaagccatatccacctattcaggaggcagaaaaatcatcagtggaccaaatttataacccgagaaataaactcatactgtaatagtttttatattggaacttttatggaattatctctcaataacacacctaaaaaatgagatttattggccgggcatagtagctcacacctgtaatctctgcactttgggaggccaaggtgggaagatcactggagctcaggagttcgagaccagccttggctacatagggagacatcatctctacaaattaaaataataaaataaaattagcaaggcatagtggcgggcacatgtagtcccagctacttgggaggctgaggttacatttttcaatgtaatcttctaagtcactgtttattccacacggtaagatagctcatcaatttagtttttttgaccaacattaacaagaaacagtatcatcacaagatatgtcatactgtaagaataagtatctttccaaaaacttgagcccaggagtatgatcacaccactggcactccagccttggtgacagagcaagaccccctctcaaaaaaaaaaaaaaaaaaaaaaaaaaaagctaggtgatagtgtgtgcctgtacttccagctgctcaagaggctgaagtaggaggatcccatgcacccaggagtttgagtttgcaatgacctaatgatcacaccactgcactccagcctgtgtgacagagtgagaccttgtctcaaaaagagaaagagagagagagatttctgggcagtatgtaacattataacttcactgcaatgccatatttgcaaagtttaataatcttggcagatctagattgtatttgagtattctaaaattttgaaatcaagtagttttaatcatagatcacataattatcttgtattttacctaaatatgactatcatttttctggtaaatagggcaataagatgtaagaaaagagcagggggactttggagccagaaagtcctgtttacatacttcatcacctttgaactgtatgaacctgggcacatcacttaaactctgaaatacagtttgtttttttattattattatactttaagttctagggtacatgtgcacaacattcaggtttgttacataggtacacatgtgccatgttggtttgttgcatccatcaactagtcatttacattaggtgaaatacagttatttaaactataaaatgggggacgatgatatctacctgatatatttgcatacctcacaaagtagttcacaaaataagcttgagaatgtttaatatgtgtttggcatacattagacgttcagcaaagtgtggttttttaaattgctcatcactagaaatacacttttctttacactacatttatatgaaatgagtgatgatgattcccttaataaattgttctcagaaggatttcaggttctgataatatttgattagaacttaatttgtaaattgtatttatttaggtatattgtgggtttaatgttcttgacttctgtgactagtacactcattgggttggaaaattggttccatcttagaattagtcaaataatattattccaagatctcttttgtagaaatatgtatcctattatgtacactagagaaatcggactaaatgaaaaatactcttcttacaaattaaattatatgcagtcatcttcaatcattaatgaagggacgtttcatgtccagaataccatatttacatgaattgtttttgataccctttgagcagggttatttggaggaagttgggaatacaggcaatatagagtcaagacaagtagataaatatactttgccatgtatagaaagatgaaatgatagtaatagggtattcactcttattatagatttcatctgattattgaatactttttaaccaagtgcttatatggtttatgacatttattttaacctcgttaattacttgactgcaactccataagtcatttaggcacattgaactcttataattttcatgaacttttatgagccatcagatttttattttttatgaaaatattcaatattaatgtttttaatttatatatttccaaattaagtacaagaataaggtattaatcataaataaggatgagttgttcttttatatttcatcaacctaatgttcaccacaaggatgagtttttatgtgaaggccattttatagtcacatagtgaaagttacctttcctctgattctttctgaatagcaatgttgttatgatgtgatacctctataaaacattttaaaatttaaaatgtacctcacttgtactttcccagatctttaagttatctgtacagatagagtaaatttttctgtgaatgcagaaagaatacattaacatagtctgtaggttaaataacttcaacaaatgccacaataaaaaaggacattgagagaagttgagcttttttcagttgaaggagtctgttaatctaatcttcatgtttcaagtcatttatttactttcatatgaaggtttacttagtgttagaagactaatgttagaagaggagataaatactctaccctttagttatcaataaaataattatctaaatttaaaaacagaataatttattgttaactattaatgatcctgatattctgttaagtgttcctgttctaactttggaatatagtgtgttttagtttagttctggtgaataatcttttatagccaatttgtatgatgttaaacttttcagatttattaatattgataagttttacatttattataacataaatatgttttgaaacagtcatgtattaatggtattttaagaattcaatacatatgagttcaagtataacatttgcttatctgaattagagaaaaattaaacagcagtggctaaataaagtactagatgaaactataaacataattattataaaatggtaactgataactgattcatgtaatactgacagttattacaaactgataactgataactgattcatgtaatactgacataatcactccttaaaggaatattcattgctttgtatcatatttgaagaagcagtagtcccccatccctgtttttactttctgtagtcaaccattatctgaaaatattaaatggaaaattccagaaataaacaattcataagttttaaattgtgccttgttctggtagcatggtgaaatcttgctccatcccattcatcccacccaagatgtggatcatccctttgaacatacagtggatctacaccatatactctgtccatctcatgttcatttagtagctgtctaccttatcagatcaaaaaaccatagtgtatatagggttcaatactatttatgatttcaggcatctactgggagtcttggaacatatcccctgtggattaaggaagactactgtattcataaacatccatttcgttacactgataggctacagtaaaatattttagaggacacatcagaatgcttcatttcaggatcaagaaaagctaattgcaatttagaagtatttaatttgaaagttattgcaaatgtcttgatattaatcttttaattaaaaaaattttttagagacatggttctcagtatgttgcccacagtggagtgtggtggcaattaataggtgtgccagttgtgcactatatcctcaaactcctgggctcaagcagtcctcctgcctcagcctcccttgtagctggaaaccagccaaatgggaagaactctttttttttttttttttgagacagagtcttgctctgtcgcccaggctgtagtgcagtggctcgatctcagctcactgcaagttccgcctcctgggttcacgccattctcctgcctcagcctcccaagtagctgggactacaggcacccgccaccacacccggctaattttttgtatttttagtagagacggggtttcaccgtgttagccaggatggtctcgatctcctgagctcatgatctgcccgcctcagcctcccaaagtgctgggattacaggcgtgagccaccacacccgacctaaattgttttacttgaaaatgaatagggcttaataaataattatttgaaccattttaaggaagcctttcatagaagagattttattgaggtttatacttctgaagagcaaacagaaactgcacttagaactttaattcacttaagtgaaaatgtatatatgtgtcttttgcattgtaagcactcagatttgtgaggaatgattggcatttgaaatggtcattatgtctcttagatattttaaattaatctctgtatctgttttcgccaatgatgcattttccctaggaataaaagacatacacgtgaatacagttaacagaaatattgttagctaaataaaattatgtctaagatcataatatatcaggaaattgtttttatacaggtaaatggttgcagttttgtgatgagaacaggaaagcctacaaatttattaagggtacagtatttaaaactacttgtgatactaatgttggatactatttaaaatcatctggcttactaacaaaactttttcctgcatgtacttctttctgtgtgtgatttcaaattaattttaatgtttactaaaacaaagttatctaccatttattataaaactcaattgtaggccaggcgtggtggcttacgtctgtaatcccagcactttgggaggccgaggcaggtggatcacctgagataaggagttcgagaccagcctgaccaacaaggtgaaaccgcatctctactataagtacaaaaattagccgggcatggtggcagccgcctgtagtcccagctacttgggaggctgagacaagagaattgcttgaacccgggaggcggaggttgcagtgagctgagattgcgccactgcactccaacctgggtgacagagcaagactctgtcaaaaaaaaaaaaaaaaaaaaaaaactcaattgtaacagaatttgcggataacctgtttatgttcttgaggtaaatatgttaacgaagtaggttgccataccataatcttccaggtggtgagtgatgttttaaagtggaccttgctatggatttcagtatttgaatctctctccctaaggaatattgctaatactgaattctttaaaatcttggattgatttaggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcaggtatgtttattttctgtggcttttgatttgctactcacaaaaacaaaaacaggaaatgtgaataatagtagtctttaaagatggggtttttaaaatttttttttaacttttttcttttcttttcttcttcttcttcttctttttttttttccatacagggtcttgctctgttgcccaggctggagtgtagtggtgcaatctcggcccactgcatcctctgcttcctgggctcaagcgatcctcccacctcagccttgtgagtaactgggactacaggcatgcactaccacacccagctaattttttgtagagacagggtgtcacctcagattcctggactctccttggcctcccaaagtgctaggattacaggcgtgagctactgtgcctggcctaaagaagggggttttaaaatggtaacttagtgggacacagtggcatgcacctgtagttctagttattcaggaggctgaggtgggaggatcacttgagcccacgagttcaagtccagcctgggcaacattgggagtccctgtctcttaaaaaatcaaacagaaaagtaaatgataatatcactcataatttttgtctttatacattgcataaacaaccctgtttaaaagtaggatttcattaacagggttaatataacacagactcttttttaactttatgatagctagcctgaaatcactttaataagacagatgtttttgtaatcagcctgagagaaaattatggtgcaaaccacatcaaaatattataacttaagtccattaagaatgtcagcaagttgggcatggtggcttatgcctgtaatcccagcacttcaagaggctgaggcaagaggatagcttgagtctggtagtttgagactggcagggtgaaaatagcaagaccccgcttctacaaaacatttaaaaattagccaggcatagtggtgtgtgcctgtagtcctagttacttgggaggctgagacaggaagatcactgcagcccaggagattgaggctgtagtgagccaaaatcacaccgctgcactctagcctgtacaacagagcgagaccctgtctcaaaaaaagaacagaaaaacgatgtcagtgggtccttgtaagtaacctcttgtggttagactaacatctgtggttagactgccataactgtctatggcagtcagttatgaaaacaagatgaagtaggacattgatgaggatgacaaaaatacatatcagtttcatcctcttcagaaacaagttggaattaaacatgtctagggtggtgttgcctgggaacagattaggggcacccctaaatataaaggcacttgtccttctataagtaaatatatggataagccagatcaattttttccttagttcagataaattttttgaagttgatttggaagcaccaatttctgtaagttaatagttttcaaatgtggaaaatactgattacaaagtgtaagaattatgccaatgtgttttgaattcttattttgaaaaagttacctgtaataatagtcaattaaaaaaaataaatctagcacttactattttctttcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaagtaagtattactaatgcaacaaaattcattatttttttagtaatgaattttaaaaattcactttcaagaacaaatctaaatttgttaaaaaagccatttcgtattatatcatgtatgaaaaattagtgaatatgtgttgctatattaaccaggaatttaattcatacttcttaaatggttctctactaatattttcttttcatttcctccctgtctctattttgaaatcttacaaattgtgtaaggttgattgagggtatttctgcagaaattaacctgtagtcacatcctacctttgccaattctggtatggtttattttagttaggttctaaatgataacaaaactaaatatattccattttcctttaattagagccacaggaatctaactgcattaatcagaatttctgatggcaagtagcaaaacaatttgaaatagtttaagcaaaagggaggtacttagtgtaaggattcaggctgtttccagaacccaagggcagaaatacaaccaggcctctgaaagggattggaactacaaactggaaagccatagggaattcgggaagtactgtctttgatgccccacttttcttcgtatatctgcctcagtctcaggagacctaggttctctgctgtatcatggaaaagataagtttattggctcggcttgggtatacctatctagtcagccaaggtagcatgtttgctagggtctcaagcctgcagagttcccagagagctattgcagggacaccccaaaggtgtctgttccctaatacagtcacttcagaatttaacgttttgaggtttctttctattttcagttacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggtatgtttattttaaggaagtcagctaacttgtagaagctttagagtttcaagttttttatgcaagtggtttttttttgttaggcacatgaatcacaaaatttcataattaagctctttgtgtaatttatttcaaaagcaaatgggaatctcagtaatgtagtttttaagataatagtcattactgagttccctaaaagtgatcagcctatgttaaactgaattagcaggaaaatacaaatttatagctatagttttttttgtcatttataattatttccacttattttagccatggttgtgaaattcagaaaatattttcacaacagagagaaattttatggattttaatgagaaaaaaattgaatgtagtcagttatctttatttacataagttatgttccataaacttaagtgtttctgggaacacttatttagcaaataagttctctggtgggggattgttgggaggaatatgtgtccgtgtatgggtgcgtatattttacatatatgtgtatcacattgattataatcttaaatcataaaactactcatcctggaagattctttttctttattttttaaaagggaaatcaaggttcagaagtgacttgcctgaggccaccccactaacaggtgtcagactgggattcagatcctgtcagttgccccagagctggagcttcctgtactacactgcactacctcgggtcctctccatccctctggtcctctctataagggatgaacaaggcagtgtggtcaccttgtttgacctcagctagaagtgtatgtccagcaactcaaattttttgtcgctctgtgcacacctacaaatgactaaaagcaccatgagcattgatttgggggttacaaataaattttagcaagaactcacaaatatggaatctacaaagaatgaggatggattgtacatgcaatataatactttttataaacttaggaggttcttctgcaagaggttgagaaattaccaagacaagaatattgcttggatgataataataatagtagtagtaattagcatttattaagtgcttactgtgtaacaggcagtattcaaagcatcttatattaactcattgaatcatcaccataggcctgtgcaatagaagtacaattatcactcctattttctaagtgaggacaccaacacaaagcaagatgaggtaaattgctcaggtatacacaggtagtaagttgatagagccagatttcaaatctaagttgtctgactccagagactgcttttaaataatagggaatgtacaaattgaagacaatgaaattatgaaaaatacatgctttaccactaaggtaatttaaaaattattaggtaaatatttacagaacacctatttttgtagcaggcccttgcaagaaatacagtgaggcttaaaatgtgcccttttcttcactggaactcagatgagtaggagagctgtggcatgtacaaaggacaccacaaaacagggataagtgtgggcaaaaagtgctttgaaagttctgaataggtctggcttcataagagaagagattcagggtaagctttagtggaagagtttccatttgaggtaagtttataaattgggacaactttttaattgtattttgtttccccaacaattggcctaatgcctggaacatagtagctactcaatactcactttgtaaacaagtgggtaaattaaggatctcaactgatagaaatggggaggactttttagatagagtgtggagtaggcataaagactcaggatgaaacatgttaaaaatcagtaaggagcaaaaaatggtgtaacttgtctagaaacagtaatctttgaaagttaatctttccaggaggtaagagtgggaggataatctaggactaggtgagaagagcctggagattggattgtattatatttactctgtgggcagtgtaaattgagattatttaaaattcaagtaattcattttgtagggggaataacctttgttatttgaatataacaagaatacttttatcaatctgtttttcactatatacatttttttaaatttttattcttaagaaaatgaatccccccaagtaataattctatcggcagctgagatattagggtcagctaaggcattggggtcacaaatgaaatggtcttggttccctagaccagtggtccccaacctttttggcaccagggccagtttcgtggaagacactttttccacagacatgagggaggaatggttttgggatgacatcaggcattagttagattcacataaggagcttgcagcctagatccttcacatgcacagttcacaataaggttcgagctcctagaagaatctagtgccgcagcagatctcacagagatctcgctggtaatgcttgcttacctcctgctgtgtggccccatctctaacaggccccaaccggtaccgggtctgcaacctggaggttggggaccccttccctacacaactgtgttgatgatcaaaagctcattctcattgtcctaatcctccaaacttcccattggtgccgtagcatagtatttccccccatctcaggtgtatttccaaaagatagtgtattcaaccacagggctctttttttttttttttttttttttttttttttttttttagaattcagagtaagtggtttaaaaccatgtactttgaaataagtgatactaagaaaaataaaccataaatttgtgttgtttaacggttgaaagaagaattattgttggttgttattatatcaggtgttggacaattttgaattaaatgattaaatgatactgttttatgaaggccccactcccctatataaatcaggaaacagaaaagttaaattttgtaacattaacatttttcaaacttagttacttatttaacagtttaactggaattgaccaccatgaactgattttactttctcatagattccaaatgtgttacagatttctttctagtatgtaaatatattacactcgtatatattaatagtacagtaagaataaaatgctttaataggtgatgttttattttagcatattctgtgagatagaggaaataataatatttatattgtatggatgaaaacactgggattaaaggagattaaactgatttattaatatcctattgtagtgcagagtttgaagtaagaaggctcaggacttggtaataacatggtaatattgggtgggatatgtgataccaaggcacaagctgatagaattttgcccaagaggctgcataggataacattcattgccttggttaatttatatagtacagaatctggccttcgacttgtaggttcagaagtctgatttttttttcccctgtcaactgagacgagctacctcagaagtgaactcagatttttcaaagttaacgaggctaattttttttgtttgttttgagacagagtctcgctctgtctcccaggctggagtgcaatggtgagatctcagctcactgcaacctctgccctctgggttcatgtgattctcctgcctcagcctcctgagtagctgggatcacgggcgcccagccccacgcccagctagtttttttatttttagtagagacagggtttcaccatgaggctaatgtttaaagcttgaataagattattaatttacaatgagaaatcattatcacagagacctaaatatttcaagttcattggattttatattatttccatgggcaaatgaattttaaaagccacataataattagaaagttatttagtgaccatgagattaaaaggttttagaggaatcagatgttcaggggcattaggctgagataacctgatctatctatctcacagtaggaatggtcatgcctatagatgggaattcttaaatgctgtttgctgcaacccctgacatttctttctacatttggtaatgttttttctagagcaaccaaaattctcaaaggctgtacttgaatgggcactgccaacatttccctctgaggcttttctttttctcagccttgacatttcttctttagttatgttcattcattcattcattcattcattcaaggcacctttaagtcctgtttgcctgggactcctgtctctttaaaatgattttacttacctacttatgtcctgatccattctgtagatttcatgtatttatttgtttttgagactatagccctctattacttacagaggcaagtaagttactgaagcaaaactttgacctagggcctctgcttgactttgtcatgctgaagtaatcaccataacagatatgccttggcctgtgtctgggcgtagccctatctccattccaaaatagaatcccaaataagaactgggggagagtatctgctttgctttgaaaattctgtttaaaccaaaagtcctaggaccaagttgttatgccataaatggtatagttgtcttagatgtcacttgaggttcagccttttaagcattgcatatctctaaatttctgactgacttaagagcccaggactgaagttaagacagaccgttaggagtctgtttttgttgtttttctttttccatagcccttgcccatgacacacattgaagtcaccagaatacatgtgaggaacttttatttatttttatctttctgaatgtgtctagagtatatgcagtactttagctatagagaatactaaatatttagaatgttgatcagttaataagaaaaatgaaaatgtaacagtttggagacatctaaaatcagactgggtttttaaactaaaaattttaatcacagaaatgttaagagaaatttcttctaagaaggccaaaactactgtagtgtttgctcacaagtagtgttggttacacgagttctaagtgtcattattgtggaaaaaattgaggggcaggaccaacatttactttttgtagaattttttaaaagagaaacttctgtcagtcttttggtaatgagatgaagcagtataatttgccagaagctaaaaatgccattcttacattttcattttttttcctaaaggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaatgaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgaccatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacaggtatgtttacttcttcatatatggtaaagcacaatgaaaaaaatgtacatttcacactaaggtttcaccttcatagaacataagttcatatccttacaagagaatgaaaatgaaccctctgatgtaattttaacttgagcctatcatttatttatcatttaagtacttttttttttaaaccattgttgcctttctttcagttaatctatcttgtatattctgctcaggaaataaaacactaatggattcagattttctttggaaagacaagagtttgtataactttatggagaatctcagcattagaaaagttattaatttcattttgtaatttttgttataatctcaaagattggtttcagcgtttttatttcatagtgatgttttcaagtctctacaactgaaaatgaactcctaagctttttaatagtctctatagttgttaggtggttatgaaattatattttcctgggagaaaaaaaaacctttgatttaagtcctagagttttttcagagtctttattatacctgaaggggaaaaaacagtattaactctaaatatagttaaagaattatatgtatataataatagatcactcctgataatttatatttgccagatactgatattaaaataacaggaaaattctgctatctacaatgtaatggtgctaactaaagttttatgtgtttcttcatttttctaacatatttattgactctcttggcaagtacgaatatagtggccaacaagagagaggtttctggtctcaaagagcatatattttagtgagggaggcagatgataaatgaaacaagtaggatagtgagaaatagtgataaattctctgaagaaataaaacaggataatgtgatagggaatgatggaattatttctgagggctctgttctgttccattggtctatatctctgttttggtaccagtaccatgctgttttggttactgtagccttgtagtatagtttgaagtcaggtagcgtgatgcctccagctttgttctcttggcttaggattgacttggcaatgtgggctcttttttggttccttatgaactttaaagtagttttttccaattctgtgaagaaagtcatttctgtgaagaaagtcattcctgatgggaatggcattgaatctataaattaccttgggcagtatggccattttcacaatattgattcttcctatccatgagcatggaatgttcttccatttgtttgtatcctcttttatttcgttgagcagtcgtttgtagttctccttgaagaggcccttcatatcccttgtaagttggattcctaggtattttattctcattgaagcaattgtgaatgggagttcactcatgatttggctctctgttcgtctgttgttggtgtataagaatgcttgtgatttttgcacattgattttgtatcctgagactttgctgaagttgcttatcagcttaaggagattttgggctgagacgatggggttttctagatatacaatcacgtcatctgcaaacagggacaatttgacttcctcttttcctaattgaataccctttatttctttctcctgcctgatttccctggccagaacttccaacactatgttgaataggagtggtgagagagggcatccctgtcttgtgccagttttcaaagggaatgcttccggtttttgtccattcagtatgatattggctgtgggtttgtcataaatagctcttactattttgagatatgccccatcagtacctaatttattgagagtttttagcatgaagtgctgttgaattttgtccaaggccttttctgcatctattgagataatcatgtggtttttgtctttggttctgtttatatgctggattacacttactgatttgcgtatgttgaaccagccttgcatcccagggatgaagcccacttgatcatggtggatgagctttctgatgtgctgctgcatttggtttgccagtattttattgaggatttttgcatcgatgttcatcaggatattgggaatgttggagagggtagtaacaacattaaatatggtggtcaggaaacatctctaggaggaattgacatttgagctgaaatctgaatgacattgaaattagagcaattgtaaagacacgggtaagtttaaagaacagaatgaaggcttgtgtagttgagtttgagagagcgggagagtggaagaagagtttgaaggaggaagagaccagaccttggagaatcttgcagactttggaagccattggaaagttttctctttttattcctaaatatatcatatttatgatcttatatcaaatgtcgagatattttatatttatgatttatatcaaatgtagagatattttatatatttacttgcctaaatagagtcaagaaattcgaattgcttaacgatttttttgtttgtttgtttttgagaccgagtctcactctgtcacccgggctggagtgcagtggcgtgatctcagctcactacaacctccgcctcccgggttcaatcaattctcctgcctcagcctcctgagtagctgggattacaggcatgcaccaccaccacgcctgggtaatttttgtatttttagtagagacaaggtttcaccatgttggccagtttggtctcaaactcctgaccttaggtgatccaacagcctcggcctcccaaagtgctgggattacaggcgtgagccaccatgcctggccaaattgcttaactgttaatgttctgttaaatgtctggaattgttttcaaaaccaaaatgtatggcagttacttgtgaaaatgtcacacatcttttaaaattttttaggaagcatttttgggagaagacctgaatttgaccctcagatggtcaaattttcttattaggaattctaattttctttttctttttcttttttttttgagacaggctctcactgccgtccaggctagagtctcatggcgcaatcacagcatcctgcagccttgacctcctggactcaggtgatcctctcacctcagcctcctgagtagctagtattacaggcatgcaccacacacccagctaggtttttgtattttttgtagagacagggatttgccatgttgcccaggctggtctcaaacttctgggcttaaatgatcttcttgccttggcctcctgaaatgctgggattacaggcatgagtctttgtcaccagccagaattctattttctgtactaaagagatactaaaaagatacttttgatggcattcagattccctctatttgacattgactacataaagtaaagcctgtaaacttcctgcccgttcatcattaccaagacaaacctttattgatgggaagggaagttcacagaagaaatcgagcagtgacttacacaatagtaacacctaagagcagcctaaatatgcttgaaataatgtggatgccacacagatatctctaatacacttaggtagtttgggcagaaggagaaaaataaaaacatcatagaagtcttttcagtgttgggatgcaaggaagaaggaagagtggcaggaattttttagatactgattaattattgatgctgggagaggtcatagattgaagtgtatgtgtttaaaattgaagatgattattagaatcaaaagagataccggagcttagaaactacaggaggaaccactagaatatcagctccttgagaacagggacccagtctcctgtatctctaatgcctagaataatgtctgacacatgataggcagttaataatttttttaaatgaatgaatgaattcatgaataaaagggggggaataaataaagcccacttaccaagaaccaacagtgaaatagcacaggccttcatgttagagtcaggaagaagatcagaatagcttttgtcacttgcttttctattgtgtaggtcctaaccattgcaaagacaaaaagatatatggtatgaatggagaaaaagatacttaattgtcataattcccatgtataattaaattaaaaattaagcatgagaactgaaattctttttttttttttttttttttttttttttgagacagagtctcactctgtcacccaggctagagtggatctcagctcactacaaactcagcctatcaagtaggtgggattacaggtggcctccgccatgcctggcaaatttttgtatttttagtagagatggggtttcaccatgttggccaggctggtcttgaactcctgacctcaagtgatttatatctttaatgtaaaataaatatgaataaaacaatgtaaataaaattataacactttaatgaaggataggaggcttgaataaatgaaaagtctcatttctgagtgggaaaatttgaatatcgtaaaaacccaggttatctctagattaatctgtaatccttatgtagttccattccaactcacaatgaaaagttactgaagttcaacttagtaattggtttatagtttatctggagaagaaatgcacaagaagagtcaataatatttttgaaaaacgcagaatagtaattggtgtatagtttatctggaagaagaaatgcacaagaacagtcaagaatatttttgaaaaatgcagaatgcatttaacatgatgtgttgaacaatgtttagccttaaatatattgattttataaatattgaaaacaagttaagctgttagttctagaggctagaatatcagagcatgtagacttaagaaaagtaaaaagaaggaaataataaagttaagaacaaaataagcaaagttagaataaccaaaacaggaggaaaagttttcaaggattttgaaagtttattatttgaaaacactagtggctggccgtggtggctcacacctgtaatcccagcactttgggaggccgaggtggacagatcacaaggtcaggagttcaagattgacctgatcaacatggtgaaaccccgtctctaccaaaaataaaaaattagccgggcatgggggcgcgtgcctgtaatcctagctactcaggaggctgaggcaggagaattgattgaacccgggaggcagaggttgcagtgagccgagatcgcgccactgcactccagcctaggcgacagaaaaaaagaaaagaaaagaaaacactaaaagtattagactttcaagaatatgggccagcgggcgtggtggctcatgcctgtaatcccagcactttggtaggccgaggtgggtggatcacgaggccaggagatcgagaccatcctggctaacacagtgaaaccccatctctactaaaaatacaaaaaatcagctaggcatggtggcatgcgcctgtaattccagctactcatgggggctgaggcaggagaatcccttgaacccaggaggtggagaatgcagtgagccaagatcgcatcactgcactccagcctgggtgacaaagtgagactctatctcaaaaaacaaagaatatgggccaggcgcggtggctcacacctgtaatcccagcactttgggaggccgaggcaggcagatcacgaggtcaggagatcaagaccatcctggccaacatggtgaaaccctgtctctactaaaaatatgaaaaattagctgggcatggtagcgtgcacctgtagtctcagctactctggaggctgaggcaggagaatagcttgaaccctggaggtggagtttgcagtgagctgaaatcacaccactgcactccagcctggcaacagagcgagactccatttaaaaaaaaaaaaaaaaagaaaatgatcgggaaaaaaagacataaaccaaatgaggcttgatgcagttgctcacacctataatcccagtgcttcggatggctgagacaggaggagtgcttgagcccaggagttcaagaccaacctgggcaatatagcaagatgcctgtctccacaaaaaattaaaaaatcagccagatgtctgcagtgagctatgattgcaccattgtacttcagcctgggtgacagagtgagaccctgtctctaaaacaaactaacaaaatcaaatgaatgaaaatcaaaacctacgtatagataccaaagagattcataaaagtcataaaagaatactataaataaacatccatcaacaaatttgaaaatagacataaactgatggttttctggaagaatataaactaccagaatcaactcaaatagaaatataaaacctgaataagccaataacaattaaagaatttgaaatcatagagattttccctctctcctctcctccaaccagaaatattagactgagaccatttcacaaatgggtcttaccaactctcaacgaatatataattgcttaataaaataggattaaagggagagaactagggggaagaaaagaaggaaagaagaaaggtaagctagacaaaagaaaaacccagttatctaatgagactggtacaatattgatacgaagacctgataagaacactacaaacaaataaaattatagatgaatcttacttatgagtggctgtagaaatcttaaataaaatattagcaaattattctaagaatggaagaatagttcaacatctgaaaaatccattaatgtaaacttcacattcatagatagcaggaaaaaaaatccatatgataaattttattttttattttgttttgtttttgagatgaggtcttgctctgtcacccaggctggagtgcagtcagacaatcacatttcactatggctgcaacctcccaggctcaagtgatcctcccaattcagcctcccaagtagctgggaccacaacaggcacatagcaccatgcctagctaagattttttaaaacatttttttacagacaggaggatctcgctgtgttgcccaggctggtcttaaatgtaggggattggtcagggtggtgggagataaagataaagttataggaaatagacacaaaccttcttgggaggccgggaggtttgcatagcttcagtgaaagatttggttgaaggcagctgaattctcttaaaagcttagggcttagctacataggaatataagggagtttatctaaagagcttgtttactcatgtggtcctaagaccaacctttgatcattcgcaggactgctctctggggagggtgaccagataattacccacaagtgtgttgactcaaagcctttgtcattaaatctatgctgaataaatgcccgcagggccagctagtcagggcgtgcactactgcaattcttttttgtgagcggcccagccccctagccactctttcactgaatactggtgtctgagtacgttattcatctgttatgcagcctgactctgcaggtcaaaccctggcacttaaactcctgggctcaagcagttattccacattggcttcccaaagtgctgggattacaggagtgagccatcatgcctggccttattttatttttttagagacaagtttttactcttgccaggctggagtacagtggcatgattatagctcactgcaaccttgaactcctggactcaggcaatctcctcatctcagcctcctaagtagctgggactacaggcacatattaccactcctggctaatttattattatttttttagagatggggtctttctgttgcccaggctggtcttgaattcctagactcaagcaatactcctacctgaacctcctgagcagctgggattataagtacaagttactgtgtccagcccatatagtcattttaatacatattggaaaagaatccataaaaaactaataactcataattttttttcaatggagaaaatccagaatagaagggaaatttcttaaccgcagtaattgttttcattaaaacatttagcagataacatttctaatagtgaaatttagaagcattcccattaatatcaagtatagaataaaatgtgatagaagcattcccattaaaatccagtatagaatcaagtataggatacccactttcaacatcactatttcaacattgctttgtagttcctagccaatgcaatttgacaagaataagaaatgagataaagaatatgaaaacttatttatgaataacaaaataaaccctacataagatgctttgaacttttgtcaagaaaattataaaacactgaagcatgtaaagacctcactatatgccaatatgtaccgtattcatagtggaaagatgtaaagaaaaatgtcagttctctccaaattaatctcagtattcagtgtacttccagtcataattacaaggaaatttttcatggatcttgaaaaactgattgtaaaattgatatagacaagtaaatactcaagaataatcaagagaaccctagaaaaatgtattgcatctgacagcaagatttactacaaaatcataatagacagtatggtttgatgctaggatggacaattaggtcagtggagcgtaatggaaagcccagaaacacattgagatccttgtgaaattttaatatataggaaagagaccctacaaatcaacatttatttaataatactgagtgagcctctactgcattctatgcactgttttagtccctggtgacataacagtgaataaaagcaagtagtaggcagggtgcggtggctcatacctgtaatcccagcactttgggaggattgcatgagcccaggagtttcaggccagcctgggcaacagagtgagaccccatctttacctaaaaataaaaagttagctgggcatggtggcatgcaccagtagtcctaactacttgggaagctgaggtgggaggatcgcttgaacccaggaggtcaaggctgcagcgagccatgattgcaccactgtactccagcctgggtgacagagtgagtatttgttaatttgggttgtgagtacataaatgtttattacttcattatttccatgtctgtacgtttaaaatcttttagaacaaaaaatcaaagatgagtcatgctagctataccaaatatcacaatttagtataaaactgaggtaatgaaaacattgtgctactttccttgaaaaagaaaggtagatcaatgcaacagcacgaagatagaaaaaaaattagacttcagttctcatgaatttttaaactcttgtagtcagtatatgcaaaaaaaagaagttaaattatttgatttgtcatttaagaatattataatgtttacatatgtttactttaagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtaaaatggtttctgacttataagtaccatgatccaaataagtattggatagagcccaccattctataattttttccttgtcatagaacccacagaggaaggtgatttgtttaccagttgttgatataatcactagacattcatttaagtgcttgagaaagctaaaatcattttcccataggaagtcacaatccattgcgaaagcatatataaaataaacaatttctccaacagaagaatgaatagaaagaatgggaggagaaaggagaaacatctagtacttcctggcaggatgagtagggtgaggtggtagacagtggtggggttggaattttttttttttttttttttttttttttttttttttgagacggagtctcgctctgtcgcccaggctggagtgcagtggcgggatctcggctcactgcaagctccacctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccggggttggaattttaaggcaggctctggagtctttagaattgaggtgtaagggtacacccattttggaaaattgagagttcaaggtgtgtgagaaagtagttggggttatagctggagagattggcaacagtttgattagaaaaagttttattctgaaagaagcatatataagccttatgctgttggtgataagacctactgcaggattttaagtagagtaacacaatatggtttttattttatgatgacaccactgcggtgagttgggggaggtaagagtagtgattagaacaccagttaagcaactaaagctgtcctttccataaacagtaagtattaactaaatgttaatgaggatggaaaagaagtttgcattcaaaagtagaaatttgagagtggcttaaataacagtaccaaacttttaaatttcaggagtgctttgggtttgaatttaataagattttaagcatgtgatatttttaatgatgtcctcttcaaacaggctagtgtttttcaaactagaggctaatgaataggtccattaatgggtggtgaagtcagtttagtgagtaatgatcaacatttttaaaaaaaaaaacaaagtagaacagaagacattggagtacatggcactacagtagaagaataaatattgatttctgagatttttatttcagttttacatagatgtatgtaataggttatgatatatgatgcatttttttgtgttgggttgtagtaaaaagaagtcactgctttgtaccattttgtggatagaaatggaaaatctcacaaagtttctgagacaatgttgagcaatggaaaataactcaaagaaataaagaatttaaaatgattcttattgcaggggagcttccagttgaaacataagttaaatatgatcatagttcttaagtatgtaaattgaatttcttaatccattatctgttctattaggtgatgaaggaaagcctttacatctgctcattggaaaacttcaaaaggcagtgtctgaagaatgttcttattttttacaggtaaaatgtttaaaagtacttttatggccagatgtggtggctgacacttataatcccagcactttgggaggctgaggtggtcagatcacttgagttcgagaccagcctggccaacgtggtgaaaccccgtctctaccaaaaaatacaaaaatcagtccggcattgtggtgtgtgcctatagtcccagctacttgggagactgaggcattggaattgcttgggcatgggaggcagaggttgcagtgagtggagatcatgctactgcactccagcctgggtaacagagtgggactctgtctcaaaaaaataataataaattttaaaaaataaataaaaggtacttttacacaaggagtgctaaattgtaagttgctactaatttaatgatcacccagcctagttttcttcactaccttcagaactgtgcctagaaagtattcctgagtttttaacttaaaatgagcattaaaaattttcctgataatcggtttgaaacaaaagaaattcaggtaaattatctcgcctgtagaacagacactaattgttgatgttgccatagatgagttataaggacaagatggagacatcctgggagacggtgtagagtgagccaaaacactaagatggcacccatctttctgggtcccagtttctttgtctgtaaattgggtgattgtttaaggtttctaaaatcaactctaatgtgagaaaactgcatcttaggggctatgctgaaaatttaataaacttaattattaattgacagtatagtttaagcaaatctcaagaaatctgaagaaatagcaataaacaatttgatttttaagtctagaagttggtggtggtaattttttagttatatgaggaacaaaggtaaaagttatttgagagcttatcaaatgataatgggacatgtattgttttaaatgatgatagaagtgtctgttgctcaggagaagaaccggaacaacgcgtcaaatattttcaatttttgtgtgtgcatataaactacataaaactattctcatgtgttaggaattttttttttttttttttgagacagtcttgctctgtcgcccaggctggagtgcagtggcacaatctcggttcactgtgacctctgcctcctaggttcaagctattcttgtacctcacctcccgagtagctgggatgacagatgcacaccaccacgcccagctaatttttgtatttttagtagagatggggttttgccatgttggccaggctggtcttgaactcctgacctcaggtgatccaccttcctcgacctcccaaagtgctgggattacaggcatgagccaccacgcctggcctcttgtgttatgaatgttaagtatatgaatgttactcttttgcttgatatgatttctttagaatttatagatttctttctgatcagcatttctgaacgtccatccttgtcctgtgatgttttttcaaaggtatttgagattacagagataacatcagaaataggatccaagctaggaagtggttgattaaagtataagataaattttattattataaggaagcagaaaaaattatagttttgtgcaatgaagtttattatcttcctgatataagaagatttcatgccagagagatagatttagacttgtttcttttgcagattgataagggtatggagagaatgttttcttaattatttttgtgtgccattttgaccgccttgcatctaggagaattatgtttaatctttagaagcagaaatcaaaatttaaattccttaaaatacacaattttgttgttaacagactttatgcagtgtccttggtgaatattatactcctgctttaaaatgtgaagtaaatgcagaagacaaagagaattctggtgattacatttctgaaaatgaagatccagaattacaagattatagatatgaagttcaaggtaataaaagcttaccatactattaaacagtatttaatcctcttaaattaattgatgacagatttttacttttgattatgatttaatcacccagccaagttgtttttcatcttaacattttatcctcctttcagattcatgaaatctcatatttaatacacattttaaatttttataatgcgataatggtgatatgaatataattggagctgtccactattgtctgtcctctgtctctctactcctatctttttccttatcctaattcttttaactttttataccatagatccaaatttttaaagttattgtatttattgaataagttcatatcaatggtttttgctttaaaatgagtaagataaacattaagaaataaaaaatatattagtatctttcttaatatagatctgctataagtttgttttaacaaatagtaacatcaccacttttttgatgttctttcacagagaaaatgtttcctagccctgtccatttgtataatgaacaaaatgtatataaattaatgactaccaaaagaaattaacatattttaatatgaaattttcaagttatctttgtagcaggcatttcacatgaatgagatttcaattttcagttactaaatatctgaggtttacttctagcaggcaatttttttaagttataaataggtgaataatatttattgaaagatgcagacttttactgtgaagtgaaattattgtaattgtttgtttaccatccagactttcaagaaaatatgcacactcttctcaacaaagtaacagaagaatacaacaaactcttggtacttcaaacacgactaagcaaggtctgtgagatggaaaatatattgtaatatttgcatttattgtattgtctgcttttttgtaagctgcttttatcaaccaagaatttctaaagtaagagaacatgaaaaaggagattgggaaaagtgacatatatttgtagtagataatttatattggtaagctgaaagaatttctgcaagtcgaataataacccctttagagagtttttagaattatgataagttaaaatatatatatcaacttgtaaactgtgtgaaacaattgcatttaattttacatataatgtaaaattaaagcagtgggccttctgttttagagaaaactggtaatgagtttagttgcttagcatatagctaattagtttcacacagcattatacatgtcaattttattttcaagcaattttttaaaagtctgtagaaaactaggtaagatagtatacatggcacagtgtaatttattaactcttatcagtaaaacaacttaaggcacatattggcaaggataagtgtaattctcatgtagaaggaaatccagaaagatgtctgtgtctatttatttggggtgctttttgatgttcagttaatattaaaatgtttaggcagatttgaaagatttaattgatagtgaaagttataatgttgatgatttatgttttggctgaaattcttcctctccatctctctccccttctttctttccctcctgtttcttcttgcctactctgtttctgtgcaattaagtacaaccttatctagcctttccaaaaatctataaacctactccagtagatttatatgagtagaatctcttttggtttcatctcttattttcttgttcattatggatttatgccttttaaatattctttatcattttaattgagtaatggaaagggaggaggtttatgtcagtaatcacaaatgtaaatgcctacattaacttagctaataaaataaatgaagaaggccaagtgaaacctggagaaaacatgcctcatccaaaaggagcggcggctgcccagcttgtgcatcgtgttgccattaagtaggaatcagggcccagtgttgctagtacttttaatctattaattttatatgatttttttttcttttaaaaatattaggaagtataaaccaggcatggtggtacatgcctgtcgtcccagctacttgagaagctgaggtgggaggatcacttgaacctaggagtttgaggctgcatgagctatgattgtgccactgtactcctgcctgggcaacagagctcaagacctcatttctaaaaatataacacacacacacacacacacacacacacacacacacacacacacacagagaaatattcaaaactaaatgttctgttttaaggttgggaaacagaaagcagccagacaacaacaaaaactgttttgtccccaaaagagcacttttatagactggatttaaagttcaagccttcactttgtaacctcagatataaacacatgctcagtgtactatcttgaactagttttctttttactttattatttctcgactgtagtatttgctgctttctgataacattttcttcccttagcttctgtagcttttcaagcctccattttggactttacctaccctgtttatattaccagggatctttatttgatcctcgtaatctgaatgcttttttcatctactttcattgcttctagatctctatgtttaggtcagtccttctgagctgcagagtcatatatctcatcagatatctctactcaaaaatcttttaggtatatctcaatcagcatattgaaatttgaatttattaactactgctgcttaaaccagcttctcctctcatatcagtttcaaaggaacaacattcaaccagaaacttggggattgtcttagatagtcttctcttttcactcctggtcttctaccatactgaaatatacactgaagggagtacaaagaatatgaaagaaaaatttatactttgttctcattcagttatacagtcaacaatttttatttttattttactttcctttttttttttctccaagacagagtcttactctgttgcccaggctggagtacagtggcgtgatctcggctcactgcaacctctgcctcccaggttcaagcgattctcctgcctcagcctcctgagtagctgggattacaggcacactccaccacacccggctaatttttgtattcttaatagagaagggctttcaccatgttgaccaggctggtctcgaactcttgaccttgtgatccgcccaccttggcctccctaagtgctgggattacaggcatgagccaccacacccgacctacttatttatttatttatttatttattccttagatctgaggacagactggtcagccaatatttattatttgctaattaaatgccaggttgttctgtgtactgagaataaagtaatgaagtcactagactgaagaaatgtgtaaattaatgggatttatgaactagtttaaggaatgtcatatacatatatactattttacatatatatatataatatatacatatgcatatataaaatagttttccttggcaacattttagtaggtgtttagaagagaaatgtaaggccgggcatggtggctcatacctgcaatcccagcactttagttggccaaggtgggccgatcacctgaggtcaggatttggagaccagcctggccaacatggtgaaaccccatctctactaaaaaaaaatacaaaaaaattagctgggtgtggtgacacgggcctataatcccagctactctggaggctgatgcaagagaattgcttgaacccagaaggtggaggttgcagtgagccaagattgcaccactgcactccagcctgggcaacagagtgagactccatctcaaaaaaaaaaatagaaaagaaatgtagataaatacgtttacttaacaggtagatgaatacagcaaacaggtagatgtcttttctgcacaaggggtaataagaggatatatatttgaatgcagtaaattagctgcaattacagaggcatttcagagttactttgggatcaggatcaggactgcaatacatcactgtgtaaccttttggcttcatcttctaatattcctcctcatttcagccatactgaaatacttagtttcccaaatgcaccctgatctttggcaccctgggcttctttgcatgctgccctttctgcataatactgcccatcccctcccagcctttttggtttgttcctgcttgttccagttggttcaaatgtttactccctctgtgtcatcttctttacctgtctttctaggcttaggcatttcttcctctgttcccttagcaacagtacaggccttgcttatcgcgtttctcttttttcgttactttaaatacttgattacccttctgtccttcttccatgttcctgtagctccttatacacatttgcatttgtatcacattacttttcatgttatataattgtttaccattctgcctctttcactattattctaaacccttcagaataagagaatcttctgtttatttttatttccttctcttaacacagtgttagcatacagtaaaggcttaataaatgtttgctgaatgagttagaaaggttggactggaaacttaataatttacctgatgatctttattttccctgggaactaagaggcaagatcctctgttgaaattactcatggggtaggaattgggtagaggatgtataagagtagtgaacagttaaaacagccttcttagcaaatagctgttttttcttttgctcagctgcttctacagtatcctttgttcatctggtcttgcaagtccatagtctttccccttgcttttaaagtcttctgttatttggatctatcttatttaactagctttatttccccctccgtatccaaattaaaccctcctcaagaagatcattgtcaattatggcatacgtcattctttcacaaatactcttactctttcttccttatagccttcccaaatcattaccagaaatatatgagcctaaatcaaaactgacttccataattactcagatccacatcagtcttctgtatcattgttgttatagtcaaattttatagtttagccgttctctaattgtttattttcccatctgattgatgaattctgtgcaggcagatatattgttattttttaaacggattttatatttttactcttgtcacagtgctggtcacattgattattaagtatttgatgaataaataaattagtacacacaggtatctgacatattgctgcttagttttatgtatttatttatttacttatttttttgaggcagagtcttgctctgtctcccaggctagagtgcaatggctcaatcttggctcactgcaacttccccttcccaggttcaagaaattcacccgcctcagcccctcaagtaactgggattacaggtgtgtgccaccacacctggctaatttttgtatttttagtagagatggggtttcactatgttggccaggctgatcctgaactcctgaccttaggtgatccagccatctcagcctcccacagtgctaggattacaggcttgctgctttttaatagttaaggaaataagctgagatttatctattttcattattttcttttctttttgtttactgtacagagcaccataccatttgtcagttacctggttgtacataggatatatctagagataaacaagctgtattaatcaagtattgctaatataaaatttattatgtatgaattgaaatttcaaagaccaaggtatactataaatattgttatcagctttctaccaaaattctcagaagcacttgtttttgtagtaaaatgaacttcctttcagatatcaaagaacattactaatataatttcagtgctatgaaaggtatggaatattaattactgttacagaagagaacagggaataacttagaagggaaaatgcttgtattagagtgccacaattttgggtggttttaaaaaagcatcttaaatgcagagttgctttaatacagctttctaattgctggattatgtatttatgttactgcttttattctgtggttttcaatagatctggggacagcagacagatggtatgaaacttgaatttggagaagaaaaccttccaaaagaggaaacagagtttttatcaatccattctcagatgaccaatttggaagacattggtaaattttgatcatataccacaatgtggtgtttttatagcaaatattgagtaatttgcttttttactttaaaatgtgagctaacgtagtgacctttggcatttcactgtagcctctctgatctcaattttttcatccttaaaatgaaagatttggactactttctatttggtcctttcccccttcttatgttctgtgattctgaattgttttaaattttaaagatataaaattttggatttaggagtactacagcatgaggatcaaaaagatgatcttgaattgtactatttatgttttcttgttttcatcagaatgagtttaaattgaaaccagagttattaccactaaaaacatactttttcaaaaaagaattaatattttctgtacacagtgattgtgctatttcactaagaaacttatattgaaatgtgcattttttgtctctttatataacatagatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaaggtattcatctgcttatagcttcattcaacagtatttgtagctttgtaacaattatagtatcatccagaatggttatttaaaaaagtaacttaagcaaagttgctggaaagagataggatgtagcattttttagaaagaagagcaagagatcattctatatctttgaaatgcctgaaaaaaatgttgatgtaaaccaaagacattataggaattttacttaaatttttacattataaagatgttggttgttgttaatctgcttaattaaatcggcagtgtgcacatatttgcagtttattctgtacctagtctttgctactttgatatggtgaatacttaaggaatataaggtaggatcattccagtcatggcagggtttcctccactttgttgtctcatgttcaaattcaccacgtccaaagtagaactctggctcttctcaaaatttgctccttctgcagctatatccatctgtcgttactcctctttctcttatacctctcttctagtctatcaagacgtcctattttctccaccttcaaaaatatatccaaactgtaccactccttaaaaccttgctggtctctgccatccttttgtctcaactggattaccctaactcccccctaaagtctgttctcaacacagttaaagcaggtgccagaatcttgcttttaaaatttaaaatagattgtatcattccaaagctcttctgtcctacatgatgagtacccattacttttctgatttttaatctcctactgacttgtctgtcactgtcttctgaccccaagatactggtgacagcatcttggggtccttaaacaagcattatcagtatgcttctgctttagggacttctcattggctgttccttctacctagaatggtcttcctccagatacatgcctggccaacaccctcaccttctttggatcattactcaagtgtcatgttctcgtgaggcttttcttaaccattctgtgtaaattaaaattgtctcctagaatgctgattcctatttctctactttattttttctatattacttaatattgtctatttatatgtatgtatacattatgcacattttatataatatatatcatatatataactaggctggtcgtggtggctcatgcctgtaattccagcattttgggaagctgaggcaggcagattacctgaggttaggagttcgagaccagcctggccaatatggcaaacctccatctctactaaaaatataaaaattagccgggcatggtggcatgcacctgtaatcccagctactcaggaggctgaggcacgagaatcacttgaacataggaagcggaggttgcagtgagctgaatttgcaccactgcactccagcctggatgacagagcaagactctgcctaaaaaatatatatatattatgtgtgtgtgtatatatatatatattatatatataaccaaatatgtgtaaatttggagggggtagattcatttttattttgtttattgttcgtctctggtgaaagactttaagctttataagggtggggctctttttccatttaggtcagtgatatatcacaaacacctaagataattccctgcacataataggtactcaataaattatttgtttaatgaatgaacagtttataatttagttgggaagtatgctatagtatataactagctctataaaaccctcagagatttcttctaactgtggctggctctgctattgtagcgcggatgtcttcctagacacttgctagtaaaacctcaacacagtttttttgtatagtggacgaaatactgaatgtctgcttgtttggaactagtcgttactcttttttatttgaaacctacatatgggctttggaattatttgctttagccttataaagcttccattttctttgagattggtggtttctaaacatgaccatacatcagaaatagtggaggtttttgaactttaatataatttttttaattacttacaatgaaagatcactgaattataatttggagagtcatactcaatagctttgagatggaacttggaaatttgtgtttttaacaatataattcagaggcacggaacccatagattgacatttggaaaccactgctttctgatatgaaacaaaataggtaattaggaagaactttctaataaacagtatttcaagcagtcttcctttaattagtgatgctttctgtccaaagcatgaagaaaagagaggcttctggaaacataggcttacattgttattcctgcatttgggcttctgcaagctcaccaccctctctcagagtttctataatactccatggaaatgtgttgacaaggcctttgaatgaaaatcattcgtttgctccctgcacccctaccaaaaagagttttactcaccaccgtcctcattcttactaatagtaatgagtcaaaattattttgtgtaaatagcatcacatattttggacatgactgtaacacattttgaatagagtatactgttccctgtgggtagacttgaaatagttaagaaaaataattgaatcattcttttaacaaatatttggtgatttcatactagaaacctctaagagaaacactaaggttggaaagatcatgggttttagtcagacggatctgcatttgaccctgatttgaccttttactggctatatgatcttggacagattatttaaacatttctaaatagtaatagggataataataattacccttaagattgtgaggattaaatgaaacagtaactgagaagagccttagctagataccctggaggtagaattagatgtttatgtaaagtggctgtttccttccagggacttcagtgtaatcactgaaataataattacttgcaaaataatttttcgaaggtaatggttggggaatataacatagtgatataactaaaatgctggaatttaaacccatgtctttgtggcgtttttcactgcacatctgtaatactgcctattagagtaataacagcaaaatggaaatgaaggatgaatatttagacattgcaatggaaggaatgttggaaacaaagcagaggggaaaaaacaaagataactctgtgttgcttgagcctagggaatatggaaaatgaaggtacatcatataaataggaaaatcaacaggggttgcagatagtaggagcttaattgcaagaggggaacaatgaattaagtttacgccagactgtttttttcagtttggagtaataaacactttcaaatactgtaaagcttaaagaatgaagtcgctctccctctccctctccctctccctctcttctctcttctctctctttccacggtctccctctgttgccgaggctggactgtactgccgtgatctcggctcgctgcaacctccctgcctcgggctcccgtgattctcctgcctcggcctgcctagtgcctgggattgcagtcacgcgccgccacgcctgactggtttttgtgtttttggtggagatggggtttcgccatgttggctgggctggtctccagctcctgacctcgagtgatctgcccgcctcggcctcccgaggtgctgggattgcagacggagtctcgctcactcagtgctcaatgttgcccaggctggagtgcgtggcgtgatctcagctcgctacaacctccacctcccagccgcctgccttggcctcccaaagtgctgagattacagcctctgcccggccaccaccccgtctaggaagtgaggagcatctctgcctggccgcccatcatctgggatgtgaggagcccctctgcccggccgccccgtctgggaagtgaggagtgcctctgcccggccgccacgccgtctaggaagtgaggagcatctctgcctggccgcccatcgtctgggatgtggggagcgcctctgcccggccgccctgtctgggatgtggggagcgcctctgcccggccgcccattgtctgggatgtggggagcgcctctgcccggctgccctgtctgggatgtgaggagcgtctctgcccggccgccccgtctgggaggtgaggagcttctctgcccggctgccaccccatctaggaagtgaggagcatctctgcctggccgccccatctaggaagtgaggagcgcctctgcccagctgccccgtctgggaagtgaggagtgcctctgcccggctgccgcgtctgggaggtgagcgcctctgcccggctgcccatcgtctgggaagtgaggagcacttctgcccagccgccccgtctgggatgtgaggagcacctctgcccggccgccaccccgtctaggaagtgaggagcgcctctgcccggccgcctcgtctgggatgtgaggagcgcctctgcccggccgccctgtctggaaagtgaggagcgcctctgcccggccgccctgtctgggaagtgaggagagcctctgcccggccgcccatcgtctgggaggtgaggagcccctctgcccagccgcccttcgtctgggaggtgaggaacgcctctgcccggctgcaccgtctgggaggtgaggagcacctctgcccggctgccccgtctgggaagtgaggagcgcctctgcctggccgccccgtctgggatgtgaggagcgcctctgcctggccgccccgtctgggatgtgaggagcgcctctgcctggccgccccgtctgggatgtgaggagcgcctctgcctggccgctgtgcaatcttccaagtgtgaagtgacagcctttctgcaggtgtacccaacagctccgaagagacagcaaccattgagaacaggccataatgacgatggcggttttgttgaaaagaaaagggggaaatatggggaaaagaaagagagatcagattgttactgtgtctgtgtagaaagaagtagacataggagactccattttgttctgtactaagaaaaattcttctgccttgggatgctgttaatctataaccttacccccaaccccgtgctctctgaaacatgtgctgtgtcaactcagggttaaatggattaagggtggtgcaagatgtgctttgttaaacagatgcttgaagacagcatgctcgttaagagtcatcaccactccctaatctcaagtacccagggacacaaacactgcggaaggccgcagggtcctctgcctaggaaaaccagagacctttgttcacgtgtttatctgctgaccttctctccactattatcctatgaccctgccacatccccctctctgagaaacacccaagaatgatcaataaatactaaaaaaaaaaaaaaaaaaaaaaaaaaaagaatgaagtcattgtggactaagtagtactttttggagtttagatcataatgaccggatagataatcaggaggattttctaggctgtgaaagtaagatccaggacataaagccaaggatcagagcagtatatacaagggacaatgaggaaaacagagacaaaatagtaataaagaaaaagcaggaaagggcagagaagaaagacaagggaatgagtttttagaagcatgggatggtcatagaacatgagaaggcagttcacagcaggaaaaacctaaacggccaataacatttgaaagaaaatgtcttctcaaaaataaagacatacatgttctagcaaagttttacaattgttataacccccgattgctgaagttttaagaaaatacttaaatgatactattatgagaataaaattaataaaactttttggaatatgaccctgtattaaaacattaaatattaagcttaacaattacttataagattttattatgtagaaacatccatggaagtgtgccaagatatgtttgtggagatctgtattatagcattgtttgtaacagtgaacagttggaagtaatcaaatggccatcattaggggtttagttatataagttatgaaatgggatgatgacaactttggccaattttggacagaatttagggtagaaaagaataggagaaagaaggttatgtggacaagaggaaggtcaaactaagaaagcagcatagttacacatgaaaatgggtatggaaaattatatttgccagaaatgaaaattataatttgctccttttttttttcccatggatcctaaatgctgatcttaccttagtttttatgacctaagttaagcgttttaagaaaaaaaaaatttttaatcatgtaaaaactacacaatacagatgtgaataccaaaagataaaacaaaaaagtccgaaagtgaatatttgtaaattaagattcttctctttaccaccactgctcctgactgagttccactagaggtaaacattgttactttcgatgtgtatacataggaagataatcaaactttttgtatccaaatatacatatgtatgttaaaagaagtttctcataaaagtgagattttacaaacttttttaaagtcattaatatatcttagataactttaaaaaaaatgttagtactggccaagcacagtggctcatgcctgtaatcccagcacatttggaggctgaggcgggaggatcacttgaggccaggagtttgagatcaacctatgtaacgtagtgagaccccatctttccaaaaaaacagtcggtacttatggttccatatcatacatttgtagtgtaaaatgacataaaattcagttgatcacctggtaaaatactgttattcaattgtgttcttttaagtggaaatattagtcaaaaatatgatttaacttgcaatacctataaccctagactcatttttgtctcccatgccccagtacacattttatgtgtggtgtagattttgcatgaacactaaagcacatatacaactctaattctttaaccttttttatttatattcagcttacctgttgattcggtggtaattacagaatctgatgcacagagaacaatgtaccctggaagttgtgtgaaaaagaatattgatggtacaatagaggtattatatttttaatttttatcttttaactgttatatacactgatttttctatcatttttatgtctggtttactatctaataaatagttgctgagaagtaagcataataaatatgaggataatgccttatatagaaaactcagaatacacatgtaaagaaatttaatctatttttatagcataggtaacacacagaggaagttaagtttgggggttatatttcccttaaatatgttatagtttaagatttatcttgttttttgtaacatgtgggctatgtacaaattagtttcagtgccctggtcaacaaagctttgtcttcccagcatgggaagttggacaaggccatctctagaaaagtgtttaggggccaggtgtgatggctcatgcctgtaatcccagcacttcagaaggccgaggtgtgtggatcacgaggtcaggagatcaagaccagcctggctaacatggtgaaaccccatctctactaaaaatacaaaaaattagctgagcgtggtggcactcgcctgtagtcccagctgctcaggaggctgaggcaggagagtcgcttgaacctgggaggcagaggttgcagtgagctgcgattgcaccactgcactccagcctgggcgacagaacaagactgtcgccaaaaaaaaaaaaaaaaagggtttaggaatccccagaatccaagacaatagggctgggataatagaattaggcctattccaataaggtccgtatggtatataaaaaagttccacatcttttaaagtgcatgccatctaactaaaccaccccctgcctctgctcaacattgtattattctaaatttctcacacctgcaactttctcaaactggcaactgccaaaccctggtcttcactcagtagatttttagctcttaagtcttagaaaaaagtaagatcatcgttcttcctcgctcagtatacagaggaaagatgttagacacatccttgattctgctatactcatcccatgtcatgatgattggtaaataaagaaatactttcatactgagaacatatttatgttttttaaaagtttatggttttttctattgataaaagtaatttgtatttgtagaaagttagatagtattaataaataccaagaagaaaacaaaatttgcttgtaagtttatgagcaaagatagccactgtttaacattttacttaaaaggaaatctgtacacacatatatattttattagttatatttaagtatccttttcccactctagaactgtatgttggcatttataaatatgtaaacatatttctctttgcatctttaagttcacggtagtgagtataattatttggtagaattatttactagaattatttttaattgagagaattaaaatttattttttgctgaaagtatgtagaacttttctaaaaatactgatactttggggagattttgaggtagaagtttaaaaataagtggtgtataattaatgtaaataaatgtcatattttgcttttaaatgtagttttctggtgaatttggagtgaaagaggaaacaaatatcgttaagttgcttgaaaaacaataccaagaacaattagaagaagaagtagctaaggtaggcttatagcttatctggaagattatcttggtttatattccctttgagccttcaaaaagaacatagattttatcgatggtatgtactttataagtttcatatatagttcatctttaagtgattggataatatcaattatagttgcctttaaacaaaatatcttgtgaatttttatttgagaagagcattgttcttgatgtagactagtaattagaagcttttcagaatgccaaaacaagtctatgtatttgttgccttgtgaagaagtttggtcttccttaaaagttgggaagaagataggaaaagaaagagaaagtggttggtcctctgtatatattatctgtatctatttccaatcagagaagttttgttaggtaatgactacagatactaagggaggattatcactgagtattaattagctcctggctaagtgaaggagtttatcaatgtgagttttgctcatctctgtatgcttatccactgtgtccagagtcattctttaatattagccatataccctagtgtaacattatggttccatttgttttgtctttgtattccttttcaaaacgtgtatacctgattggcttttaatattggaactggccgggtgcagtggctcacgcctgtaatcccaccgctttgggaggccgaggcgggcaggtcacctgaggtcaggagtttgagaccagcttgaccaacgtggagaaaccctggctctactaaaaatacaaaattagccgggcgtggtgacgcatgtctgtaatcccagctgttcaggaggctgaggcaggagaattgcttgaacccgggaggcagaggttgtggtgagctgagatcgcaccattgtactccagcttggccaacaaaagcgaaactccgtctcaaaaaaaaaaaaaaaaagatatatgtatatatgaactattgaattatgagtttgctttttttgtataatatttcagctgtcttaatataacaatcccaatggaatatgtgcattttaaagggttaggattgattggtaggatataaaggaaatatataaggaattaggaaaaacataaattcgatgaggaagtcaagacctaaggaaatatctgggccataaggacttattcacttatgcctaaagtgaaaagtgaaacactatcattttttttttatagctttcaatgtctagttcttggaggaatgcaaattttctcttgcatgtagctcttacacaaatttatcaaatggaatggtgtatcagggtatagtaattaacatgaggtttggtattggatataccatcctttaaattcttgttcttttggtttactagatttgtgaccttaggaaagttacttaacttgtgaatctcagcgttttatatgttgaaagaggaaattggcttagtagcaatttttataaggattcaatgagctaatgcatatagaacacttagcaaatgagttgatacatagtaaagactcataaatactattttaaaagtagtcattactgtgataatggtggtaacatgatgatgttttataaagcattactcactcaagctgatagcagagcaccaaagtactggtcagtgatgtaacagacctgcacgttgtgcacatgtaccctaaaacttaaagtatttaaaaaaaaaagactcttctaaatgcagccaagatactgtggtccaagagattatgtttgatggcccagcttggtcctagaataatatagattgttgatattagtcaccagtaccgatgggattatgctgtactctgtacccctcagatatgatagaagaagactgagagccatttttcttttcttttcttttctttttttttttttttttttttgagacagggtctggctctgtcgcccaggctggagtacagtggcgcaatctctgctcaccgcaacctccaactcctgggctcaagccatcctcccacctgagcctcccaagtagctggtactacaggtgtgcaccaccaccccagctaatttttttgtagagacagggttttgccatgttggccaggctggtcttgaactcctgatctcaagcaatctactcaccttggcctaccaaagtgctggaatagcaggcgtgagccaccatgcctggctgagaatcatttttctaaaagcacaaggctatatagaagaagcccaatagtagtgatttccagtatatatcatattagagtcctcctgtgatttgagcacatactactgaaagtagacattcatttacatttcactgttaagcaatgttctgggtgctgaagtataacagagaataaaagaggatgaaatctttgtttccatagaccttacattccagttggtacagatagacaacatacagatgatgataagtactatgaagaaaaaaagcaggactaggaaaatccatggggagtgagatggtgttattttatatagggttgtcatggaaggcctgacttatgaagtgacattagaggaaaatcctaaaggaagtgagggagtgaatcaggaagatatcaggttgaggaccttttaaagaaatatgaaagggaaagtcaagagagcaagagaaaaagaaaggtcaaaaattactctaacaggtgtctttaagacacggtcaggagacttgactagagtttgtggaggctgcttgcccagctgctacctctggtgagttggaggacaattcagtttaatcctgcaactcccatattcatggtgaaatattgtgaaatcctggcacagatttgtcttttctgcagatgtaactggatacaggaggaagaaatcagggaaagacagcaagggctcacacttccggtgaatttatataggtagagttgtattgtagtgtatatatctatatatatatatatatatttttttttttttttttttttgagatggagtttcactcttgtcgccaggctggagtgcagtggcacaatctcagctcactgcaacctctgcctctggattcaagtgattctcctgcctcagcctctcaagtagctgggattgcaggcacgcaccaccacacccagctaatttttgtgggtttttttttttagtagagatggggtttcatcatgttggctgtaactcctgacctcaagtgatccacccacctcggcctcccaaagtactgggattacaggtgttagccaccatgccctgcctgtagtattcttttatcatttaatgtctgtggcatctgtagtgttatccctatttctcacctttttgtcagattggctagaggtttattgattgtattgataatattaaggattcagctttttgtttcattgttgtttttattgtttttgtttttattttcaattgctacccatatctttttgatatcctttttctgcgtgctttggacttaatttgctcttcttctgcttttctaaaaggaatttcttttctaatgtatgcatttaatgctatactcgaaagcatagcgttacagctttaaacattatagcttgtaagtatagcaatgcttcctcgtaagcaatgtttaaagctgcattctgcaaattttcattcaatccaaatatattatttcccccgtgacttcctctttgattcatgggttatttagaaatgtactgatttccacatttttatgattttcagatagcttcccatggttaacttaattaatttttaagtttctttgtggtctggcaaaatacctcatataatttcagttcttttaaatttgatgcccaaaatatggtcttttctgggtgaaagctccatgtgtacttgaaaagagtatgtgttttgctgttatttaaatttcagatttccctctggtgccatttttctttagcctaaaaaccttcctttagcatttcttttagaacaggtatgctgacaatgagttcaacatacaacgaattttatgttgtctaattttgaattgtatattaaatgttttgtgttttgtatgctctggatgtcattataattctttgaagaatgtgaattttttaaaaaaataggcagtccacccagttaggttcagactaaaaatcctgtttcttctttcccatacaaatcacctaagttttgacttccctctgcagtctcctagccattgtttactcttcagaattctttagttgttttgtattgtgctcagagtttttaggtaatcagtgggagaagcaggctgtagtgggcttattttatgttgcctggaagcacagtctttgtgttttcttattccacaattcagatgcaattattgccttatagcatcagtatttcaatttacccacattttttttttaaaaaggatgtttacgctctaatcctttttgcatcttaggccatccttttagaatcttatttctttttgaagaaaattctttagaagtttttttttttttaactgattatctattgggagtaaactatgttttttagttgtctttattttatgtctttattgtgtttttatccataaaagtttgttttgtttactgtttgaacctggttagcagttatttttatgccagaactttgaaggtaacattccagtgttttctgatttcttgtttctgtcgacaaggtccttgtcactttgttgttccctcgtaggtaatacgtcttttttctttagcaacatttaagatcttctttttgattttggtgttctcttttctcctttttttttaattttttttattttaagagatgggtctgtcagccaggctggagtgcagtggtgtgatcatagctcactgtagccttgcactcctgagctcacacaatcctctcacctcagtccctggagtagctcaccacacccagctacaaatgtttttgtagagatgaggtatttgtttttattataattcattgatcatcttgaatcttggcagtggtatcttctgtaaatattctcagccattatctcgtgaaatagttcctttccattgttctctattatatcctcctggaactctaattagatgttggttgaccattctctatccttcatatctctgttcttctctttcatatttttaatccttttgttccatgttacattcttaatatattcagtatgaagagacagaggcagatcaggttcaagacaggaaattaaagcaaaactcagtcataaggttttgatcactagttacagaaggttaaaaatatgttttgttaagttgtattctatggttaattatttttaattatctttgtcttttgacattttgccgtaatgggtatatgttccagatgacatcgttgttaccaaaccctggttctttctgagctagcataggcacccagaggtccaatttggtaggtgagatatggtaccaggattatctgggaagaaacagaatggcatataatgtttaaggtgcttgagctctgtatagacacattttgattcaaatttctgccgtaatatttattaaatatgtgacctttgatgtggttcctaatgttgcagcacttgaattttctctgcattggctactggtattataattattcctcaagtcagttttagcattatacttctagacagattcatttagttgtggaatagtataatgttaccttttagaaagtgagcttaggcaagattataggattttgaaccccagcttcaatgatttatttgctttgtgtttttgagtcaaattactccaaaggaggctagcacaggaaccaggtgggaatcaggaccccagataggtgaatcacattcaggacaggaaattaaaactaaagttcagttatatgacctggaccagcaaggaaaataatgctgcagatcagtaaatacaaatatttctaatcccaggcatactttattctgggtttattacagccagccttctttcattataaattatctatggaaaaaggacttaaagttattgatacggttggttctcaaaggtgtagggacttgtcagagccaaaactgctagtcagaattcctaagtacctgtgctggggtgggatgggaggctagaataagcagggattcaggatcatagttgtagtgaaaggtcaaattggattataatgaaatgtctactcatatttaccagtcatacaaactaagtgttccgcttctgggaatttgttttgaggaaataagaaaagatatgcacaattatataattacaaatatttcatcacactggtgtttaaaatagtaaaagactggaatcactctaaatgtccaatatagagaattgatttaataaacttatactacatctatgtaatatgaaactttgaacccattggaaattacatagaaatgtatttctatttcttaacttgaagaggtatttactatagttaagctacaaaaactggttacagtattagaatatgatcacgtttttataggaaaattatatctgtatctattcatatctatctctgcaaagaagaataagaagatttgggaaagtattcactaaaatgtttacattgatttttcttggaagagagaaatataagggcttttattttctaatttttactgaacatttatgtctgttataataagaaaacattttactttttatttaaagtggcaggcagtaaaataaatactttgacattagatttattgtaaaaagagaatccatctcggtattactttattataggatttctttttgtttagaaccgtgaggccatgcttttttctgtttatacaattttgagtactaatttactttttaaattcctgctgatatttctaaatctaatcctttattgtttgcttttatttctttaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctgtaagtatgcctccttgaatataaaaaacttatttaaaaattgtgaattctttcactttaaaaatattagcaatagtgctgcttaatgtttggaggaggaaaatatcaaattcagtcttatgactcacgttgttttgttttgttttgtttttgaggctgagtctcactctgtcgccagggtggagtgcagtggcatgatctcggctcactgcaacctccatctcccaggttcaggcgattctcctgcctcagcctcctgagtaactgggactccatgcgcgtgccaccacatccagctaatttttgtatttttagtagagacaggattttaccatgttggacaggatggtctcgatctcttgaccttgtgatctaccctcctcagcctcccaaagtgctgggattacaggcatgagccaccgtgcccagccagttcacactgttaatgtgttttattaattgtaagatatatggataagtgacttaatattagtatcaaataaaacaagtctggttcatagtattcttgtttatcttaaagatgttgtacctggtaaaatcccattgtaagttgtacgtacattaattctgtttcaaccaattcaagattaattatactacaatttggtaatatctgtgaataaaagatttgcttaattaaatataacaacattagaaggaaatagctacctatttaggaagactaaaagattttactatctatatcctaattcttgatttatgtacttatttattaatagaagatccattctgtgtctgtacctcaactgttcactgcctttaacagaaagtaataaatcctacttcttttaacattatctgaattaaaattttttattaatattcaggataggttatgttttgttcagactaatattcaagtaaaattgccaactccaggccgagtgtggtggctcatgcctgtaatcccagcactttgggaggccgaggcaggtggatcacttgaggtcaggagttcgagaccagcttagccaacatggtaaaaccccctctctactaaaaatacaaaaattagctgggcatggcagtacatgcctgtaatcccagctacttgggaggctgaggcagaggaatcacttgaactggggagatgaaggttgcagtgagccaaggtggtgccactgcactccagcctgggtgacaccaagactccctctcaaaaataaataaaataaaattgccaactctttatggaatgcaaaacttgttaggtgttcttcaagacctctttaatttaccagcaactgttcaaagcaaaattatttgtataagtaacattcctccaggaaatgatgtactcgtagaacatattaaggagttgacttcttatgagtgtgagactctggaatgtaaagcttttatcttcaaataaaatgtattgaaaattattttttatcagtagttctctgtagtactgtgataaccactgtgtaaattaaatgggtagtttctcatgtttcatacatttaattttaaaatataaatattccatggatattattttcccttcataaaatgtcaagaggaataatggcattatagcttcgttaagagtagaaggaatcttaagtatcttagttcttttttttctattagaattagattaagtctaaactaattgataaatagctgttttgcttttggaaaataatgataaagtagctttatgttgttttagagttgtaattaagaaaaacaccattttaaaaattatgtttttgtttaataataaaatatcacatgctttatgggataaggaatagaattgctttcgtatttgtttacaatattaatgctgacagatttttacaaaatgtgttatggttgaattgtttttttttttttttttactattaaagattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccaggtaagggtcttgtagtcccctttctctccccagttatttttttttccaaacaccaacttgaaccagatccccaattaaaacaacagtattttttatgtagccataatttttttttttttttgccgaaatctgaataaactacatatatttagcatcaggaacacactctatactaagacagcagctttagatcttgttagggacacctatctcaaccttggagtgggcattgtctttctgtcattttatttaactcctttttcaagcactggaaaagtggctacacggttttgtttttttcttttaaatcattccattagccatatatagcaaactcactttgacattttggaaataacattgtgctgaggtgctccattatgcagttactatcattcagttttactatcttcatttatagttttgtgagtccaccaattagcatctcgaaggtttacctttatctgtctttaatccatctttttaatcatgaatggaaatcggaagtagtatgcttctgaaactctttccagggaaacatctcttcttgatttgagaaatgcaaatttatttaacattcttatccctttcttgactaaatttaaatacttcttggtatttgggagctggattcttgtcaactgctgtataaaatatactcacaaaaccattgcagaaaagcaagaaatatttatgtagaagttcttatgaaaacttattgaatttaattttgaaaactgaagctaagagagataataaatatctagagataactattaacagtattctttcaaacataaaataataagataattgggagctgagcataaaacattatttggaaaaattaactttgcttttcttcattgcattttgtgaattcaaacttcttaattttcaatgcaaaattgacaaaaattaattgaactgcacaaattcctgaatatatagacttaattggcttttaaaaaatattttaaattttgcattgatctttgtatatacttttaaccccttacgatggaatatgaatcataagtagaaccagggcctgttggtcccgggggttaaaagaaatctgcttaatatttctaccctttttctctatcacaaacagtattctttcatgaccttttttcttatttagagatcctccatagataatgaaaacctggtttcagagagagagagggtgcttttagaggagctggaagcactaaagcagctgtctttagctggaagagagaagctgtgttgtgagctgcgcaacagcagtacgcaaacacaggtagtatggactttgccccacctaggagcaatggatcaccaattcagtaggatttgtttgtctttgttgttggtatgagatgtattcttttataggtactgagcttaacatatttgtgactgcatgtgtgtaaggtaggtggagtcaaaatgccttacatttcatttaaggtaatttgaatctgacattctgttaacagcaagtattgtttcaccaaagagaacctaacaaactttattgttgcactacagcatggataatttgaacccattaaaattttttatttgtgtacgagaatgttttatcctcttttgataacactaatctcgagtgtagttaaatattataccaaccagtatcaattttgtgcacagaggtttctattttatctcataccaatatagaagaatgacatgctgtttccaagttgacaggttttctttctgtcttctcctctcttcctttacacaaacttaaacagaatggaaatgaaaaccaaggagaagttgaagaacaaacatttaaagaaaaggaattagacagaaaacctgaagatgtgcctcctgagattttgtctaatgaaaggtatacaaaatgtgtactttttcagtgcaaagtaaattaaaatggttgtttcaatgtaatagactttgtccttatttttatcttgtacattgatactttgtcttaaaaatcatcataccatctgtgtatgaaacatgtccatgtatgtgtagtatgtaaaggattttcagtttttcatcattaaatagataacattttaaaaaaatcttttctatataaattttgattggatattaatcacatacttaactgttaatcacctgatgttagcaaaacttttccttactttgattttgtagaggttaatataaaaatgtgaaatattaagtgagaatagttatcctacattagtattaaagactttaagcacaatattttaaactttgttttgttcaaatgaaaataatttctttaattttaaattaaaactaatatttacttcttaatttcctccttttccaatttctgtgactgtcaaccctcttgtgtcctcctaacctccttcctcagcttgcatggaggaatttggcccctaagattttggcttccccattggatcatcagtatggaacgcagtcagtatggaactcaaacaagaaagacagtgtatgaaaattagagttaccacggcaatataaaataaacactttgtttattttatattatttatctctaattggtaaattttgaaaactatgcagtatttaatttctaggaatttttatagtaagtgccaataaaatgagtatttttttttaaccaccatattaattttaatcatttctcttaagtagaaatattttcacattattctagttctggggtttggggcttaaacaaaacctcagaacaagttaaggaaataaaacccttggcttcctactaaattagtttagttttatttttagtattcttgattatataagcagagaacttgatctaggtgcaaaaatagaaccgtctctttcacttgacaaatactaacggaaaacttctccatttattatcttgtcttaaaatagatatgtcatgtgcctgtgaaacaggtatcctttagcctgatttttggcaagctcctacagtgtgaagctaaaagataaaactgtcttaaggcagaagacctttaccatgaaaatcttttattttgtctgcatgtataaagtgtgcctttgttgaactgagttgctaggacaagagagttgtttagtttttaagaaaattaatcaggcagtcttctgaatcaccatttatggaagtagctttctttgcatggtagaatgttcatgttaagcaaaaaagagagtgtacaaaaacactttgttcgggatgatctcatttttgtttttaaaatacgtatatatttataagagaggcaggaggaaaagtctagaaatacaggcattaaaattgtaatagtgattgctgaggttttttggtgagtggttagcagtattttccaaattttttaaaataaggattactttttaaaaagagagacacaccaaattcattctagttgaaaacaggtttcttctgccgacttaaatgagtgtggtgagtgtaacttgagaaatttctgtccctggagcagatgtaataaaaacggcctatgatactctctgtggtgttgacagatagtgaaatttcattacagacctttttaaaaacacatcgctgcctaactattactttttgtaatttaaacattcagctcattaccattaacttgtacaaatactaccacataattttttctggtgtgattttaaaattatgtttcaaaatatgtttttatgtttaacatatagaaagatttaaatgtgcaaaatacatatgtataaccatgggcagcaagctcaataacttgcatatgctttggcactaccatactttttaaaacttaaattttgtctcccaagattttctcttaacctagttactggcttaagactttagttatttttttcaagtcaattaaataccgtacattttaaaaaatggtatgattaagctaattggccaaaatttttcagacaaaaacaaatcattttataatatagttacaaataaaaaacaagaagcactttattgtagatgctattgggtattttaataaaaaggatcatctgttatttttcaaatcaaatattttgcagtgtactttttagtggacataagcaaagtgtttgcttcaaaaatattaaacattttaatcagtgcttctttatctatacaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagaggtactagttttctgtgttgtggaaacaatcatttcaacaaatctgctgagttcaaggcattttgccatgtgttgaaaatatagaagagaaaataagtattttccagcaaatggaccttcaaacagaaatacattagagcaactcttttcaaacaccattattgtatagcatttgcaagtgggtatcatagagttgtcattatatttacccagggttgccacagtgcctacataaaccagaatgctgttacatttctccaccgataaaagaaaatttatatatcagcacttagtactcttaccagtatctgtgaggtatggatgacatcctgaaaccatcctatagattaaggaaagattagaaataaagactttttaggaacccagcaccagcttcatgtacctgttgaaatggttagaagaaagtcttgataagaaacccaagatttggtgttacctttggactgtcctttgctagattctttcttccttttgaaaaagtgagttgaaatattacacaatgtgtatggatccagagattaggtcctgatatgccagagctgtcttcgtaactctgtcttccttcagctgtgtggattcagctcttctttccgtttctttttttttttttttttttttgagacagagtcttgctctgtcgcccaggctggagtgcagtggcgcagtctgggctcactgcaacctctgtctcccgggttcaagcaattctcctgcctcagcctctcaactagctgggactacaggtgcatgccaccatgcccagctaatttttgtatttttagtagagacaggattttaccctgttagccaggctggtcttgaattcctgacctcaggtgatctccctggtttggcctcccaaagtgctaggattacaggcgtgagccaccatgcccggcctcttctttctatttcttcccatcacattgctgaactccattgtctcttgttttttcaatttctttttccttgtaggagagggaaatgaggaaatcaaaagaggggaaaagttttgtgagatggagaaacataggatgtggactcctggctcacaagatcaagcccacagttcactaccattccacactcaagcacttctcccatagaggcagacctaaaatgccagtttttgtaatttttgagagaattctgtttgttaaatttcatgtggagaaatgaaaagaaattatcccatttatggaaggtttgcctaattataagttggccagtagtgtgtttctaggtacagagaaaagcttgatttggaattgcaaataaaactgatttttaaacaccttagctgagttcaaagatagttttaaaaattgtttttagtaaattaagagctgaaataatactgaattttaaaccttgctttcaaattcactcttttcaaacttggtggaaggatttttcaaattaacttcactcttggttaagctctcagtcacggctattttatttctgcatatggatctttatagagaagaattaggtaacattttcttggtctgataaaagtgtttatcaaattatgctttttaaaaaacaattatttcacaagcttgtttcacttaaccatttagggagggattttgctgttctgctggtaagacctagaccaggttgactgccatattcagaagagactctgagaatgttctgtgcattacagatgtattttgtgcttttgttgttgttgttagcagttctcttagatacttctcaacatggctgccaaagtattcagcagacaacataccttgaaagacagtgaacttacttccagagcactgtctccataaaagggaataaatggataatttaactcaagcacagaggattatatttatgttcattttccatgagaaagcagacctaaaaagacttctgatccactagcctattttcttgcataagtgtatctaaatcttccaacacacatgaaatatgtatatcctattttaagatacagtaatggttttctttccttttttttttccttttgagtctcgctctgtcacctaggctggagagcagtggcgcaatctctgcttactgcaacctccacctcctgggttcaagccattctcctgctgcagcctcccaagtagctgggattacaggtgcctgccaccatgcctggctaatatttttgtatttttagtagagacagggtttcactatgttagccaggctggtttcgaactcctgacctcaagtgatccaccaacctcggcctcccaaagtgctagaattacaggcgtgagccactgcgactgaccatagttttcaattataagcaattttatgagtttaattctgcagacatttactgagctatttctctatgctctcagctttacagcaattcatagtctaatgaagaagtcattgctattctgattcaaagcaaaatagagtcataatatttaatattttgcctaaaaccactacgtatatttgaatcaactaaaacctttaaaattttagttatttaactgttgaccgattctgaaagaataatattgagataagagaaaaagctaaatccacagttaagaaatatagtgtatagaatattgtagcagagataattttgctaggattagtatcattggttacatttactttccatttagttaactccatcttactgtttttatgtttagcagcagtgtgatcatcttactaataaaattggagcaaccactaatattactgggggacagttaatggatccatcttgcatctttaaggatatattgagttaatagaatttataatttaaaatttttaatttttatataaacctgaaagaaaatactggctttaaaatattaacactgtgttccatatgtaagaattttttctgacattccttcataaatataatgggagcattatttttaaaaatgaaaaacttttgacagttttatgttttttagtataacaaaaaaattaaaccagtctaattgcgaagcaacttttgcttttcagttttcatatatgactttttgttgtaacacttctgatgtgttttcagccttcaggtctgaacttgtttcgattttaaacatgtatggacttgttaacactcaaaaagtaaagaataaagttgctaatatttgcttcctcataagagtaacctagtttatgaaattgaagggaaattttgagctaacataaaatcacttaaacctgaatgaatattagatcagttcataaaaatgaattccccaggttgtgttgaaaaaaaaatttcctttaggtcttcactgtgatgattcagtggttttatgctcacctctcccataggaggccagggatggaatcttgtctgctgctgcctccttttggagaaatgctgtcttatagaaggaatgctaggggctgagagtcatggctcatgcctgtaatcccaacactttgggaggccaaggcgggcagatcacctgaagtcaggagttcaagaccagcctggccaacatggtgaaaccccgtctctactaaaaatatgaaaattagccaggtgtggcggcacatacctgtaatcccagctattcgtgaggctgaagcaagagaatgcttgaacccaggaggtggaggttgcagtgagccgagatcacaccactgcactaatcagaaggccttgttttctttttttctagttcattgtgatattgggcaaacctcttaagtctcccagggcttcagtacagttttctcaactgtcagatccagggtcagactaaagcctagtggtttccattggagccattagagattcagagagcctttggggcagagaaggctttatcacattgcctatcccacttaaacctgaggagtttatcgttacctgtcagggaatgaacatgatataatccataaagttaataactaaaggacttgaataaccatcatttactatgttttaagacataaatccaagaggttcaccaatttgaaatgattctatttaccaaactggatgttctaagattattattggcatcttgtgaagttcccctgctaatctatattatcctctgaatttttccctccaagactggttattaaaaataaagtttagggccaggcacagtggctcacacctgtaatcgcagcactttgggaggctgaggtgggtggatcacacggtcaggagatcgagaccgtcctggctaacatggtgaaaccccatctctactaaaaatacaaaaaattagccaggcgtggtggtgggcgcctgtagtcccagctacttgggaggctaaggcaagagaatgacgtgaaccccggaggcggagctttcagtgagcggagatccagctactgcactccagcctgggcgacagagtgagactccatctcaaaaaaaataataataataaaataaataaataaataaagtttaagcttgatgtctttctcatatttctattttataggatttttttaaatttggttttttcttggaacatattcagattatttcagattgtttatactttcaaaatgttattaagaaaataccttaagctaggtgacgtctttgccttttctaggtactttaatgtctatttttaaaaattagccatttggcttaaaaaagccagaggccttttataagtcactttcacgcaccctctttattttgtgcttgagatttgctcccatctaatacaccataccttcaatcttttcctcatgttgattccttctctatagcccaaaacattagactgtcttcatactgccttaaaaatttaagaagtgttgaattttctcacctttgttccctgctcaaggtaaatttcagcaaactttttttttttttttttttgagacggagttttgctctatcgcccaggcgggagtgcagtagtgcaatcttggctcactgcaacctccacctcctggattccagtgatcctcctgcctcagcctcccaagtagctggaactacaggcacgtgccaccatggccagctaatttttgtatttttgtaatttttttttttgtatttttgtattttttagtagagatggagtttcaccatattagccaggctggtcttgaactcctgacctcgtgatccacctgcctcggcctcccaaagtgctgggattacaggcatgagccaccgtgcccagctgatttgacaactgggaggtcagtgttgtcctctgagagagcagctttggtactgcaggaatagaaatcaaggctggtaaacacaggagtctccatagcatcttcccagtcgttgtcttgtttgtctttctagacaaataacattactaaagtgtcttgaagccgtctctttttgtctgttggaacatctctctcctgcctctctctgatattttttaacacaggttcttttgttagattatgatatacagagacttcaactttgtcttccttctctcactgagtattactcctaggacaaatgtatctacttccaaggtttcaactctcacctttctacaaatgactcctaagtcattgcagacccaaaattccaacagttgactcatcttcacaaatcccattaacacttcagactaatcatttttcatccctactctgtatactttttcctgattttttagtatttttcttaatgatttctctgtcacctaagaatcatctaagctggaagcccagagtcatcttacgcatatcttctttccttgtcttcttctacattgtcttctccaacctgtgctttctcaattttttctcctttaacttacctctgcattgctacaatttgcttcctgatgcacatatttgatattatcttcttattcaaaatatgatttactctttccatttgtttatagcaaaacccctaaggttcctataaaatttaagaccatttacaacttgaatccagcttactttccagctaccttcttttagctctctcacctacctcaccactatttctccatgtccctttgccctaaaaagcctagagttcccatcgtatcacactgttccctttgcgtcacatttctgtacccatgagaaagaaaatgttactagaatgcatttaatttctcacataaagatgctgtaaattccaagattatcttgcacttctaaatgttttcaaggcattcaattttgagcacatggagtaatataaataagtaccagtgtagctgatgtgttttttactttggagaataaggatacaaagtgaaagttgtatttactgttaccttaagaattagataaacctgtatataatgggaaacatttaaaatcatgccttaaaatgcaattttgggctctacagccagtgacttacaaagaggacatgcttagtgaatattgaattgtgctgaattcaggtcttgcgtctgaagctgtatctgatgtcattactacatagattaagaaaatgtggcaccagctactttagcaagacaagttctaataagtagctcttattttgagtgaatgtgtcaaactgaatgcttattccaagcacttggtacatgaagatttcctctgctttaattggttaactttgtacagttactgataacaaatatgtactacatgtaataaaagaataggtaatgcctcttcaggaaacttcactgttgagttgtaacatctgccacaaaggagtatttaatggcagtggtgaatagcctatgcttttattatagcttagagaaaatacttggaaagcttatcttctacccatgcaaactcatttttttttaacataagaaataagaatagtgtgggtaatgtggataacaatgtccaaagttaaattagacctgctcatcagtctaatcttatcccagtattcctcttaaaacagtagcaagcaacaaaatgatctcagttccttttactgtgtagccaaagcagatgatattgcccagtgttggatcaaaagttagtcatcaccagataaattcaagcacttatttctatcctgtactcccaatgtaggctcaaaagtcagtctgctcccgaaaaatccaagcacttatttctatccctctgtacaatttgaaatggcctactccacaatgcctttcttttcttgtgattgtttatgtgtttcctcattacattgtaaagtcgtcaagggttggagccagatcttgtcacctatatgtccctattacttagcaaactccacatagtggacatgtagtaaatttctgttgaaaggtatcttagaagtttttatcaaagaaaaaaatactgaattacccacatgatcaatttctgcaaattcctattagcataacatttctcattcttttgcttggttattgaataatattatatcctatatttgcatattttatttgtttggttgcaatattgttttaaaagaccttacaatttccatgatttccagtttagtttgatgttgttttataactttaaaaaattatgattattataattaatttatgcctttaaaacactgttattctagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcaggtaacctccttatattgctaatatgtactgagtttgaagtacaatatactatcccactctctcgactgagctaattttgatattttcatggatagctgtttggcattttcaaagcttgaatgcatatgcatcttaattatccctttggttgtatgaaagttgtatagtataaatgattctatactgaattcctacatgatcctgcttttgttttgttttggtttttgcttatttcaggtatattagtatttaatttttgtgatttgtactttcatatatgaaaacaactgttaatactttttgtttcttaaccgctattaagtacttttgacctggatctcagccagtgttaatgctgttgctactacttgataccattgtaaattataagcagtttagttaatgcaacatagtatttgtcttttgataagcaacgtgaaaaatgttaaataaatcagaagtggtcagtggttccaataggctacttgttcttaacaggctactagagagaaacttctccaaaatttgttaatgctgccaacagtcaagcatgtgggctcctcctgaaacattcatttccccaggccaagaccacagctcatagcagctgtctgcttatgtgaccaggtagtgaagtatagtaggagtctgaccatggcattttccagatttttcccaatttgttgaatactaactccacgctgtgttatttagcttcttctgtattgtggtaatttaaatatcactgaatggatcacaaaagctttgtgtagagcagtaaccctatggcagagacttctcaaagtgcagcccctaaccagcaatatcagcatcacctggtgatgtgttcaatatataaattcttaggccccaccccagacctactgaaactgagggcccagcaacctgtgtttttaataagtcctttatatgattctgattcacactaaagtttgagaaccactaatctgtggattattagtacaatgttcacattgttctctggcttaattttgaagcactctactaacatcttttatataaaatgttaaactagttgttggcattaggtataaaaagttataaaaatgaagtatttcttaagtgaataatatttttcagcattgggagtaggcgtttttaaaaactttcttttaaatgaatttcagctcagtttttaatcttccatggatagatgtttaaagccattgatttcttcagaatagtctcattgattaataactaaaattatcttgaacctgatgaatatttttaacagattgacacagaataatgtgtaatatctttgtgaaataacttatattccactttcctcttcaatgtgtcattatttggttctactttataatagtatacttccctttaaccttcattttttttttcacgtattataacaaaatgtaaaacagctgggaggcatgctgtaatatctttgcgttttcagtgaaagagaaattcaggaaaatagctttgtacaggatactctgagaccagagaagagagcaacatctgacatgttagagtgtggtggggaccaagtaaagtttacttgggagttgatgcttaagatgtttaagatgagttattcactggcaaaatttttgaatatcagggcactggacaagtatctgccttataggctgattgggtgatttcataacctgtattataggagttatttactttagatatttgatttgaggggtaacttgcccagtggtatgtccaagtccatattatagtacatttattacaacggttttacctctcttttgcttggacaggctaccatacaatcaggcctatattcactttattgttaggttcctactggttggggtagctttcatgatagtatgaaaaagaatgcttaagagactgtcataaggcccttagagaggtaatctctttaacacaatccttattcagtagtctctttgtggttctgcagaaatgttatctttgagagtgtggtttcacagattctaaactcctggatcaggtagaaatcaaaaccattctcttctttgggagtagtttttcagcaattaaagttttccagaatccagaagtattatttagagccataggaggttatttaccaagagattctgctaggccttggaataaattaatgaatatgtaatttattcccatggaattatttttactgtaagaaatttttacgggcttcctaatacttgtttttaagaattacagcatcaaagctacatgcttctatattttctcaaaaaaaggaatctgaggatgaagcagtagtataagttaagattttgttttgtcattgttgtgtttgaaacataactgcaatcaaaatactgaaacacattttgccttcaagtattgtccccagtatgcttagcattggtctaggctccgtcagggtaatgtttgcaggttataggccctctgtgaaataacttcaagaaatagatgaacaaatcaaagtccaaaagagagcaacaaaagtgttttacagtttgaagaaataatttatgaagaaaggtagttaaatggtttgacattatttgatttaagtaaagctattttgtttaggaaacaactctatgctgcaaattaatagccttcaaatatacattaaaatcttgattatctgaaacctggcgataataagctagtctggataattaaaagtgtgttcttctaagtcattttattataactatttttgattgcaagaagttttatgtgctttctaaaatagagggggaagcaagatagaatataatttgaattattctaattcagtcacctttctgaacatcaattaatatatcatcagttaatattactgttgttacaagggctgtatgccactatcctgaatcatctttatttaatactgctcttttgagtcttttttgccctaattttactttattttctttgtgtaagcttcttaccttgacctgtgttcctaatataactacttacctacagatttttgttttacatggatggaagcaagttttacatgcttccaaaaatgggtgaaacaatagacaataatttcagttattttaattcatggtcatctttctgaacatgaattaatatttaatataatactccatcagttaatatactgttatgagggctgtttgccctattctgaatcatctttatctgttacttttttgagtccatttttctcagtaatttttctctcttatctttgtagttagttcttatcctgaccgaaatgttaactgtttataaagggttgtttcttacttacagattttgtttttgcttcaaataagagaaactagatatcagattatcaaaacaaactgtagtttgcagagggagcagggaaagagtgttttaagaggtatttgataggctaagcatgggtccccacagttcataaagctgagcatctgggatattgacaacttctatctgccaaagccccactaaagtcacatttagctgcagcagtgataagattaggcctctatcttgtataggtgtttattagggtttcttatgcaaccctccagttaatctgtgaacgtgctttgttaagacaccttcacagactaactggagggttgcataagaaaccctaataaacaaaaaatttttattgcctagtccagacttgtaagaggcaactgcccctccacagctacaagccatctccctgtagattctggctttctatagaaaatgtcattttctctgccctaattattagtctacctactgtgaaatggtttgagtactggtttaaacaactttatagtgtgagtagctgtagaatggatttgtgttggtattacctaccttctttagcatgggtttttccatttaaataaaggctttgtggatttaggatatttagttactggaaagaataataccaaaatgagggttttttcctttctttaaaacaactttcattattgaaaatcttttaatattaaaaagtaagttgtttatcttctaaaattctgagtggcttatttattcactattgcccaggtttctggagctacccagaaggctattctatataacttgggcttttaaagtttagtcagggttcataagataccttaagtggtatagttttcaactgttacatacagtgtagctttaaaaagaattttttccttagcatgtactctgtaaacaatatgaaaataggttataactgaaatgtctatagttttagtggctgcttgaaagatgagtaatatttctaaggaaatagcaaaagtaagttttaattttccagaaataactttgattattttatatacttgaataacttattactaatgtggactcaagcataattaatttcacatttttaaattaaagcaattttttaatggaacggaaaaacaccagcttatcttacaaacattataaacttgtctaaatgccctttcaaagccctgacgtggaacttggatcctgtctggcaggcttttttgtgggcatattaattcacattccacctgtcagtgtacctataggtaaagacattaaaccacaccctctgttctgaccttttcctcaggggacactgactagaatcctttggctcagcatgagaggctatttgaatagctcagttcagaagagcttttccttttgaatagagtgaagcagcaagagcaagagaaataatgttacaactgcatttctcaagactgctgctatggagatttcaaacttgaccttccctgccaggttctgctttgaaggcttacttattactacagacatcgctgatattaaaagcagttttattgctcgtctaattagatgtttatatttttattcttctcttcaaggacttaattatgctagtttaaaaggtgtttttgtttgcttgcttttatttttgttttttgattttttttggtttttgttttggtttgggtttttttgagggggcatcaagattgatagagacctaagtttttttagatttgtagtttttttcctggactttccccttccttttattgtgcagttgtatgaattaattttataacatttatttgatagtgctaaaaaagaaactttttatactgctatggtagatcttgataaactaaaaagaactttttaatgtattagaaaattgataaagcaaattaggaatctcggcagctgtatcttctgggatggattcttatagcacctatttggcaactgtcaaagtcagtggctcgtggttagaagagcaagatgaagacatttatgaggttgaatctcgcgtgcctttaccacatccttttcctctttgtgaacatttggatgaaaataactcagtaattgttaatacttctattttccattttattcataaaagaaacgggcatatattaaagcttatttctaaaatttcactgcctacccctccttattcagtaagtataaaaaatattcatttagttaaacactataatgagaaattaaattttgagtgtctatattaaggctaaatgggatagaaccttgtttgatgcgttactactcattcattctagatgtatttaagggctaaatttggtctgagttccaacttggctatgtttacaattacagaaagcagaatgagataatattacatttctccaatgccaggcagtttgtttaaaaagatcccgcttttccttaagattcttgcttttgtatgtttatcatgccaatcctgaataagaatggaataattattatatttgagagactcggtattatgatacttataagacagctaagtgaattgtcattgagcaattaggaaatgtttacaatcatatgttatattggctgttccagtccaggaaaaaaggaagcttgggttctaattttaatattcttaacaacctaagaaacttactttttgtttttaatatgcctcgtaatcttgtggaacaagacccttttctgctttttatatgaaatatattttataaacattgttaaggataagtgtttagcataaagaggcttgaatatttagtatttcaggttcactacaggttattcagtataactaaaagttattcagcgctttttatgactttcatagctttatcctgtactagctaatatttaacaagccagatggttttcagaatagttttgttacctcttctgcaacttttatattaaagtgacagaatattaactgatactttacatgtacttttaatgtaataagtttcttaaatactttggaaatattgaatatgaaatcttacattcttcatattgttatagatattaggaataaacatactctaactgaatggaagaggattctttaaatattaagtatttaatgaacatttatttgaagggtgtctcatctcccgatgaagtgtggatctcatctgctataataaatgacatttttttttgctagatttactgtatttgattgttccaactttttcattttattttagaaaacaagtttttctcttgtggttttatgataaatatttaaatggattataaggctgattaaatcttgtcaggaagtagaacatagaagcaaaggcttatttaatttacttacctaaagcaagcatttattttgttgtaaattctttgttatatccttatagtaaatttaaaaaagacaaaaaaaagcatatcctttttagttacatgtatttactagatagtcattatgtaatgaacagaaaaaaatgacaaacgtgtaaaaacaattgatatgtttttaaaatatggattgtgactgtaaattcccatgtagttgtatataaattagttcatactttattgttatgtttctttgtaataaaaattaatgatattagttatccagactttaaaggaaaaactctttccagttaaaagtaaaaatattccttttgagataacaacatattatcatgggtattttaggaaataatttataatttaaaatgtatgattaattttctattatgagtcttatacgtgtattcatattaattgcaaataagttataagtgatatttgaaatatcctattaaaacaagaataattgcatactggatattttggaaattgatttagagtagccatcaaaagctgtagttactctaaaatccatttgctatgacaaatacctctcagatgtgaaaagtggaagtctttaacaataaagtatcctttagtattatcatgattttgtaatacattttcaatatgtgactataaattagaaaccactacatttgatcatattttaagcttaaaatgcactaatatctttttaatgcacaaagtactttatatgtaaatttacaaattcttatgactttactgtgagcctgttattaatatatgtgatgatttcttcttacaatttttggactaaatactagaaacatttgagttcaattttttcccatgtaattgtttcagtaataacagataagcaggtgctgatagtcaaaagctcagaaaactaaggcagagacagtacttttctgcaatttcacacagctcatttagtagcagtgatcaagagagctttggctttaagccttctatcatcttaaaaaattgtttaagaatgtagtcagtatgtgctattggtaatattttaaggaatctgtgtttatggttaatgtctctgtattctacggttttgaaaataagctgaatattcataggagctttaggtgtttcacaaatggacagaaatataaagcttttagttaagtacatggattataaatataatttcattttgttgtgctactatcattttgttaattgatgccattgtattaatcatgtattattggtcccccacagtatacagcagatactgtaggagtcacaatccgtaaatactaaatgtagaagaaagtttatcatagactgtatagttacataaaattctttggcaaatacaataaacgcctgtgcttcattaactttatatcttcttttatatgataaagtacacagccattgatttaaagtggtttgtatccaaaagaagcatattcttttgttcagtaaagctagaatacatcactttacagaaagtcgtgcacagccaatatacatgtctcctctgatttctcctacctgctaatcttagcatacactggcaatatctaaatgactacaattcagtagtatatctttattttaaaatcctccttttttccagctttaatagggaatgaaactagtatttccacactttattttcttttatgtattgtttccctctttgtttagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggtgagcaatttgccattgacaactaagggtagagaaatttcagtcttaaaatagagatttttgatgcacagccaggtttggaagccgtcaatccaatttagaatgaccattaaaaagtacttgtggtttatcttcagagttcctccaagcaatttttaaaactatatatatatatatatatatatatatatatatataaaattataaaaagaatttatagagttacagaaaataataatttcagaaaataccaaaaaggatagtggtgactcgttactgtaatcacaccatcttaagacaacccttgtaatttaaagatgagcaaactgaagcgaaaagatgttattaaattgttaaagggcacaaataccattacatagtgattccaggctttgaatctctaaagccctatgctctttttaattctcctctgctgttatgggtgttggccttctaaaattacttaaaataccaaccttctaattttcaaaatgtgattcagttcacaagcatctaatttgtattaagcttttcagaaacttactgtttatatctgtttaataaagtgacttacacctacataatgtggtactttggtatagcaaagtattagaaaattcagagaaatttcatgtttatgcacaatggtaaacaaggaaatgtctgcattgaccataccctattaaaggttgatagttgctgtgatgagcagcaaattcattcaagacttttaataggttggaatgatggaaagttttgctaacagtataccttttgttgtttatattaaaacctagtggttgaatttgaaatgaataatagttctattttctgttaattttgtattataggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacgtaagtattttcagaatttgtatgaaacagtcctctgattttatttgtattcttcaaaggcttaaggtggcttttttcctctttcagtgccattattcatatattttatagagagatttaaaaaattataagaaaatctaccttagagataaatgtcttattagccaatcatgtggaatcaggttttttttttctttttccttaggcagatgttaacaggaaaagatagttcttcatttatcctcaaacttctgcttcaagagaaagctgcaaataatgaggcaggatattttaaaaattgtgtaaggtttagttctaatagcagagaggcagcaaaaatgtatacttggattaaatatctaaaagcactgatctggcactagtaatgagcaggtggaggggttttttgacttgcaagcagagtagatttaaaaaggtcagtggctggtaggctgacatctagtttaatgtagtaggaattcaaataatacttaaatgtttaagtaacctttcatttttccttaaataagatattaagtaatatcttgaagtgaaagtttgtttagcagtaaatgtcagtcttggtaatgatggaactttaatcctgtttaccatgtcctctcacttttatattacacgtgcagttggatttttaaatgtgccgtttcactgatttcattttatcggtttagaaatacagcatacatttttgtaatatagtgaagtttcttccagctgctcaaattaattaaacaggtttagtttgggatttttaatatggaaagtatatgtcatatatgcaaaatattcaagaaatactggaacttctcaaaatgttaccagtgataatcagtgtcttcaactcttgtttttgatacgtgtgtgtgcatgtgcattatcccattttaggaagtagaagacatataaattatacttttgttgtgtctttttttttttttttctctattttcctaggactagtagatgctgcagtcgatgcagcaccaggagcaggtgtgtgtataccattgcatggccaatgtttgggtggtagactttaaactccaaaatgtgggtgacctggattttcagccaactaacatctctagttttgcagtgttgctgttgttccatacttacagtttttctctttaacaacaacaaataaacttttcttacaataaaagtacaaattttcatttgaaattaacatctgagattcatactgaccatcatcttatgatgtctatttttgcatagagcttaaaaccattttgatttttgtttgtttgtttgtctgtgtttgttttttgagatggagtcttgctcaatcacccaggctagagtgcagtggtctgatctcggctcactgcaacctccgcctcctgggttcaagcgattcttccacctcagcctcctgagtaactgagactacaggcgggagccaccatgcctggctaattttttgtacttttagtagagatggggtttcaccatgttggccaggctggtctcaatctcctggcctcaggtgatccgcccacctctgcctcccaaagtgctgggattacaggcataagccaccatacccagccattttgagttttttaagaaaccatttaacaaatgtattaaactctttcaatctatgagtttttaaaatgctccttctaaatcaggaagtatgtaagatgatggtagcaaaaggatcagtgaaatttaataagaggctctctggttgatttatttttatgttaacatctaatgttgttttaaaaggaaagctgttttctagagattcctagtcctgagtacaatgttggcatactagttaaagaccctagggatatgttctttccattttcttcattagaagattgttttatttttactatatacactttgttatattaataatattaatagctaacacatagtgcttaccatacctcagacactcttctttacatgtattaactcatttaatgccaaaataactctaagagatcagtaataatattattctcagtttacatataaggaaactaaaggacatcatcataactgtcacatgggagataagtggctgagctaggttgggcctacggtctgttcttaagcactacaccacactacctctcatacatgtcagttttcccttgattcacatacatgtgaccatgcaaaagcaactcaggaatatggatctaataaggagtaagactaacaggaaatttcaattatagctgtatttatatttctgtaactcttagacttgccttggttaaagatttacagtgtttgatcttcatgtttattgtgtatgcaaataaaattgactttatgggtttggaatgaattgctttttgcctgaggtgaagaaaacggtgagtttttttctgtgcttgaatttaattggactttgttctttgcccagtagtaaaaatagattttttttttttggtcatttgctatgttgttttcacaaaaatattattttcagtgacaggacatattttttgttaataattctgtataattttattaataattgcttgtttacttatatagaaatattttaatataattttgatactttcataagagaatatttactttcatgtgtatttaaaataattctcagcctttcatgaacgtaaaatttggacatagttatcagggatttcattatcataagatcattaattgtgatttaattcagtatattttgtattaataaacagaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgtaagtattctcaagttgaatactgatttttctcagtggaatgttctttgctagtatactaggctatgaattttaaattatgaaaagactgttgagttagtttttcagtgttttattaggtgtcgaatctactaatcgatcaaaaagtactattccaatttaagattccaataatttttattgtgcagcactcagaattaaaatcagtacattttattatgtattgaattatacatgataaaaattatgaataagccccactagttttccaaattcagatcaggagcttattctagttttttatttaaccacagactaagataggcaaagagataatgggccaccactgcttcacctgtaaaagatacacatagaacagtgtggccattggaaatgggcccggaacagtggtcatgctgccattactctcttccaaaaagatgttaaatctctaatttcacatttttttttcctttgagatttcacttaagcctgatactctcttcatagatcagagaatcagattcttactcattttataactttagacataaaacctagattaggattcaagaaactgatttaccaaacaatttgttttatggattttgtttaatggctaaactaacatggaattcctcctttgttccagaaaagtaaattcattttaaggtgaatattttttcatcctgtatttaatattacttgaataaaaaaagaaatgtacttgaaataatattttaatattaatacttgaatttttgttgaggaggccaaataggctatatggcatataaaaaataaaatgttatcttttaaaacttttgtgatttgggatgttccatgatcatcagtcctttgtcttcaaacaaaactaacatatctctaaaggagaagtaagaaataatagcttctctaaatactgtttcttcagctactatcattattgtcattaaactttaggagcaagccattgacagagaacatgagagagatgtattccaacaggaaatacagaaactagaacagcaacttaaggttgttcctcgattccagcctatcagtgaacatcaaactagagaggtaagaacttcactgatattgcccaacttacagtaatttgtatcaagtgtaaaataagatgcatatcattaaaaacttaaaagtggattctttcctttgtatgtaaatcttcaaaatcagaaaacttaatattacttaagcatgagaaggtaattaaccctgaaaattgttggtattgaaatttggaatcatttccatctgcatatgtcttctagtatttctcaattaaataaactctgtttatttctttattcccattcctaacaaaagtgatcaagagagttatctgtgttcactgtttactttcccatttccttttctcttactagtccactccagtgaagtatccagcccttgtttctcagtagggttataccttctactccatttaaattgttcttgtgaaggtgacccagagcctcatggctatggctaatatccaactctgtctccatcctcctcaaccattcagaggcatttattgcagccttctcccagaaatacttccttctcttgtttctgtgacacagctactccactggtctctctcctctagtctttgtttctccttttcctacccagcataaatgatggagtgccccaaaacttactcttgggcccctttttatttcctatttatagcctcttcccaggcagtcatatataaatgcctccacatttgtatttctatctgtgacatttctgttaagttccagcattggatatccagtgcctactctgtctctgcttagatgtctcaaaattaacatgtccaaaagaaaggtcttgattcctgattagccactaccagagaaagacaagcataaaacatttttcttcttcatctcagtaaattctgtaccttctaacctgccccattgctgagaactagaatcagccttgattctcctttctctcaacccctgattccaacccactgatgggtcagactgcactacatctttctgttatttgcacttttattcatcttcctaaatcccacttgtcacttgtttgcctggatcactgtggtagcctcttaaccagtctccctgcttctcctttttcaccccaactgcccattttcctcatagaaacatagtcaaaactccacatttaccaaatgaatgctacataaatgagagaggattcactgtatgaatacctaaagatggcttgtcatggtgataaagacattgtgcttagggtaaggcaatcccagtttgtatcatggctctgccatttactaggttatgacaataactaagtcagttaacctctcaaatctctgttaattcatttctaaaatagagattgtaatagcacccacatcataggagtgttgacctggcacatagtgaacactttaactagtattatttctgaaacaatttttatttcgaatgtaatttctaaacagttcagtggatttcatttctcttaaaagaaagccgaagaagtacagagtgccaataaactccttataataaaatgttgtatactagagtagtacaaaagttatcagtctccagggctgggcgtgatggctcaagcctgtaatcccagcactttgggaggccgaggtgggcagatcacgaggtcaggagatcgtgaccatcctggctaacacagtgaaaccccatctctactaaaaatacaaaaaaaaaaaattagccaggcgtggtggcgggcacctgtagtcctagctactcgggaggctgagacaggagaatggcatgaattcaggaggcagagcttgcagtgagctgagatcacgccactgcactccagccttggggacagagcaagactccgtctcaaaaaaaaaaaaaaaaaaaaaagaaaaaagttatccacagtttctagttattgccccatttctgacaaacatatttttggcttttaaaaagtagtcgtttgttgtacttcaaagaatatttaagctctagaacctaggctgtcatctcctattatgtagttttcttttatttgaaaaggttggcctgctttgctcatgaaactttaagaaactaacaaagatgtgcatgtttgattttttttttctactgttgcaccattttattgtacctacattgttgccttttttcttaaccttactccaaatcttagtcaacttattattattaaagtttctcctcagcagctttttttttccttttttttctttttccctttaaaactgactgcacatatcagtgactttattgctatcatccttgaacctgaaattatagttaagcttgcattcttttaatgttctgagaaataactgtcattttttagataatttcctcagaatatttcactgaaaagaaaaggtagaattactttatttcttaccatcacatgtcgctttttttaaagtaagctttccttcctcactttccatacagtacaactaatccttcctgtcacagaaccattcacttgaagggatctccatatcattcttagggaataggtcttggcatgcatcattattttggttaaaggagaaaccaagactagagacatttagggaaaccttcaaggtgcacagatccctctcacaccccttcatccttagctctttcctgggctgatggaatgtatagattgaaaaagctttcccaatgactgttttcaaaatatagtccataaaagatttatttaggtcattttatctcatacaagagtaaatcagtacctgcaaatttgtcatcttcattaggatttagtgtggttgtgccattagataattcagccttatgaaaaatccattttttcccctcttcctaggtggagaaagtcttagtcttaagagaaagattttttaaaggattacgtgaaagcaatattacttgtggtctactagtgttgcttaattttttcaacttgtaaaatgtcacctttgttggagacaacagttgctatctttatacaaagttaaattagcataacatttaaaaatactttttagaaaaaaatttttgaaatgaagatatgttttatatgcattgagtattctttaaaatgcttgagagaagtgtttcagatttcagatattttgaattttgtaatatttgcattatacttacctattcagcatcctaatttgaaatgtgaaatgctccaatgagcatttcctttgagcatgatgtcagtgcttaaaaagtttcagattttgacctgggcttgttggtgtgcatctgtagtcccagctactcaggaggctgatgcaggagaattgcttgagcccaggagtttgaggctgtagtgcatgacgatcgtgcctgtaaatagccactgcattccagcctgggtaacataatgagactccatttcttaaacagacaaacaaaaacgtttcagattttggagcattttggattgtagatatccaaaatgagggataactcaacctatactaactagcttgctgaaattttttttaaattaaattttttgcctcttatatttcaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtgtggcattttatttgggctaacttaataagtgttttaatgaagaatactcttaaattgtcaacttcttgtaggtattattacatattatgtttatatctctgttgacattgtaaccatttctgtttgttcttatttccaaatgttgcttgcatgtcttagtcctgagaagggaagagttttttgttgttgttgttgttttgttttgttttgttttgttttgttttgttttgttttgttttttggagacatagtttcgctcttcttgcccaggctggagtgcaatggtgcgacctcagcttaccacaacctccacctcccgagttcaagcgattcttctgcctcagcctcccaagtagctgggattataggcatgcgccaccacaaccagctgatttttgtatttttagtagaaacggggtttctgcatgttgatcagactggtctcaaaatcccaacctcaggtgatccacctacctcagcctcccaaagtgctgggattacaggcgtgagccatcatgcccggccaacttttttattattcactaattagaagtagactttctacttctaattggagaaacaggattgctgcttctcaaaaaaaaaaaaaaaaaaagcagaccaaaaaacaaaaaaaaactggataatcaggatttaatttatcaaattttgagaaaatttttatatatttaaaggtagaggaccgaaaacactttggagctgtagaagctaaaccagaattgtccctagaagtacaattgcaggctgaacgagatgccatagacagaaaggaaaaagaggtaaggagtttatttttaaatgacacagcgtggtttgaattattttaaatcagttaccttgaaaatattatttgaactgaatgtagtttatgatctaaaaccaaagttgaggctgtttctcagctcaatgccaaaattgaccttgaaggcagtaaacatatgagtaattaagctgacgggaaagaagagtgctccagatagagagaagagccagtgtaaaggccttgaagcaggacgaagttcggaggaacaggaagaaggccagtttagcaggagtgtagagggtggagagatatagtagtgttaggacaaaaggcaatatatcccttttctcctaaccgtagaatacatattgaattattgctgctttgctgtgtggttttttttttttttattgtattgccctgggagattatagtcctgttttacaatatacagaatatgttcttaaaacaaaaagattaatagtaaattgctttaatagtaaagcaattaagcaattatataaagttctcctttgtttctctgccccttcttccaaaaaactaaaaatctactttcagaacaatggtcacctcaacttcctaatttataacttatttaagcctttgtctactaatagtttttaaaaaacatatcctactctatctacattgtctagctatatcttatcatttaaaatgtttaaaatttttaaaattacatttttgtctctaatattctgagaagacttactatattttaacaaatagttatgaacttaagctgctttgaaaaatataagaatgatttagatatcagctaaaactatagttcagaaaacctgtagattagaggagaaaaaaggcatctatgtaagtgactgtagttgaaatcatttccatgagaaggattattttctcactatcacataatactgagtaatgtttacctgagaggctcttatttattttgacttttgattttttttattggaggtggggagcatttttgtttatatgtaactatttctgtgtttcaaagagctaacatttaaagatttcccttaaactgagtaaagtaatttatatgttgcctaaaaagacagaccttctcaactggacccaaagcaatgatagttgactgtggataattgattaaccttactgattttatatttttattatcttctgaatataatatagcactgctatcttgaattaagtatctaataactgtctaccttttactcagaatcatagttgttcaaaactatgagaaactttagagggcatctgtcaactgactgatgttttttatagataaggagagaaacggtaaatgagtaagaggttaaactgacagctgaccctaataacagtaacaagtactttatcaaaacccattcacctaccataactggagactgagaggcaggaacatagaattaaaatgtattttattgaaaataacttcttaagcattttttccccagaaactaggcaaatgctttcagatatctgatggagtataaatataagatgtccctatgtatcatggtatttgagatacttttctctcagagcctaaatttgtataaaacattttttaagcttattagaaatttagaaatgcaggatgaataaaaagagaactctaaaagaaaggagttttagaattataggaggaggtagaaaatggggaaaggaatagaaggattttagaaaaagatacgttccataggttttagctctctgtagagctaatgagatctagcttagagttagcaataataaataataatagttttgttgaggcctatctaattagacagtactaagtatttaaatgcccttttaccgttaacactttcttcccgaggacagactctgttatccccattttacagatgtgtaaactgagccttaagggaagttaaataacttgatcatggtcacaccttaagtggttgaaaaggagttcctctcagatttctgtgagtctgaagcccttgtgatactatactgccaaagcattggggcccattttgtcttgttggtgagaagtgttaaagactgccattcaacatttagtgagctcttaatgcacctgtagcaccagtacccaaatgtaaaactagcggtggacgtcaaggaatctactgtgtaattaaggagacatatgtacatttgaaagagataaaaacactttttaaaaaaggaaacaggccaggcgtggtgactcacgcctgtaatcccaacactttgggaggccgaggtgggtggattactaggtcaggagagcgagaccatcctggctaacatggtgaaaccccatctctactaaaaatacaaaaaaaaaaaaaaaattagccgggtgtggtggcgggcgcctgtagtcccagctactcgggaggctgaggcaggagaatgctgtgaacccgggaggcagagcttgcagtgagccaagatcacgccactgcactctagcgtgggcaacagagtgagactccatctcaaaaaaaaaagaaaacaaaaatagatgcaaattaatccaaacattaatttcaattattagataaattaaacaagattaaaacaaatatttaccagcctttgtttttaaatcttaataatgttcttctggttgtaggtggttacaggctcaataagaagagagcctagtactaaactagagcctgactgaataagaggaaagaatgtcccatagtgtcatttgggggaattgaagtgtctgatatgatgcctgaacttcagctacttagaataggaaagttagtgctttagaccagtgcatttcaaactttaatgcacatgcaaatcacccagggatcttgttaaaacacaagtcttacacaaaaattaactcaagatggattaaagactaagacctaaaaccataaaaaccctagaagaaaacctaggcaataccattcaggacataggcatgggcaaggacttcatgtctaaaacaccaaaagcaatggcaacaaaagccaaaattgacaaatggcatctaattaaatgaaagagcttctgcacagcaaaagaaactatcatcagaatgagcaggcaacctacagaatgggagaaaatttttgcaatctatccatctgacaaagggctaatatccagaatctacaaagaacttaaacaaatttacaagaaaaaacaaccccatcaaaaagtgggcaaaggatacgaacagacacttctcaaaagaagacatttatatggccaaaaaacatacgaagaaaagctcatcatcactggtcatcagagaagtgcaaaccaaaaccacaatgagataccatctcatgccagttagaaaggtaatcattaaagaggaaacaacagatgctggagaggatgtggagaaataggaacacctttacactgttgatgggagtgtaaattagttcaaccattatggaagacagtgtggcgattcctcaaggatctagaaccagaaataccttttgacccagcaatcccattactgggtatatacccaaaggattataaatcattctactataaagatacatgcacacataggtttattgcagcactattcacaatagcaaagacttggaaccaacccaaatgtccattaatgataaactggataaagaaaatgtggcacatatacaccatggaatactatgaagccacaaaaaaggatgagttcatgtcctttgcagggacacggatgaagctggaaaccatcattctcagcaaactatcacaaggatagaaaaccaaacaccacatgttctcactcataagtggaagctgaacaatgagaacacatggacacagggagggaaacatcacaaaccagggccttttagggggtgaggggtacaggagggatagcattgggagaaacacctaatgtagatgacggattgatgggtgcagcaaactacaatggcacgtgtgtacctgtgtaataaacctatgcattctgcacatgtatcccagaaaagtataattttttaaaaaagattaaaaaggaatatataatagagttcatttcctatctgattactgtaaaacaataaaatgagtcaaaaattaaaaaaaaaataaaacacaagtgtggggtgtgacatggcattttgcacacccagcatgctcccacatgatgccaactctactgctctcgagaccacactgaatagcaaggcttcatgtcacaaagttaagaaattgatcataaactgttgtataaaaaaaggaaatttcgtatgagatagggcagcaatttgaacttaaataactatttatgtgttgattttaaaataataccttgtcatcaaagtagttacagaaatgtagggatagttgtaaatactatgttaaatcactttgaagaagatataatcattgcagttttcagcaacctggtaattatttatgttcagtcattaaatgtatttcagtgtctactgagtttaataaccagtgttacagaaaaaattttaagtgtaagtcttagacattagttattagaagcaggataagtgatagtttagagtggaagattcagagataaactcctcaggttcaaaagctggcttctccacatactcgccatgtggcctgaaagcaaattactcctctctgtgacgtccatcctcatctctaaaatggggatactcagaacagatcttataaagttgtaacagggttttaagaaataatacatataaagcactttgtgcagtgcttagcggtaaactgttacaagtgatggctgttactactagtattgatactgtttaggaaatactaagctaactggtttttaaggatttgccagtgttcagatatggttctcagtatgtgatgtgttagtgtgtaatcagcgattccctctttcagtttctaaggcagtaaatgattcataagctgctttctgagccacttgtcactaagtgttgctgaggataggctctgttgccttagataacagagatgctcctgcatcttagtttgctttttgatcagcagttttgatcatgaggtaaatacacatttggaaatcattcattcactttgtattaagtagcaacaaaccagtgagctaaatgaatgttactgtcctcagtcaaaaccaattttcaaatataaaaataattcttaatattcatcattcgtttcagtctctaaccatcaaaaagcagttgctttaccattattcataatccatcctcaaaatgattaaataaatttctgttgtcctacctataggagctctctaattttctcctgaattgtataattcacttactctaaggtttttgtaattcagacctaaggatctcttggtcttagtttctatcttggcttccttctgcttaacaaaccacatggcagccaggccttttagtaagttaattagatatttttggactaaattgagttagtcttatatggtggctaacaaaacaaacagttctacaacttttctaggccttttgatagcaacttaatgtaacataaactaagatttaatatgtggactctttcccttcctcctatgactcttttctgcttcaggagaagagactaaggtaggaaatggctccttttatccttcctcaggaggtttcctctctgctttgtgtaggatagtttaaggatggccagtttgagcatgtctaggaaccacacaggtaacacagattatacctggcttagaaaaaccacattcctttattcttatgactcatgttttaagcatgcatactttgtaaagctaatatagcactcttcattttatcttgataaacgtttgtataaacattttttctcttttgataattttgttattaaagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggtaattagttaagaaaaacttttatctgtaaataagtcatagtttcagtcctatattgctttattattattattattattatttctttctttttttttttttttttgagacttagtctcactctgttgcccaggctggagtgcaatggtgtgatctcggctcattgcaagctccgcctccctggttcaagcaattctgcctcagcctcccgagtagctgggactataggcacgtaccaccacgcctggctaatttttgtatttttagtagagatggggtttcaccgtgttagccaggatgctctcgatctcctgacctcgtgatccgcctgtcttggcctcccaaagtgctgggattacaggcgtgagccaccacacctggcccctatattgctttattaagcattcgataaatccagctgttaaataatactcaacagaggaacattaacaggcagacacatttgcatacagcttattttcagcccaacctgaacatttgaattcatcataaatgaaaattttgggatcatttatcaaaatattttagaattattgatttacagtaaccatatggtgtctctgattttattcatttgtacgttataggctctgatttcttttgtaattatgttctgaaaatgataggtaatgatatatccaactgtgataattatttttgttcctaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggtatactcatttaaaattgattatgaaattaatatgaaccagagttttaaagggcaaaatggttataatgttgctccccattgaatttaaaaaacaaaccaattttattttattttattttattttatttattttttttgagacagaatctcgctctgtcgcccaggctggagtccaatggtgcaacctcggctcactgcaacctccacctcctaggttcaagtgattctcctgcctcagcctcccgagtagctgggattacaggcacccaccatcacacctggctaattttttgtatttttaatagagatggggtttcaccatgttgaccaggctggtctctatctcctgatgtcaggtgatccacccacctcagcctcccaaagtgctggtattactggcatgagccaccacgcctggcccaattctcttttattaattttaatttattaagacacattggtggccaggcacagaggctcacacctgtaatccttatactttaggaagcctaggtgggcggattgcttgggcccaggagttcaagaccagcctgggcaacatggtgaaactttgtctctacaaaaaatataaaaattaactggacatggtggcataccacctgtagtcccagctgcagtgagcctcatcatgccactgcactccagcttgggtgacagagtgagaccctgtctcaaaaagaaaaaaaaaaaaaagcaaagacacattggtttaataatttatatgtatttttctcccctcctaatattgtcataggattctaatgtttttcagaaaggctctgtgacttagattttatcatgttattctaaccaaatctattataaattataatatttaatatgagttaagtaaggtaattacctttggtgccatcggttgtagactttatttccgtacttcatccttttccattaagaagtattgatattgactattttcctaatagggaatcagcaactaaaagcttatattactttatacttaacagaactttctgagccttgtttgatatgatgggggagatattggtctataatgaaattaagtagtatgtctgagaagtagtgtattatttttgtgtgtgatcatctctttgaggtactgccctaaaataaagtaaaattttcaaaatgtaaatacatatatattatgtatgttacctttttcattaattattaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaaggttagttttgtattttattagtttcatttaaataccccaagaaactaagctgattgctaatttactaaatatggtgttctgtttacatctaacaatttatacaagaaggtttttataaaaatataccacttataaaaaataaactcttgttaaaagaaaaactaggacaggcgcggtggcccacgcctgtaatcccagcactttgggaggccgaggcgggtggatcttgaggtcaggagatcgagaccatcctgtctaacacggtgaaaccccgtctctactaaaaatacaaaaaattatccgggcgtggtggtgggtgcctgtagtcccagctactcgggaggctgaggcaggagaatgctgtgaacccgggaggcagagcttgcagtgagccaagatcgcgccactgcacactccaacctgggtgacagagcgagactccatctcaaaaaaaaaaaagaagaagaaaaactagacaaactaaatttacgagagtttatttgaacaaaaaaggattcacgtattgggtagcattcagaaccagaggagtttcacaaatctcttttgtgcaacagtggccagtgaatatttatagacagaactaccaaataaaatacagaaatagcttgattagttacagttaggtgtttgccttatttggacccagtctgctcagttgactgcttgtcattagctaagagttggctgtttattatactcctaagatacgttttcagtttgcttacgtactcctaagttagattgtagttccttacataggaactcaagatacagagacagcctcaggccaaatttaacttaacactgtgtagtcatattattatcactaaaataatggatacagactgtattttatggtctttaaatatgatatttatttcattaacatcatcattaaatggagcagtcagaagaaactaagaaacattaattttagcaaatgttctctaggatttatggggatttttttcttaatttgcttctaatatgcatgttatgttatcattccttttaagtaataataagtatgaaaatatgttaggattgacaaagaatgcagactttacagaaagaaatctattatttaatagcatctactgaattaattaatgtgtgggtgacatattttacaattttttttttttcttgagacagagtctcgctctgtcgcccaggctggagttcagtggtgtgatctcagctcactgcagcctccacctcctgggtttccagcaattctcctgcctcggcctcccaggcggctgggattacagacacgcaccaccacacccggctaatttatatatatatatatatatatatatttttttttttttagtagagacgaggtttctccatgttagccaagctggtctcaaactcctgacctcaagtgatccgcctgccttggcctcccaaagtgctaggattacaggtgttagccactgcgcctggccagcttttacaaattttatacctgataatagatttcatctgttttaagtaaaaatgcgtagttgacctctgtaagtttacttatgagaagatctgaaatcgcagttatttcttagcatatgacagataggacaagagcttttttttcctccaaattctcaccttataaatttataactttgagtagctgaacttcagtcttctccaaacaccagaagattaactgataaatcacaattctataattatatattttgcaaagaataataattccctggctttttcctccttcattggaactaagttacttaagttatagataattaaaatagtaatataactttctttttttcctggacacagagtcttgctttgttgcccaggctgaagtttagtggcgcagtcttggctcattgcaacctctccctcctgagcagctgggactacaggtgtgcaccacaacacctggctaatttttgtattttttgtagagacagggtttcgccacgttgcccagactggcctcaaactcctggcctcaaatgatctacctgtctcagcctctcaaagtgctgggattacaggcgtgagccaccgtgcctggcctaaaatagtaatgtaactttccattttaggatgtatatgaataacattacttaccttttattcccagaaaatcattcttttctcaagaagaaaatcattgtctcaagaatataagatgatggttctgaaaaagcttctctgtttttggaaagagcattgatttgttccaactccttatatctgtaggcagtcattccttggatggttttattagaatgtataagagccttgaatttagctatattttttttaaattatgtgtttcttgtgtttccgctgtcattcagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaagataagtaacatagctcctaattcactcatttctacctatcttaattacgtttcaaagtatatactcttttataacaaatgagctccataacttaaaagctagataaaaagtattttgtggatttgatgaaaactttcattgttataaatttctttaccaacatcttcttgcttggttttcctggaaatctttcttaggaggatactttttatttccattctgttaatgaaggagtagaaagttgttaaagagaactgtatatcccatgagaaccaaaaatagaagctaataaaattatttcatttctatagtaatctatgaccatacgtacatacaaatatatatatgtaaactgtgagcgtttctgaaatgtttttcctactactctgaggaaaatgaacgtataatcatgaattacattcctcccacaccctttaaattctacatttaatatgggaagattttaactgaatgccctactgttctattcattacgttttaggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagaggtatttggtttttataatatgtgtttttcaacattgtgtggttttttaaaaaaaaaaaatcagtttaattcattttgtagatgacaaaccaaaatgcaactcattaaggcacttgatctttctaagtaggtgtattatcaaggcaagttttaaactcctagtacaatattccttttttttcttttgttatactttaagttctgggatacacgtgcaggatgtgcaggtttgttacacaggtatacacgtgccatggtggtttgctgcacccatcaacccgtcatctacattaggtatttctcctaaagctgtccctcccctagcacctcacccccgacaggccccagtgtgtgatgttcccctccctgtgtccatgtgttctcattgtttaactcccacttatgagtgagaacatgcagtgtttggttttctgttcttgtgttagtccgctgagaatgatggtttccagcttcatctatgtccctgcaaatgacatgaacgcatccttttttatggctacatagtattccatggtgtatatgtgccacattttctttatccagtttatcattgatgggcatttgggttggttccaacactgtgtgcttttaagagaaaataaaaaaacgggggcagtctcttccttatgatcgcaattttaatggttttgaacttttttaaatttaaagagtttttagttttaaatttctttaaatctttccattgcatagagttaaataatatatgatgttcctgtatggatttggaacatgttatctttccttaattcatgagtatctcttcttatggtaatattcatgaagaaacagacttgttaaaaaaaaaaaccatgaataatttcatttattatgaaaggtgtgacagatttgattgattacagcacgggaaaccagcaaaataattcattgtattctatttttattaaagcaaaaaatatatgtactttttgttttctctaattagggatcctcaattcctgagctagcacattctgatgcttaccagactagagaaatatgctccagtggtaagttatataaatatttgtaatgtttgtagtagttgtttaagaaataatagttttttggggactggggtttgatttttttttttttaacagcaaattattttctttattttagattctggatcagactggggtcagggaatttatcttacacacagtcagggatttgacatagcatcagaaggccgaggagaagaaagtgaaagtgcaacagattcctttccaaagaaaataaaggtactaaaagatagataccttttattaactcagccagtgttgtttctatgttgaacatagcagttcattagaagttatatggtgggatcatttctgaagagagaattgcttagctagaaggaatctgagagatctattttatttccacatttcacagataataaagtaagagattaatgataatatgtatgaagactttttttcttaataattcttattcctgatgtattcgtttgccagaatttttaaagtagtctcaaagagtagaagttagagcccatgtatttattttggtcaaatcagtagcttatcagtaaacctaggaagagtacattagccaaacagaaggaacttagagatgagagctatggaaagtcataggccatctgctggggttggcttacccctccacaggaagaaggcattcagtaatgttgggctggagttttctctctgcaagctatcttgcttaaaatttatttctgtttgtaagtctaatttttcagtctgtgaagaagttgtcataattctggctcttgggttttggtttccagggattactgagagctgtccataatgaaggcatgcaggtgctttctctcactgagtctccctatagtgatggagaggaccattctattcagcaggtttcagaaccttggctagaagagagaaaagcttacatcaatacaatctcatctctaaaggatttaattacaaagatgcaactgcaaagagaagccgaggtaaccaaagaatactatgcatttaaatcattttatgtattatttgaacaataataatacattataaattaaattatcttttatacatatttttgcatgaataactatatatatatattttcacacttgaaactcagccagaagcagtgcctcatgcctgtaatcccagcactttgggaggccgaggtgggtggatcacctgaagtcaggagttcaagaccagcctggccaacatgttgaaacccgtctctactaaaaatacaaaaattagccaggcgtggtggtgggtgcctgtaatcccagctactcaggagaatcgcttgaacctgggaggtggaggttgcagtgagctgagatcatgccactgcactccagcctgagcaacagagtgagactgtctcaaaaagaaaaaaataaataaataaaagaagtacacatgctcctaggcttttaattatttttctttgtagattaatatttttagaatgtttttaaaacatgcttatttgaaaactaactatcgttatatgtactttgctaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacaggtataatgaaacttcattttaaaaacactttaatagaaataaggaaatgactattgattttagagtcttaatttaagtatgaaggttaagattttaataggagccactatgaatattttaaaaaaattattgtaactattttaacgtattatgttagaaggtaagaaagactgaaagttaatgagcttattttctaacctaggaaattagaaaaagagcaacagaataatcccaaacaaatttgagagagtaaattctcattatttgcactggttatgttccataaagttgctctgaacattgagcggtcattgctcctaagggaaatacaaggttaggttcctgtaagcctttggtcacaacattttcatcagtcagcacataaccttgtctatatgtgattctattttaagacaccttatttactatatattattgattgattaaccttgaacaccaccaacagcactataactcatgcctgaaaaaaacttgtctgacacacatattttctccttaaggcacatcacagccttctcgtacttaggaacaccataaagcacttcagcactacttttgggggccattctaaacagtgaaatcacaaataaaaggcacaaaaatttgaaaagtcactaagtactctgtaaaaaggacatttgacttcagctggggacacccacattggaccatttaaattttttgctgctgtatgcatttctgtgaaagaccatgaaagcaacacaacaatggatttgggagttacaaatacattttagtgagaaggcaaatctgcaaatatggaatcagaataatgaggattccctttaacgaagaagacgacgtcaatagacacactggtacaataggataaaatgttaaaagttggacatttgaacttttctggagaattggttaagcaaaatgataaagcacacatttttaaagttaggaatgaactaaagatatacctgagatataaaaataatagaatattatgaataatttcatgagagtaaacttaaacacttgggtgaaatggacagattttctaaaaagaaattcacttatgaaaactctttcagtaagaaatagaagacctccaaagacctattactagtaacagaatcaaatcaatagttaaaaatctactcataatacttaacacccagatctttttttttaatatattctccactgaaaagaactaggacttcttgtagaactgatgattctagggatggaccagggaaagtataaggtgagcctggaacatcttgttttgctggcaagtaaggaattgttcaaagaatgaagggaacatgtcgaaaggtcatagaagccagcttgaaggagctccaattgaccaaattctagaaaaatttaaacattatattaaatgatagtgacaaattataagccaaagagtgaaataagaactcatgagaccatactgatataaataaataaatatatatataaataaataaatagtattaccatggaatgacagctagtaaatgtagaaggaacaatgaaattaggaaatcaccctttattaaacactgtagtgttaaatcaccctttattaaacactattcaggcaatagttcgcaacagatgctaaaactagtgtgaaaaggtttgttaagaaagtatatttacatagtctcaaagtaaatccccagaaaatcttctttaattaccagggaaaagcagtaactttacagtggagaaaccttgcagataccaccttaaccaagtgatcagaattactattaccagaaatggaatagacatcatacagttcctaatgtgaagggcacgatgccacttttgtagtgtttttgtcaaatgaatattcagagtctactcttggggaaatatcagaccaaaacaaattgagaacactacatctatcaaaataaaaaatagtgacagcaagtactggagaggatgaaaagaaactgtctcatagattgctggtagcaatgtgaaatgggagggcaatagccaaaaactggaatgttctttgacaggggaatggatggacaaaatgtggtacatccatacaatgaaatattactcagcaattaaaaagaaacaaactatttatgcctacaaccacttgtatgctatataatgctcttaaaatgacaaaattatagtaatagaaagcagatcagtggttgacaggggttagggttagggagagagtttgactacagaggagtttcttcgtggtgagaaaacagttggtactctgatggtagtggtggttacgtgaacctatccatacatgtgatcaaattttgtaggactacacaccaagaaaactaatgatcaaattttgtaggactacacaccaagaaaactaatgtgaaaactaatgaaatctgagtaagccctatagtttggtattgtactaataccattttcctggttttgataatatactatggtaatgcaagatggtatcattgggaaaagctggctaacagatacatgggaactttagctttaattaattcaaaataaaaagttttttaaaattgaggaacgtacaacaaaatagcctgtagtcttcaaaaattcaaggtcatgaaagacaaagaaagacttgggaatatcactttttttctttttgctgtgaagtacatttcacaaaatttgaataggctctgtatatcacataatagtattgtagtaatgttaattccacttttgctaattgtagttatgtaaaagaatgttcttgttttaaggaaatacactctggtatttagaggtaaatgagcatttgtctgcagcatatcctcatacattttggaaaggaaaaataagaaaattttttaaaaaagaaaattttagtatgtgtgttccattcattcttctttagatttcttggttgttaattgtattgcctttacattgctcttcacttgttttttaccttcctttgttacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaaggtatgttgtatgacaagctcatatggttacacaaacaggtgaaaagatttcactttgttttctttcttattattattaagttaaaacatattttcttggtcacattttcttctcattctcataatgttaaggatacaatctatattaattactctaggggttagaggattgtctaattggtttaaacagctacgttgactttaaaataaactgccattcccctgataaggttaagcccattggattcattctttttctttattttagagctgtatgttaagaaaacagtctttccaatcataaaacagaaaatactctttagaggaaaatccacaatgcatgtaactaattattttttaatccttttttaaaaaaattgtgagccataacatacagaaaattacaaattgcaaatatgcagtatgacgcatttttaaatgagtatctatggaaacatcacccatgtgaatatagccagtatcccaacagccccttctcccaagcacatgctcctctgagtaacttagaggtaatcattgttctgatttttctttagttttactatctatttatatattcctaaaacatttaagtttcaagtttttttctgtttttgaactttatcaatctgtatgtattttttatcttgtttctttcacctctctgtaacattcttccaacattcttccaagttactgcatttttcaagttactgcattcttccaaattagtagtagaacattcttccaagttactgcatttatctctagttcattcattcttgttactctataactctatgaccctgtgtagggccaggcacggtggcttacacctgtaatcccagcactttgggaggctgacgtgggtggatcacgaggtcagaagttcaagatgagcctagccaaaatggtgaaacccagtctctactaaaaatacaaaaattagccaggcgtggtggcgggtgcctgtaaggccagccactcaggagactgaagcagagaattacttgaacccagaaggtggaggttgcagtgagctgaaatcacaccactgcactctagcctgagcgacagagcaagactccatctcaaaaaaaaaaaaaaaaaaaagaatttcctgtatagatactccaaaattaatatatccattctattaatatgattgagcatttgggttgtttctactttttagctgtttagctatcaatgttattataaacattgttgtatagtgtttctgctacatatgtgcatgcatcttctgagtatatgactaagagcagaattgctgggtcatggaatgcctatcttagataaggtcaaatgattttcctacatagtcatattagtttatacacttagtagcagtatatgagagttacgttgcttcacatctttgccaacagttagtatagtcagacttctgttgccaatctgatgggtgtgcagtggattcttattgtggttttaattggctgttctctagttcctgaagggtttagtcctttttcatatggtaattggctagttggatttttatttttgtgatatgcttgtttaggtactttttgataacagtatctggtcttttaaattgagctacagatggaaatcattagaaagtaaagtgaaatctaattttcatcatgtccactgaggacacatacctgtgtgttcagtaattttgtgtcatgtactggtagaaacatgtatcctttggaaaattttgaaagtcacagcatggtctcacattggtcattataaagctgaagcaggctgggccctgtggttcacgcctgtaatcccagcactttgggaggccgaggtgggaggatcacgaggtcaggagtacgagaccagcctggccaacatggtgaaaccccatctctactaaaaatacaaaaattagcttggcgtgatgctcggtgcctgtaatcccagctactcgggaggctgaggcaggagaatcgtctgaacttaggaggcagaggttgcaatgagttgggatcgtgccattgtactccagcttggacgacagggcaagactctgtctcaaaaaaaaaaaacaaaaaaaaaaaacaaagcagaagcattcttaccactgagtttaagaaggaaaaaaaaaagcaggttaaaattacttcagaaaagagagtcataatgagataaacatatcactttaaacgtaggcgtaattgaagatgtcttttagagatagattaatattgttttacttaggttaaatagaacaccattgaaagcttaatgtcacagattcacatttatgtaaatccttaacctctaaagtttttagaagcctaaattaaacatgattgattatcatctaaagctaatgttatttctgtctcctaacgtcagtaatatgaattgtaatgtgaattgttgaactttgatagtattttttaagttaaaaatgtttttcttattagagtagtatagtattacatatttatggtagaatacagaaaagaatagagtgaaaatcatcccttgaatcacctaaatcctaaaataatgactacctaacacctgggtaaatatgtctccagaccttttcaatgtgcatgtgtacataagcttgtatttttcataaaaaaggaatcctgatacatattttataacatactttttttcatttaacatactgaggcatttaaaattttcagtttgtttttattgtagcaaacatgtagtaagggtttggttggctttcaatggataaaaggacggtatccaaaggggggtttgaatttcccacttctgggaacagactcctattaaagttccaggggactatctgcagtggggtgctgaacaaaagatatcagcagtgctcatcattgtagtaacttgggtaactcctccaaatactttgtgtgactatcagaaatctttggaattttttaatgtacattcttgaaattctgaatgtacaaatatgagttccatttaaagtttttttttttaattttaagtcttgcatccattaatgtattctcttaaacttttatccttatatatttatagctctgaaatcttggccactagcactatgaggaaaacatgcctgaaatttatttttatacgttaccaaccctttttgtttgtttttttgagacagggtctcactgtcactgaggctggagtacagtggcatggtctcaactcattgcaacctccacctcccgggctcaagcaatccccccacctcagcctcctgagtcgatgggactacaggcacatgccagcacgcccagctaatttttgtatttttagtagagacagagtttcaccatgttgcccaggctggtcttgaactcctggccttaagcagtcctccctcccacctcagcctcccaaagtgctgggattacaggtgtgagccaccatgcctggactgcattaccaactcttgggactataatttttcatgtttcctttgaagtaatctccttaactacaaatcagttcttatcaacaaatatttataaaccaaatatgagttgcttgattatgtttcaaatattaatcatgttctgtgtagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggtgtgccaggcttccttattaaaaacatgtaacaaggagtgggagtaattttgtcataaacactgtgcaaatatagagaaatgtaacatgcatgatatttaaatagcatgcaactgttttttttaggaaaaactataatagaaaaaactctaaatgtttccaaatgatgaacttatgatcgtgattatagcatattctctactgtgacttcagttctgtgtgagacttgtatgaaatagaattttgactttgacctttattttaccatcaaccaatttgaagtgatatttatgaacgcagtagaattcatgattgagtgagctaaaatatgcaaaatatttgaagagacaatgcttgttaaaagaatatatttcttggtataaatactgagatattctgttgccaaagacacattacaactagtcatttttatattgaacattagcttcacacacaaatagatatggtgattcccatgttcagtaaaagacaaaaattttatttactttttatttatttatttattttattttatttttatttaattgttttgagatggaatctcgctctgtcgcccagactggagtgcaatggcatgatattggctcactgcaacctccaccacccgggttcaagtgattctcctgcctcagccttctgagtagctgggattataggcacccgccaccatgcctggctaatttttgtattttcaatagagacagagtttcaccatgttgaccatgctggtctcgcactcctgacctcaggtgacccacccaccacggcctcccaaagtgccgggattacaggtgtgagccaccatgcccagccaaaatttttattaatactattttgtaacaataaattgcatagttgtttgcattgataattaataactagtaattgtactactagaaacagttaatttgaagccaggtgtggtgactaatgcctgtaatcccagcactttgggaggccaaggcaggtggatcacctgaggtcaggagttcaagaccagcctggccaacatggtgaaaccccatctctactaaaaatacaaaaaattagccgggcatgctggcattcacctgtaatcccagctacatgggagggtgaggcaggagaatcacttgaacccgggaggcggaggttacagtgagccaggatcgcgctattgcactccatcctgggtgacaagagggaaactccgtctcaaaaaaaaagaaaaaagagggccgggcgcggtggctcatgcctgtaatccgagcactttgggaggccaagacaggcggatcatgaggtcaggagattgaaaccatcctggccaaaatggtgaaactccatctctactgaaaatacaaaaattagctgggcgtggttgcgggcacctgtagtcccagctacccgggaggctgaggcaggagaattgctttaacccgggaggtggaggttgcagtgagccgagatggcgctactgcactccagcctggcgacagagcgagactccgtctcgaaacaaaacaacaaaaaaaagaaagagttaatttgaaatgaaccccagtcaagaatctttaatagtttatattttcctcttagctagtttattatatgcctcaacttatcagtagaagctgtttttctctctctcattatatgcttcgtcaacatagctttatggaaattcatttgtctttctgacttaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggtactgttatctttgtctttaaatgtctggaaaatccagaatgatagaagagggtcttaaggctttcctccatctaaaatgtcaaccttagacttcttaataagatatggtaagttgttcactgtgcattgaatactacataaaccgtattatgaggaaatgctaatggagtggtgattggttttttttgtttgtttgtttgttttgctacatccaaagatgcatatagactgctctgctgcaacatgttttgggcatgtgaattggtacacacagataaatatggcaatcctgtcagtttaatacagaggtagttttggttcctgttttctcctagggaagaggaacagggatacttttctggagccctcactgcttaagaacatttaaagtgaacattggcccctttcagagagacacacccctgctttgcaaggctctcagctcaaggcaggctgctttgagtatctgcttttaatagaggtggagtatacatgaagtatctgcttttaatagaggtgttgttgtctcactggctcagagctcttctagccacgtaatcctaattctcactaactctgtgctgaaaaacaatgtgttgctggcatttttgcccgattttttatttttaatgtccactgtgttagcctccaggcaaagagaactctctgcccggcagggacatgatatctccctaggtaccaattatagttttttaaccattaaaagtttatgtatattttgagttatttgcccctaaccttgctttcgttataagccctattatttttagcatgtgatactgcaaaacacaaggtttttcaggaactcctatcacattatatcaggaacatttattttttaaacaaatttattaatgtgcacaggaatcttatcaaaacgtaagatctccaggaacagttatatttttaaaggttgttattcttataagaaatgtaccctgcttcatattacttagtgagattaagattttttgagaaaagtattatcttacccttcttttatttatatttcatgattatgcactaactactgaacatttaagttaataaactaaataatcagttctattttctaataaagatactaccaacatagtattaataaaggcatggttgtatacttctgaagttttttttgtttttttttttttttttgagtcaaaagtctcactctgttgctcacgctggagggcagtggtgcaatctaggctcactgcaacctccacctcccgggttcaagcaattcgcctgcctcagcctcccaagtagctgggactacaggcacgtgccattgcacccagctaatttttttgtatttttagtagagacagggtttcaccatgttggccaggctgggcttgaactcttgacctcaggtgatctgcccgcctcggcctcccaaagtgctgggattacaggcgtgagccaccacgcccggccaagtatttttaataatattaacaagttcttaaatttgattttctcgtaccaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgaggtaaactgacagtttctttttagatatttttaaggaaagcactgcagccctttgatcattaaattttgatattggattaaattacttaaatagctatatgtaaatcacttaaaaatgaaatctatagaagtttattggatataaacaataattgtgttcccttaagatagactgtgatatgctgttcacttataattattgttttcttattctgtccaaaattgccagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagaggttagacttttctgcctgatctttgggaaagtagtattcttaggctgggtagaccccatgcctctgggacagctagccaagggtggggaattgaaattttaaaggtaatgcgtgtttacattaggaggtgatattctttaacagaactcaaatgtctgaaaacaactatctaacactttgacccagggaagaaagcatgggatataagggagaagtgataggtgaagtagaacgtcgcctgctctgtaatgtttgtggtagtaaacacccccaattgagaaggtatgttttgactttttgtctttttcttgaagactacagtttgaaacagcagatgatgaagatttcatttgggttcaggaaaatattgatgaaattattttacaactacagaaattaactggccagcaaggtgaagaggtaatactttttaaaagttatttctgaagcattgagagcaaagatttaatagaaactggataatttgaaacttgcagcatattctttatactctttatagagttttatttgtatctttttatttattttaaatatgaataataatgcttgctttcccccaagagaagataatgaaagcttagggggggaattagctttcattattgtcattgaataattatgttgaccttttactgtatggagacaagcttcctgaaagagtgatctggcttctatcctgtctactccatgaaacacccttagactcctacagtgtctaaacaattgactagtctggtgaatcttttcagtttatctcttgacttctttgtagcatttgatacttttgacctgttttattttcttaaaaccctctctttccttgcctgtcatgtcagtattctagcatttcttctgcttctttcatcagttgcctttatgattcctcttcctaccctcttccttcttttctctaacctataactatgaaagctcacacagtccgacaccctgagctctcactagacttatttattaaacaaatacttatattgaacacttattctgtgccagataggttctggagatacagtgaacaaatctgactaaaacctcacccttatggagcttatctttagtggactgtggttctagtctagacttctgtcctgtgttccaggtttatattttcaattagttactaaacatttttccctggggaaatgtaccccatagtgaccccttaggaacctcacaggcacattccaaactgaacaccatcttccctttctacttcctgctccagaccctcatttctagtcatgatattgcccagtttagaaagctgaaagtcaccatagaccactttccttcacccttatctgcacatctagacagtcactaaatcctgtccctcttaccttctaaatacctctcccacacaccctttactttctgtcccttagtcgttgcctccattcaggctttcagcatttcttacctggctgttgaaacaacttcctgataggtctacctgactcgaagattatatcttccctaatttcccctgctttgtacattactaccaaaggaattttcccaacacataaattttgtgtcatatttttgcatcaagcctttcgtgactctccattgcctacatttaggtctgttattcataaagtgaagcaatctagacttaccaggcaacctacaacaccccgaaaacaatacacactcgctcaagccttcgtgccttttgcttaatatgcccttccttatcttttctgcctggtaaatatctacctattactgaatactcaactcaagcaccaattcatgaattctgttgttctcggtgcctattcacactttatatgcattattcacatccatttgtgcttaagtgaccttacaccattttatttttccagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataatgtatgtccatttttagcatctccatatatgagaattagtgcatgcttatcatttctgctgtctagttcaagttttaatcctgttaatgtaaaactatcacacacctgattcttaggatctgtagaaaattttatagggatgacaataataatattattactaagttataataattactgttatttattggaaaccatctctgtactcgactctgggttgtatacatacagaatctctaatccacatccaccttatacctgagaaaactgaattgaagtcgtagtcaaaccaagatacttgtatctccaaagccagatactttgctacctagggaccaacaacagatacacgagatgttcaaatgtgaatcctgactgttctcttcatttaattattagttattgtgttgatgactcaattaaaaggttctgttaaattacgtctttcagtctgaaattactctgagaatttacttaaaatttttccatttaaaaacaggtataaaattaattgctagtttccataatcacccagtataaagatagaaaagacctgtaagacaactgtgtggttaaatacatgataacacatttacgtgccttttatagaaatccacttattatgtacatactggcttgtttttttcccacttctccagtacactatttcaggcacaggctcaaaatttgaacccaaatggtctgttaggtctcttgactttttcagttcaaagctctgctaatctgctaaaccttccctgtggccaggctttctcaaggacttttagttgtaaaactaatgtacttagcaaaggaccatgtacttaagagttagtgtatatgcgtaatgtcaattgagattggctttgaactttgtctgggtggggttagaaagttgagactgcatcatcatgcagatatctttttaatatgtttagctcagacttttcttcagagacttgtgtaagtaggctgtggtctttgcagtcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaaggtaggagacatctcccatctaaacatcacagctggttctatgtttttgccttctttcatctctcactgaccttaaataaacagtctaaagaaatttagggcctggcacagtggttcacgcctatagtcccagcactttgggaggccgagatgggcagatcacgaggtcaggagatcaagaccatcctggctaacacggtgaaaccccgtctctactaaaaatacaaaaacaaaaaattagctgggcgtggtggcgggtgcctgtagtcccagctactgtcccaggcaggagaatcgcttgaacccaggaagcggaggttgcagtgagccgagatcgcgccactgcactccagcctgggccacagagtgagactccgtctcaaaaaaaaaaaaaaaatgtagatagtattcaggttttgtctctaggtctttttattcagtctttgtcatgaatgcaggtcacagaggtttctggaaaggcatgcccaggactgggaccagattaacctttattaatggtcacagtggcagcctgggctcatggttccactttccctggtttcatccctaatagaccaaaagaatggtatcttttcaactcctaacaaaagctctactattgtcaatgtaagaacatcatactctgtaaaatggtaagccctctgaaaagcctctccggtgactaataatgaatgttgttaaaactaccttaatcagtcaacataaaattcaaaacaaaaagaaaaacttttggaacatttattccagtttatgactctgaagggatagaaaacattaacatttaaaaagttagattaggccaggcactggtggctcacacctgtaatcccagcacttcgggaggccaaggtgggtggatcactgaggtcaggagttcgagatcagcctggccaacatggtgaaatcccatctctactagaaatacaaaaattagccaggcatggtggtgggcgcctgtaatcccagccacttggaaggctgaggcaggagaattgcttgaatctgggagacggaggttgcagtgagccgagatcacgccactaaactccagtatgggtgacagagtgagactccgtctcataaatttaaaaaaaaaataaataaataaataaataaataaataaatagatagattagtgaccctaataaaaatagctctgtacaattaaaaaaaaaattgggatgacaaaaatatttgcaattaatatgattaatgagggctaaaacctaaaagaaacaagaagcctaactataatattagtattcagactccattgactaatagaggcaaaagtgtaaaggttaatttatctgaaatttcaactttgctgataaagtagaaaacagtgataggaacctgccgttttactattactactactactactactactactactactactactactaccaccaccaccaccactacttgttaaaatctaggttattttcccctagagagcagggtgaatgttttcttaatgtctttacattcttctcttccctaaatatagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccaggtaaagacttgaaggaaaatgcattttactagtagactctctaaaaggattagttatttttaattctccctctattctctgctggttatactctatatttatatagtaggaggtatgtgccatcactgaagcatgtctgctttttttttctaggttttcattcatttagcaggaatactggcagggtatgtgtaaactatgaaaagggccttcctaggtccaggcagctggtgactcagagctggcctatccaatcacggctgccttttagaaaacaatctgggccaggcgtggtgcctcatgcctgtaatcccagcactttgggaggccaaggcaggcgaatcacaaggtcaggagatcgagaccagcctggccaacatggtgaaaccctatctctactaaaaaaacaaaaaattagctgggcgtagtggcaggcacctgtagtcccagctacttgggagtctgaggcaggagaatcacttgaacctgggcggcggaggttgcggtgagccgagatcggcgccactacactccagccatgtgacagagtgagactctgtcaaaaaaaaaaaaaaaaaaaaaaaaaaggccgggcatggtggctcacacctgtaatcccagcactttgggaggctgaggccggcagatcgtgaggtcaggagattgagaccatcctggctatgctgaaaccccatctctgctaaaagtgtacaaaaaaattagccaggcgtggtggcgggtgcctgtagtcccagctacttgggaggctgaggcaggacaatggcatgaacctgggaggtggagcttgcagtgagctgagatcgcgccactgcactccagcctcggtgacagagcaagactctgtctcaaaaaaaaaaaaaaaatctgaataagcccatgaacaagctcacacatgtaaataaataaaagattataaaatttaaaaatgtggttgacaaattacttcttaggctggcgtacattcattttcttcattgctaagataacccacttttggtgcccagttatggaaggtcctttcctaactgcattcaaatcagaggttagcctttaaggcattggatttttgctttttgctagtgcttttattgttctttctctagtaattccaagcaaagaactctggtattcattctgtctgtgattgacatggagccaagactcaaactactttgaggacctggcccactacagtcttctgacctggttatacgcatacaaacaccaaggcttctccatgcatccccctcccttttaggaggcagacagaatcttaaaggaattttgctttttaaagttatttctatcaggtcacatctgatgctgctttatttatttatttattttttttttttttttttgagacagagtcttgctctgtcgcccaggctggagtgcagtggtgctatctcagctcactgcaagctccgcctcccgggttcatgccattctcctgcctcagcctcctgagtagctgggactacaggcgcccaccaccacacccggctaatttttttgtatttttagtagagactgggtttcactgtgttaaccaggatggtctcgatctcctgacctcatgatccgcccgcctcggcctccgaaagtgctgggattacaggcgtgagccactgcaccggcctatttttctctaaaaatatggcacagttttttaattggaagctgtctgagatcacctagtccagaatctcatttcacacttgaggaaactgaggcagggagcggttacaaagccagtagtgatagagctaggacaaccagcccagtctcccaagtctcattcatgctggctctggaaacaggagcacaagttttatcttaactgtgggccttagaccctccttgcttctgatattccatattgtagtctcctggtttcatttactcttcctcacctttcatttccttcatcaccttgtatagagtaaaccagggtaagtgctggtagatgcattgatgaaaaaatatataatcctgcctaaatacctaaaggcagctcactttctagtggggaagactaatatgcacagaacttagaatataataagtaaatgggaggtcacaggagttagctagtaattttgattagagggatctagagaggcttcatgagagcggtgtagaagttgttattgacatacttcactctgccccactttttcttatccaagattatgtttatcatattttgaccctcctaagatggagccttggaactgattcaaagtaaatcaaaactggtgctccaaaagctccttgggccaagatggggaagaaggtcgtaacttgctgcacctgggtcatgaagctaacactcccattccttttgaaaccaacgtttttttgtccctgatcaaagggacaagagcttcacccaccttgcagcattcccagcacattcttattgccaatttaagggtctttttgttctcttcttatctcatctgccctttattctctgttcttttctcttttcattacttctcaccctttctttgcctatctgcttttcccatctacttttgccttccatctccttataccccatttatccctcaagctggaacctgatgctggcaatataagagacctctaatgcctcttgggaaggggatgaggggattttgagtccctattcttccgttccagttgattttgtcacaacaggcattgacatagtttaactgggcaattgtgaaatttgacatttgttctatgttcatatttaaacgtgtgatgtgatttttgtaggaaatgtatatactgtttatagatgggctgtgaaattttatcttggaatcttttttagaatgaaatttttggttcgacggtggcatcgagtcacaggttctgtttccatcaatattaacagagatggctttggactgaatcaaggtgaagtcaaaatagcatattttcttatgtttatgactctctaaatcagaggtcccccacccccagactatggaccatacttgtctgtggcctgttaggaaccaggccgcacagcagcaggtgagcagcgggcattactgcccgagctccacctcctgtcagatcagccgtggcattagattctcataggagcacaaatcctattgtgaactgcacatgtgaggaatctaggttgtgtgctccttatgagaatctaactaatgcctgattatctggggtggaacagtttcatccagaaaccattctggcccctttgggtccatggaaaaattgtcttccatgaaatgtgtccctggtgccaaaaaggttggggactgctgctctgaattactgcatgtgtaatacttaccaagtaatgaattctggaagcaatgttttccaaagacaaagcccttataactgccaaaactaggtaacttcactgttttaaagagggtaataataactgattttcatggagaacttagtctgcacctggccatgctcttttcatgtattctcccaatcctatgatataagtacagttttactactctcacttttagatgaaaaatcgaggcatggaaaacacaagtcatttgccccagaatggccagtagggaagtgatggaaccaggaccaaacactggcagtctgggtccagagcccacactcttcataactgcatttaaggcacggttcaagacaggattgctgttagtcatatggaagaattaggaagttttcataatttaacaatattcaaacaagtttctgagtttaccaacaggttgtataataatggtaacagctaaaattccttctgtctacacctagaagtggaaacaaactagggcttgaacatttctggcaataaagatgaggtccgaatctggggagcacacagaggacacagcatccctgtgctgtgtattcatagtaaaccacctttacatactctaccaggagctgagcatcctacagaggggaaatagatttggtaccctacacaaagtattttgaaatatcattacactgaaacagctgaaatttgtaccataataagttgtgttttattaaaagttagcaaatcttggtttcaagtcagtagattggaatggttacattggtctaatattttttatccacatcatttcccacaagccacacccactcagacacccctcacctctcatctacttagagctaaggtctttaaagaagaaaatatgccaattaaataattttctttgagacataattccagatatcagaaatactcatattcaaaagtaaacaaaataacatttgaaagccgaatttttgtttgtactgttttctcctttatcaagaataatagaaaatgactataaataggagattgtataatatagtataatagtcttttgagcagttacctattttgtagaaattttttaaggtcttgggattttatttttctttacaaggaatattttgggttactttaggtgcagaaaagactgactcattttatcattcttctggtgggctggagttatatggagaaccaagacatactacgtatcgctcaagatcagatctggactatattaggtcccctttaccatttcagaataggtaagaatatgagaaaacctgcctggaattgttaaatgtattaatatttaacagagataaatggacatttttagggctttgacttctttgcattgagatagacatctttgttatatataatttacataatatgaccaagtgcggtggctcacacctataatcccagcactttgggaggctgaggcgggcagatcatgaggtcaggagttcaagaccagctagttggagactagcctggccaacatggtgaaaccctgtctctactaaaaatacaaaaaattagccaggcgtggtggcaggcgcctgtggtcccagctacttgggaggctgaggcaggagaatggtgtgaacccgggaggcggagctggcagtgagctgagattgtgccactgcactctggcctgggcaacggagcgagactctgtctcaaaaaaaaatacaaaaaaattagccaggcatggtggtgggtgcctgtaatcccagctactcaggaggctgaggcaggagaatcgcttgaactcaggaggtggaggttgcagtgagccgaggtcacgccactgcactctagcctgggcaacaaagcaagatttggtctccaaaaaaaaaaaaaaagaaaaaaaatatacataacctaaggcttaatgtaaaaatgtaaaaaccagtgtttaaatttgtaactgatttccaagggtatagcaaacaagctgaccaagtgttatttagtgtatgctatggttagatattgggaaaagtattgactaaaattgatactctgatcattatgaaaagcttaacagtcttcatgacaagatacatttatacatacccaatttattgagacctctgccacaagcattgtattggacattcttatgttgacttagtagcatctttgaattcattggagagttgtctctttctcatcccaagctccaaagctgaagcttggaggagatacattatgtgtgtacaagtgacccacctttttggggaagggagtggaggcaggttggtaacttatatgcatatttctggataacttgattcatgtacatatttttaatcctttaggtacccaggcactccagctgatttcaatcctggttctttagcatgttctcagcttcagaattacgatcctgacagagccctaacagattatatcactcggctagaggcactgcaaagacgacttggaactatacagtcaggtgctctgagtttaaccacatcttggcagcaccacagtgcgagacccacagctcccctttctttgaaattctttcacactcattaggataatcaaagcttccagtttagtgcatgagctaattattaagttagccaaagcttaaactcttgtaaccagcagagaaactgactttaaataatttaagtgaaaatatgatttatcaccccagatcccactcctcccaaaaatgatttcctactatgttcattcagcggactgatgacacaaaatgcacaatgagcaccagtgtgcaaggtactctgagtctacagagcctaactggagaacgtattcctaagtagcgcatggcagaaagtggtaaggccgtgccgcagcactccagcctgggcagcagagcgagaccctgtctcaaagaaaaaaaaaaaaaaaagaaagtggtaaggcatgcaaatcgggtggagttaaggaggaagcacttactttaagcacttaatgtaaccattatccctgctactatattgtgcttttatgtatcatcgaaaaaaactatcccatttaaaatactttgtaaggattattttttctttgttcaaaaacaaaaaacaagtcatactttaaaataaaggtggattccctgttcatggaaggaaaacctcttttccctatctcacttcagttcactcctgattcagagactttgaatcattgagtagtttatctcttccttcaagaaatcatttgtttacacccaagcatcttgtagtaataggaaacttttattatcatagctgagtttgttggtttgcctaggcttgttttgttttgagcatccaaatttcacaagacccagattttgaagaccaaaagatttttcaaaaatgtatgaggtatagaacatccaactttgagagcactttaaaaaaactctaaatattagtctcacctaccttgccatagagccagtcatggtgatttttacatatatattcaaaatctcttaaaagtcagcttaagtatatgggctgggcgcggtggctcatgcctgtaatcccagcactttgggcggccgaggcaggcggatcactaggtcaggagttcaagaccaaccagttcgagactagcctggccaacatggtgaaaccccgtctccactaaaaatacaaaaatttgctggacatggtggcatgtgtggatagtcccagctactcaggaggctgaggcaggagaatcacttgaacccaggaggcgggggttgcagtgagccaagatcacaccactgaattccagcctgggcaacagagtaacactccaccttgggggtagtggggagagactcagtttaagtatgaagaggacattttaaggaaaaaaagggctttaaaaaaatggagaataataataatttcctttgtgtgaactctggtgggtctgatacaggtagcaatgtaatttgaaatcagttgaatttcctgtttttctctcataggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccacactgtatttgaaccttcttcatttttaactgagccatagttcttggtacatagcatctcattacttatgtcaaatatgtaggagtgagagattcagagaaagttgtcctaatcttagagttaatactgttgaaagttttccatgtgtctttgtatcaactttacatctacatagtgttttttaaaagctatattggtatttcatgattaatcagtatttactatattacagttagtgttacttgtttccaaagatgtgttctcacaaatccatggcccactaaaaagatgaagaaatcattaactcaaaagatcttaatcacattgcagccgaattaaacagtatccctgttgtccaagccaaattcagactgggaggctctcacagagataatacagatcgcaatgttatttctcatctggagtcctcctcaataacatggcaactcactaaaacagcaagaggactagtatttgatgcttacacctggaggattttgtcttattatttgatgttccatgatttataccaacacaaacaggcatggtagaaagttgtacatgcttgaacatttctaatttcagtcatccctcggcatgtgtgggggattagttccaggatcccccttggatattacagtccgcgaatgcttaagtctcttataaaacaatgtgctatttgcagatagtctacatacatcctcctgtgtacttcaaatcatctccagattatttgatacctaatacaatgtgaacattatgtaaatagttgctaatactgtatttttttattgtggggttttatttttagtattttgaacctgcagttggttgaatcagaggatacagaacccacaaataaaaggagccaactatacttaaattttccacattagaagctgggttccaataagaggaattctaaaaatagcaaacgtactctaaagcagttagttgaaggggcaggttgtgggtaaaaacctttttcagctagcatggcttgccattcaaggctattctgctctaagagacagtggagaaaaaaacagatggacaaatgatctgatcaagctgagttcagtgccattgtttgaccaccacgcctccttatgatagtaggcctctgcaatcacacttgtttatgcatctcaataattaattagtctgtgattaaaaatgaaatctgttaagaagtctaaaactattcactaaacattagactagccttatctcggggtcgtaactagatacttcaagaaatctgtaacatctgtaatatgaaaatatctgagatttctattgacaaaatcatggatactgctaataaaatgctgcccaaattcataattgaaataaatactaaattgcagttagaaattattagtgcaaataaagatgtaatttttccccacccaagttcctggattccctaactctgctcactgaagcacatattttacaattcatgaatacagactgtattttttcaaagagaattttaatctgaaaaattagcagagattctgccttcacaattagagtttaacatgagtcttccagtgttttaaaaagaactgtaatatacataaagcaaaatattttggcatcacctagtgaaaacagacgatgtggtattttttcagccatctcatatagttaggccccgagttacaatttgagataagttgattcctaaacagaatgtgctttacagaatgtgaccaattttattactcccaaggaccttgtttcagattatcttaaaaccagagttcactgatctcacattttaaaaagaaaaaagtttgttaactgttttaatcaatatgagtagtaacaaacatccctaattggattctagagaggaagcagggaaggccaggtgcggtggctcatgcctgtaatcccagcactttgggaggccaaggcgggtggatcacgaggtcaggagttcaagaccagcctagccaacatagtgaaacccccgtctctactaaaaatacaaaaaattagccaggcatggtggcaggtgcctgtaatcccaactacttgggaggctgaggcagagaattgcttgaacccgggaggcagaggatgcagtgagctgagatcgcaccactgcactccagcctgggcaacagagcgagactccatctcaaaaaaaaaaaaaaaaaaaggaagcagggaacaactgagccaaaacaaaattatcccctaaggacttgactttggacttccacataaatgtgaccttgtagaactagatacatatttatcaggtaaataaatatgtaattatttagtaattagatcaagatacatgagcagtctttagcattaataattacattatttttaggaactcttatcaaatatggtcctggatctcttaatttcccatatgcagtgattttagttaaaattccaaaggatttctttttcctataatatctccatttctgagtatcatcataccaaaacaattagtattctcttattcaaggctttagatgttcgattattccctacccttccatcctcacacacacaataattgcccagataaataataataaactgtggtttccaagtatctcactgggatttttattctttataccttgcaggactagtccaagatttgaataccctgaacttatttggcaagagcgatgagtactcttaaaattactatctggaaattatattatttagaatctgccaattacctagatcccccctcaacaattgtttcaccaaggaacttcctgaaagcacatgtataagtatcataactattagaaaatgtttcaaatgctattatatttgatagaaccattcagttaacaaaatcctaaatcataaactggcttttagaattacacacttaaaaaaacagtaaactacaagagttgttttgtacacttcattctcttcgaatgcctttgtggcttacagtgataatcacatatattcgttccttgcaacctttttcattttgatcttcgtttgtaacggataactgggttttcaggggtgtgaatcatagttgtataattcacagtgggaaagtatccatcaatgagatcaaattcatataaacgaagcatagtggaccaaattgtcttaatttgaacataggcaaaattttccccaatacaacgatgacgccctaaaaaaaagaaaaagttataagaatcagtttaaattctttctcatcctttttagcctggggtgatattatctacattttagatgaacagcaaatgtacagataatataataaaaagatgacattcttttcacataaaacaacatgaattattaaaaattccaggagattttcaataccacattttaggaaaacagtacttgactgatcacataacttttccaattactttttctgaaaatatatatctgggttaaatatatggaaagtttgaatcataagatggtaatctagtttgggaatatagtagaatattctgtttgtcccaagaaagccctagttaaaagtcaatatgaaaaccttccaatcaaacctcaaatgtcattataaatgtatggaagaaaatgagatttaatgaacccaaaataatatactaaaaagtcacacccatgtagaaactgacaagctgattctaaaatgcatataaaaatgcaaaggacctaggatatccaaagcaatcttggaaaaagaactgagttggaggacataaaactgatttcaaatctgacttcaagactaaagataaaacagagtggtactaggtaaggatcaacaaatagatcaatggaacagagcagagagcccagaacagaatatttttatggttatttgattatcagtacagacaccaaagcaagccaatgaggaaaagcaagtcttttcaacataaggtccaggaataactagatattacatgggggaaaaatgaaattcaactcctatgtcacaccataatcaaatactaattcaagaagggtcacaaaccatgatgctaacagcataaatttcagtagagaagaacaggagaatatcttcatgactcaggggctaagcaaaaattttaagacagggccagaaagcaataaccatttaaaagattgatacattggactaaactaaaggttattcatttgtcaaaactcaatgaatgttgacttaagatttgggcatttcattgcaagatttttcatcaaaagaaaaaacctaaactgatagtgcttagcacagtgcttgcttggcccataactgtacttatttctaggagtgacatttaagatgagcatttacaaattggtccatatttcaaatataacaactaaagagaagcttggcttacaggaagaatagtccaaggatttaatcgcaacaagcaagaagtatcctaattgaatcaacataagagtagataaattctgatgattcacaaaatgtaatattatgaaaatgaatgaactatatgcaccaacataaataaacagcacaattacgaggtaaaagaatgagtaaagaaattagagacatgtaatgtgatatttaacaagattaacgtaagatcatatatccccccataaattcaagtccatccagaaccttagaatgtgatcttaattgggaaataggatctttatatacacaattatttaagatgagatgaccctgacttagggtaggacttagatccaatgactggtgtccttataagaatgccatgttaagatacagagacatgaacaagaagaaagcctgttgaagacaggggtagtaattggaacaatgtagttacaagccaagggttgccaagagccaccagaagctaggaagatgcaaggaaggattctcctgtagaaccttaaggaggagcacggtcctgccaataccttgatttcacacttccagcctccaaaactgtgatagaatatatttctattgttttaagccacccatattgtaattagttacagaagccctaggaaactaacacaaagattgaaaaaaagatggaggagacattatatctgtactcaaatacctcatacaatataagttcagagactatggttaggaccaactataaatgagatgttaaaaagaaacagatttcagctttaacataaggctctaaaaatgacagctgtccaaacatagaatgagccatcataaaaggtaactgaacaacccacaacccatttctagtaaagttcaagtggaaaccagataattactagtttagaaacgattcctctttggggcagaatttgggctacagaactaatgctcttcccatctgttaacaatctgattctttggccaggtggcatggctcacgcctgtaatcccagcactgtgggaggccaaggtgggcagattgcttcaagcctggaattcgagaccagcctggccaacatggcaaaacccagtctctactaaaagctcaaaaattagctgagcgtggtggtacacacctgtaatcccagctactcaggaggctaaggcacgagaattacttgaacccagaggtggaggttgcagtgagctgagagattgtgccactgcactccagactgggtgacagagcaagactctctcaaaaaaaaaactatgattcttttatatattgtgttatacaccacagtattaaatttattacataaagttaagatctgaagttcccaaaggactttatattttcctttatatgtggaaaaagtgtgaccaatgacaagtcatctgtcatttaaatgatccctttggaaagactaaagcatagaatatagtttaatcagtacagagaaccaatggacagagaaattactggagaaacaagggtatagctaaattattttaggatcttactggaaatgaaatttgcaagcctacacacaacctgcccaaatttaaagaccattttctcatacggatattcagagagcaaaaatgttgactaacgatcgagaagagctttaattttaaaagactgcctttgcttttttgtgaaatgctagtaatctgttattccctgaatggtgtgctgactccaatggttctttaaaagagaatccacaaagagctttaaataccattgtaagggaaaacaaggatgttctataaaaattagacctaataaaaccagacaggttaggaagtagtgaagcattatataaggatttatggaacaattccatttggtacaaaggaaatatttttctccaacttataaagattcttctcctaaaaaagtttgcaaaaatgtccctatgaggaaagggagagataatttgtaaacacaattcggaatattttgacagagacaaatatgttatcagaacaaacatttccaatctaaaatataatcatcttaccagctccaaatggcacataggcaaacttttcccctgatgctgggttatcctgtaagtagcgatcaggattaaagtccaggcgttctacccatgagtctttaagtctttgattgacagtgggagaaacacacacctgatgtcctggaggaatggtataccctgccacagtctataaacaaaagccacacatttcattagagaatttaaaaatgtgctgacaaataatcagatcattgtgtaataaagcatgaatatacatgggatactcagatgctccttgacttatgataggtttacatcctgataaatccatcataaagtcaaaaaattataagttgaatcacataaatcaagaaccatctgtacatatatttaaaaactggctagataataggcaaactaaaaattattttaactcaagatgatttccagtgagccagcgttgggttggaagtacacagtacacaaatcaaacccataatgccttggaggtagggttggaatttcagagaggctttcactatcaatttgtacacttcatattaacaattttttacaacaaaatgttatttttaaaaccaagaaaaatatgtactttgatttttaaaaccccaattgttaaagaaaaatgcagaacatgattagcattaaagattagcatgtaggccgggcgcgggattacacctgtaatcccagcactttgggaggccaaggcgggtggatcacctgaggtcgggagttcgagatcagcctgaccaacatggataaaccccatctctactaaaatacaaaaaattagccaggcatggtggcatgcccctgtaatcccagctacttgggaggctgaggcagaagaattgcttgaacccgggaggcggaggttgcagtgagctgagatcgcaccactgcactccagcctgggcaacaagagtgaaatgccgtctcaaaaaaaaaaaaaacagattagcacgtatactatctacaattaggtaaaaatatgtttttagagtatataaaactgaagattaggtagaagtgattattctacttttttaatttaaaaaaatctcttttatgctactctacttcctcttttctttttctttcttttttatttttattttttttgagacagggtcttgctctgttgcccaggcagcaatgcagtggcgtgatcatggattactgcagtttcaacctcccaggctcaagcaatctacccacatcagcctcccaagcagctgggaccacaggcatgtgccattatggccagctaatttttagaaaaaattttgtagagatgaggtcagtctcactatgttgcccaggctggtctcaaattctggcctcaagtgatcctcccacctcagcctcccaaagtgttgagattacaggtgtgaaccaccacacccacctatttcttctttttgataaaaactgggggtatagaggggaagatgtagccaagatactcacctgaggagttctggccattctcatcatgatcattataggaggtctaagtcttaatgtttcttttatacagcgatcaagtaaatttagatccttgagctaaaatgagaaagcatttcctgattgttataaataacatacttcaacagtacaaaaaattagtttaacttcttagttagtacaagacagcttgcattccagctaaaagtacagaggtaactggttcagggtggctggggttatcatgctctaccactgtccatggtgaaaaaggagggcaaggtaacagaagcgattgccctgaagaatgaagtaagaacctacaaaaattcactcctccaaaaaatgaaaacagtagcaacaatcttaatgtcaactttttcaaaattctggaagattaaccaaaggcttgcaacaatctaaggagagttaattcaagaaaaagaaatctgaatcttggtaagaagagtaagctttgtggtagtgtaagttgtatttctttcatcctcctctccccaaatccatggtagccccggaaaccaacagcatgacaactatagcagctgtgaaagccagaagcctaacaactattagaggagccagagcaaattttccaaaaatatttagcaaaaattgtttaacactgaaggcgcctgagatggtgatatcagttggtgctaagagacagaacaagaagtttaaaagggaaaactggggagtaagatgtccacaggagactttgaaaagttccaacataagagaatcttgaaggccacacatatgtataagaccatgcatatgcccaggtaagatctaagaggctgtaatcttttacctctggctgacctgtacacacaggtagtgaaggcagacttgtaactgcctgttggagtgttaataacatcccctaacacacacatacagagcctttcagcaaaagctaggagactggctgttcaaagcacttcagtaaatctctgtccaaatattagatgcccactaaagtaagcaagcagagatttcagtgacctcactgaacaaggaatgacataattaatccaggaaacgcagtaaacaaacagcagcagcaacaacaacaacaacaaagagccagcaacaataaacccagggaggagggcatctgatttccacagttgccacattattttaaatgtacagttttcaacaaaaaaattacaaaaaacacaccaaaacaggaaagtatggccagtacatagaaaaagcaagcagtttaatagaaactatccatgaagaagcccagacattggacttactagataatgaatttaaatcagctattataaacaggttcaaagaactatagcaaaatatgcctagatatctctagtaaaatggagaatatcaatatattatttttttagagaaccaaatagaaattcaagaactgagaagtatgagaactgaaatgaaaaattcacccgaggggatcaacagcagatttggactggcagaagaaagaataacatcaaaaaaataacaataataaaatacttaagaatacatttaacaagagaagtttaaacattgtgcaccaaaaactataaaacattgttgaaagaaattaaagaactaaaataagagaaagacatctcatgttcacagatttaaagactaaaattgtgctcccaaattaatatggcgatacaatgcaatcattgtcaaaaatctcagctagcttctttgcagaaactgacacactgaccccaaaattcatatggaaactaaagggactaggagtagataaacagccttgaaaaggacaaagtcagaggactcacactcccgaattcaaaacttattacaaaactacgtaatggcatcagactaaacatatcaatggaatagaactgagtccagaaataaagccttaaatttatggtcaagaggctttttaaaatgtatttattttttcagagacagggtttcgctatgttgcccaggctggaccccaagtcctgagctcaagcgaccttcccatctcagcttctcagtagctgagaatacaggcacgtgccactgcgcctggctataatagatttttttacaaagacaattcaacgtggaaaaaatagtcttttcaacaaacagtgtgggacaactggataaacacatgcaaaagaatgatgacctcacatcatatacataaattaattcataatggatcaaagacctaaatgtaagatatgaaactacaaaacactaagaagaatacacagaaataaatcttcatacactttgattaggcattagtttctctgacaccaaaagcacattaaaaaaaaatagatgaactcttacaactcaataataaaaagacaactcattttaaatatgggaacaggatgtgagcagacatttctccaaagaagtataccaaagccaaagaacacatcataagacactcaacatcactagtcaccagggaaatgcaaaatcaaaacaaaataccaactgggcatggtggctcacacctgtaatcccagcactttgggaggccaaggcgggcagatgacttgaggtcaggagttcaagaccagcctggccaatatggtacaaccttgtctctaccaaaaatacaaaaattagccaggcgtggtggtgtgtacccagctacttgggaggctgaggaaggagaatagcttgaacctgggaagccgaggttgcagtaagccaaggtcgcgccattgcactagagcctgggcatcacaccaagactctgtctcaaaaaaaaaaaaaaaagtatcacttcacacctattataataaaaaaatcaagtaacaagtttggtgagggggtgaagtcaggaccaacatatactgtttagtgagatttgaaagtggtgcagccactttttaaaacagtctggcagttcttcaaagttaccttataacccagcaattctactcctaggtatgaccccccaaaattgaaaacacatgtccacataaaatcagtacacaaacgtttagagcggcattattcataatagtttaaaaggtggaaacaactcaaatgtccatcaactgatgaacaaataaacaaaatgtggtctatccatataatggaatattattggtaataacaaagactgaagtactgatacatgctacaacatggaagaaccctgataacatgctaagtgaaacaaggtagtcacaaaagactacaaattgtatgatcccatttacatgaaatatccagaataggcaaactcacagaggcaaaaggagattaatggttgccaggggcagcagtcagggagaatgaagcatgactgctaatgggtaccagctctcttttgggagtgatgtaaatgttctaaaattaaattatgatgatggtttcccaactcttaatatgctaaaaaccacaaagtgtacattttaaatggatggatttatgctatgtaaatatatcagttaagctgttattttaagttactaaaaacaagaatgagtgttgagacatcactactgagcttacagaaataaaaaggattatgagaatactatgaacaattgtatgccaacaaattaggtaacctagatgaaatggacaaattcctagagagatataaactactgaaactgacataagaagaaatggaatatctgaataaacctgtaacaaataaattgaattagtaagtaaagtcttctcagaaagaaaagcacagatctagatgatttcactgctgaatttttgcaaatatgtaaaaaaggattaacaccaatcatccacaaactcttccaaaaattagaagaaaaaaagaatacttccaaatacattctatgagatgagtatgatcctgatatcaaaaccagtcaaagacatcacagtgaaactagagatcaatatcctttatgaatatagatgcaaaaatcctcaacaaaacaccagcaagtttatatgtagtaacatatagaaagaactatgcaccatgacaaagtaggatttatcccaggaatacaattaacatctgaaaatcagtgtaatgtgccatattaatataggaccaaaagcacaaaagataacaggaagatgacatcaccaaggtttgcttccaagatggaatgtcaggttgtgcagtgagttgtcctctcttcctttccacccagcaagttgcatgtagtatttgtaaatgtcttgtcctcattactactactactactacttttagaagtctctgctcatgcccaggccactctggacatacagaattctaagtaattcagaggcttctacacttcataagacacacaacatgcacataatatcctctatgtacagaagccagactttgaagcagaggaagtaagtaccaaagaaacatccccaaggatctctaagccatcaacccaaaacatatctgataaagcttaatggcaagaagcaataacattaagatattttaggtaaggttatagggaatttgctaaaaatagagaagctgatcaatttaagctatagtatatagaaaatctcaaattgtcccttttaaaaattagccacagatcctcaaagtcataaggcagcaatgaaactgaaaaatccaacaaacctggtcataagttaaaggaggcagattctctccacagactgttttctgttctaaataacattttttttgaagtgttttgtctctggccaaaaagaagcccatccaagcactagtagttgaggatgtatgctgccctgccaagagtaatccaataagcatccctgctacttcatcatcagtcaaaggacgcccatccctaaggaatgaaccaaagacacaaatttaacattttggcagatacatttcatgcctcaacctttaaataaagtgtcataatgaatacatttttcaggtatagtggtctcttatatttgactatcacaagtcaagagttttttttctcttagggaagagacagaccagcacaaaacgattttgattacaaaagactccattacagttcattagcaaacttttaccatacccagtcactgggattacagtaagacacaggatgccaatagtttatgtctcaacaatttaaagagtccaaagatcacagctaccaacttattttgccagcatcactgttttttaactggaaatactatttaactgtgttttaatgtgtaatttcctgcttcagcttaatatgttatctgaatagctcttacttgtatgtagcatctagtaaagtttggagaatgtcatcaattttttcttgagactgtctgcgtttctggattgccttatagaaaatatccttgatttcccgatgagctctgtccctgcgtctgtaattaaaagataaagatgattttcttaaataaagaaataaccttctaggatcaaattcattttgagaaccaggaccgagcataaagcatcttatttaaccaactttaatgactctaaaataattgacaaaaaaatcagaaccaggaacatactggaagtcatgaaaatcttacattgttaaaaatgtccatagtccctaagggcaagaactgtgctttatttaacatatatatcccagattcttaacacattgcctgtgttcaaactaaaggcctaaaacaagcaagaaattcctttagaagtattttccagttcaacagaaagtaggatactcttttaaattaacataaaattccaattttaataccaaatcaagtcttaaagcagaagagtcactctggttcttccatggaatctggttctacttttcactttctaatacaatagttttttgtagggggtgaaaatactagcagattcagaaaacaagcttcaactcctaaactttacctttaaatagtatgttcactatgtagcaggtaccatgttaagtgttttacatgaattactcacttttatcttcctgtgaggtacatactattaacctcaagttatagctagctgcataagatcacacagaaagcaaacattggagctggaatttaaaactaggcagtctgactcccaagccccctcttaaatcaagccttctaaaaaaaactcctactctgtttcatttacaagactgttaatctgttattgaggatcaactgaaaccatgtgtacagaagagaagatgttggggcttaactgtatgaatacagtcgaaccaggaaaacataggcctgtttaagaaagtgaattgaataatctggttaaattagttggtatgagtagaagaaagaaagactgggccagaatgtgaagggcctaacatagcaagctctgacttcatccaagagacagagcaggtagaaacaggcaggtagaaatgtacatttatgggccaggtgcagtggctcacgcctgtaatcccagcactatgggaggccgaggcgggcggatcacaaggtcgggagatcaagaccatcctggctaacacggtgaaaccccatctctactaaaagtacaaaacaattagccaggcttggtggcgggtgcctgtagtcccagctactcgggaggctgaggcaggagaatggcgtgaacctgggaagcagagcttgcagtgagccgagctcatgccactgcactccagcctgggcgagagagcaagactccatcaccaaaaaaaaaaaaaaaaaaaagaaatgcacatttatggagaacccactatgagtccagggctgtgctgggtgttctaatataagatatatgaaaacattttgaaactgcaaagctccttgcaaatataaggtatgatgagttccagagaactttagggaatctctcctggctcttccttttactcccacccctcttccaatctgtaactagatagagggggcagaaatagaagaaaagggactagcaatctatctcctccccatctgtcacctaaacaccaataaatcaacaaaagtacagaaagcctactaatatgcaaaacactaagcactaagctatagatcaagtcctaagagcaatatttctttatatcagaggcagtccctgtccttaagaaacagaaaattaaataaaggcacaaatatttaaaacaaagaaacttcacaatacaataaaaagccaccaaagatttcaaacaagtgctagagaagagctgtatcacttttaggtatagttcagagactttcctgaggataaggaatacgtgaggtaagcaggcttttaaactaggctgggctcagtggctcacgcctgtaatcctaacactttgggaggctgaggcaggtggatcacctgaggtcaggagtttgaaaccagcctggccaacatgatgaaaccctgtctctactaaaaatagaaaaattagttgggcatggtggcacgtgcctgtagtcccagctctcaggaggatgaggcaggagaattgcttgaacacaggaggcagagactgcagtgagccgagatcacaccactgcactacagctggggcaacagagcaagactccatctcaaaaacaaaaacataaataaaatattagactagacagacaacaaatcacctttttaataaactgaaacttactttaaatgagctcattatataaagaaaatttgtcttgaattcttatagaagaaaggggattcataatcttacccattttgtatgttttacttgtttaatttttatctttgttaaggcaaagcataccaacactacaataattatacaaagttaaataacctagtgtaatatattctttatccatacctgaaactaggcaaaggcagccaacctggtaagagccaggctgcatggctgaaacctccatccaaatctgcatacagctgtgctaccttttcattgagttgacttctgatttcctttccatgcaaacaatggctagctgttaaaattatgagctcagaaagagcttcaaacacatctagggagaaaaaaaagattattctcattactatttccaaaaagtgaaagaaaattgagaattaaaaacagaactcaagaagaaacaagatcctattcatatcatcaaaaaaagtctgtagacagacatgtgactatgtacaacaacaaagaggggcaataaaccaaacaatgtgaagcaccctgtccctctaaacagccaaaacagatcccagaaacacatctcaaaaccccactcatgagcacttcatcatgaaaagaataaatgtggttatttgatttccaggtcacaataacaaaagcagaaaaaaggttatttatagtgcatatgacaataataaggtacttcccaaggaatagtagccaaagatcagattatttcccaggttaaaagtaggaagatcagggccaaaatggaattactggcgatatgtaaaagaaaactataatcaccaattagtatatcccaacactggagacaaatgcaccaggcaagcataatttgatgacaactaataaaaattatccaattaatttcctgttaattccacattcactaaatgaacttccaatgatcatctggctttccaattatatttgtcaataaaaagaatatcagtaaatattctggatttcttggtgctgtaattatatgtctcacatgcattattacattggcattctaatttatacatcagtttcttgtatggttagaaaatatatcaatatcaacttaagtataccaaaaacaaagattctggaactcttacagaggccaaaggccagacccagaatatagtgacctgctgccctgggtcctgctgccctgtgggcagatgttgcttcctactatgggcacagcaattgcttctgaaggcaatacttaacttgcagcccagtataaaaactggattctcagttacaacttcatggtaatcattacataaccctcccataaatctaaggtagttttacatacactgtaatttgttttttatatactacacacatatatactctacttttctattcacagagaagtagaaatgttaggacaaacataaaacattttgcttacttttttctccactttctccccaactctcaaagtattcctttgtttctttttcaattatagaaacatgctgtttaaagtgggctatgttaaggccactttttaacattttcttctgctccaagaaaaccttcaaaaaaattcaaaacggggatacggcattaaaacacatttttgttttatcataaaatccatttaggttattataattatgtaacactaacacaagtaatggttttaaccctttgggcatttacattttaagagtctaaatgaatagatctatctgactctaaatgaatagagtctaaatgaatatatatatctgaacagagggattttccagggccctgttttttggccttaaggagaggcattcattccctcattccccatcactagaaacaagatttaatgttaactcttaactgctatactagggtactggctaatgtgtgttacattcacagccagagcccataccaagcattggggccaattgtctgatttgtgttctatatcaacttaaaacaatttcgtatttggcttttgagggtaaaacatacacatagatgtaccccacacgtgaagttgttgcattaaaagaggacttctgaagtcagcaatctctaaacagcgcttatgttagaatttcaggcaggaatgggtaggcaggaagtccttttgatgaagtaacagcattgtctaataaccctttcaaattaaatcccagtatgctaagttatcattgattccattatttgtacaggaagccctttaatattgtttagccatgacagcaaatataaaactaaatacccattacttatcagttatccatggcctttcttctcatgattcttcagacttttgaaccaaggaataaactggttctacattttattacatttttgtttggttggtttctgtgtgtgtgtgtgtgtgtgtgtgtgtgcgcgtgcgtgtgtgtgtgtgtgtttggttttttgtttctgtttttgagacagggtctcactctgttgccaaggctaaagtgcagtgttgtgatctcggctcactgcaacctccgcctcctgggttcaagcgattctcatgcctcagcctcccaagtagctggaatttacaggtgtgcaccaccagccccacccagctaatttttgtatttttagtagagacagggtttcaccatgttggccaggctggtcttgaactcctgactttgagtgatccacccaccttggcctcccaaagtgctgggattacaggaatgagccaccatgcctggctgtttctacattttaaatgtataatgtctcactattagctataactactgaggtatagatttgtctttatttatggtaacagtgtcacctactggattaggcacatcgtatgcaactcccttcccaaacacaggtgttgtcaggcgactgtagacatcttctgcattcaggtcttcatttttactattaaaaagcagtgcagcagcatcactccccagaaggtaagtaaatgtcttgcctaccatggtaaaactaaatacaggtccatactaaaaagagaaaagtacatatagtgatgttacaaaaaatatgcaacactacgacagtaactttttaaaatcacaaaataatgcattattaaaaaaataaaaacatatataaaccttaaagcaattcttttcatcttgccatactcctccttcctttgtccaaatttataattatgttcatttagttgcaaatgtagtataaatataactgtttattatgcttttttcagtttatattgacaatgttttctattgtctatataaacatcacaatgttaatttactgactactctttcattattggacatatgggtgatatgtcagggttttctttagttattacagctaattctgtgatgaacacctctgaaaatatagacttcttccccctttggttaaaaacaaattttacaagactagccaaagaatttgaccttttctatagtacctgctatgtgaagacactacaagtttatttatctattttagcactatctcacctacactaaatgacttcattttttattttatattaatttggttagatgttaaatactttcccttgcagttttctggttatgattgaagactagactctgggggtataatcatgaaaaaaaatactgtcccaactcaccaagcttagtctattggaaaaaatacaaattaatcaaataatcacattaacaaacataaaactgcaaatgtgacaagtattacagaaaggaaagcaactctgtgatgagagaatctaaaaaagggagacctaatagaggaaaagacaactaggttgagaccagaagaatgaggagctggtttggtagctaaacatacacaaaggccctaaaagtaagagaaagagaaaggaggagatgagagttgagcattaggcagtgctagaccatacagagcctcataagccattttgaggaagtttttaaacgggtgacaagaatttttcagagaaaaaggaaagatgccattgaaaaagaagtcaacaatacactgagaaaacaaataaaagtaaaaagttcctgagacaaaagagggatggagagttcagcctccgataagaggcaaaatatagttgtaataaaatcaaagtggtagaacgcagtgagccagactgtccgtgttcaaatcccagctcctccacctacttgctgtatgactttggtcctatagtcagagaacttagtctctctgtgtttcgtttctctcacctataaaatggtaataataataatagcagttcttcacagagctgctgccaaattttatatacagggcagagaagagtaccttggcttacttagcatcttaatgacttgttttccattattgttatcattaataaaagtataggctcagaaatcagaccatgtgtaaatcctggcttggccactgtctagcagtgagtccaagaagaaattatatatcctctctgcttctcagttttgtcatctataaaacaaatatacctgaaagggtttttgtggagcttcagtgagatgatctttgtaaagcactaagtactggcataaagtaagtgtttgataattattactgtgataggaagaaagagaataggattactatataaatacaagtaggtttgcatatttgaaattgagaaaatgaggaagttttctttgaatgttttaataattgtctcctaaatcaacgtttttaatcattgtctcctaaacaggagaaaaaatcatctgctttgatggagaggtagaaagattcagaagtttagaaaagtgaaggtttgaattagtcactgtaatgagtggaaaagtaggcccaatcacaagaacataataggactgtggagcagtgttcaaatatcattaaggtaggcaatcataaaatcaggaagaaactaatctggtgcagaaggagacaataactggctgcctccaagggtgacttctgccagctgaacacaatgaaaagatgcggggtcgaggaaatttaaagtacagtattgccaagagtgtaacagaaacgacatgccatggacccaaagcggaaagaggaaagtgaagaatgaaggctgatggatcaggagaaagtaaatggaatgcaagatccaatgaggtcaaagaatagttataatttaaggagttgcacaagcaaaccaggagacggtatggtctacgaataggatatctaaattaatattgtggaagtgaaacagttaagagtgacaagtccaaagcgagactgtgaagtaaatggcttaactggcacagggaagctcattagagagaagacgggcaaataattgagtagctatggtgtcatgtgggtcattcaagtggacagtgaaatcacagaagatgtatagagcaggttagaaaaccccacagatgcatggtaaagaaaaatgagggttaattaatatcaattttaatgacaataagtgaatagaaaactcagaacagtggcttttaaaccatagttgccagaactacaggtttcctcaatggtgtctcaaagacgaccccaggacatgggaaaagctaaaaggataggtatctataagacaccatctcttaaaccagagcagtttccattttgtttcctatactgaggatatgtatatgattacaatgtttttaaatgttctgccacttttttaaaaaagtttaaaaagcacttctctagttgtttttttttttttcctctaattatttggaagacttaccttctcatatgcattttctagaaattcaattggacttttcccaaatgctatggcatgcccaaggaatggaattggggagaaaatgtatggaggacttttctacaagagaaaaaaatagtaaattcaattcgtgtttcatttcaagagagaaacccagtttcgtttcatgaccaaacaattaaacaaaatagctattaagacttcaaaaaaaagttaccaaaaaaaaaggaagcatcagaagtaacttgagaacagccaaattgcaaatacctcaagagagtagctattgtagaaaagaacagaaactcaaaacacggtataagataaacgaccagataaacactaaggcactgtaaatttaaatgatggacactgtccagaatatgtccaattattattggtgtctccaggcaacttttctaaccattagtagcaaaaaaccaaaaaggtcaaactacacttgtcccttggcatttgtggagaactggtcccaggaccccctcacagatttgtatccagggatcctcaagtcccttatataaaatggcaaagtatttgcgtataacctatgcacatcctctcatataccttaaaccatttctatattacttacaatacccaatacaatgtaaaggctatataaactgttattaaactgtgtttttttatttgtattattttttattgttgtgttattttgtattgggtttttttcccctgggtattttagatctacacttggctgaattcccaaatgtggaattcgtgtccccagagggcccactatattgtttcttcactacttactactactactactcacaattttagtcccagatacttgcttaaagaaggtatagaaaaagacaagcagtaacttgtagtatagaaagaagggaaatgtttaagaagctatatttacttctcagtaaacaatcaatctcatgcttctctcactgcaagtgaactagagccactgattttagagtttttaagagagtagatcagctctagcaagaactctagcattcttcataaaagtttctttagatgccacaaaatgagacctgcagattacaacattaagtatcctgaaaatcaaacaaaataatgaaaaagggtaatactcctcaattctctggtggtctcaaatagaaaggagcaccacaacctcacagtacacctcagctaatagaactatctttaaacactaaaagtaactttgtcttcccagagacaaatatcatttccttaaagatcccatgtgtaggaaaaaaataaataaataaataactctttcttatgcctggtatggttcaaacaaaaattattttaaaagctacttggtcaaaagtttgtacattgcattgtcagtaaaagggtagttttcaaaagctacttattgctgactgtaaaaggcacaatcaaataacatttgggagattgaaagctaggttaataaggctgttaaattgaagaaaatgattttttttttttttgagacggagtctcattctgtcgcccagactggagtccagtggcgcaatctcggtttactgcaacctccgcctcctaggttcaagtgattctcgggcctcagcttcccaagcagctgggactacaggcgtgtgccaccacatccagctaatttttgttttgttttgttgtattttagtagagatggggtttctccatgttgttcaggctggtctggaactcctgacctcaggtgatccgcccgcttcggcctcccgaagtgctgggattacaggcgtgagccactgctcccggccgagaaactgttacattattagcatcagaggaaggcccttaccacactccagtcactaccattaccacactctacacatcctccttaatatgggtataaaccaccattaggggcactgctacagcccacagaacactgaaccacacagggcagcctccaggatgacgggccagctgccaacagcatctccgtcaggacccccaccaagggccccaacgaccaccgggtcgttcaaacccacagccgccaatccagccaccgccactaggggcaccactgctgcggtcagtacagaccgctacaaccacaaatgccgcaaccacgaccccgtctaggatcagatacacagccggggaggccagcaccgccccccaacacaaggcaatggcgggtgctacagccagcgccaccagcagcagtgccgccgccgcagccactactccagcccccagcgcgcctgccaccaaagccacgccaagcatggccgcagtcgcccccgcccttgccatccactgagccggtcggggccacggagccgcccacgccagcccttcggccgcctcagctgcggcgcgcgccccactcagaccctaaagaatgtacgtaccacccctgcgggcagctggaccaggtggccggcggccagacggatcaggtagaccaggctgagggtgaaggcgcaggcgatcagcagcatggacaagaggttgccgcctgtcaccttctccatcgcctggcccagcaccgacccacccgcctgcagcaagcccagcagcagcatcccagccgccgccgccattcactccgtcggaaacactgaaggccgaggtcgccaccgctcctcccaatcgacggaacgagagaagctggcagatggtcgtccacagggggccttgccccaggtctcctactaaacccagccccacccctcgggtcccacgcgcgccaccccgtgcgtcacagaatggggcgggatgttccgctggccacgccccttaaataacactctgtgaagccgtggtcttcttgcgcgggatagggcacctgaggaagcgggctgcgcctgtggcacagtggtacggggccggaagataacttacctgaagaggcgatcaatccctgagaatcgcgggcgacccgttttttgtgtgcccgggtgcggggtgccgggacacggcgttgaaggcgctgagcggagggatctcagggcgagctcgagcggcgacggcgcgctctgtgattgcaccgcgagcgcctgaggtgatctcggcctacatcgcgtcagcggggccttgggcgtgagcaccgccccctgtccggacgcagggtactggggcacctcgaactgtggcacctcacccttctccggggccacgtcttggggactccgacagccccaaataagccctcggggactggggttgtgaaaagcgaggtcgtgaagacgccggcctcataccgaagggtaggacggtgaggtcagccccgtcccactccaactaaaatcaacctgacaggtattaatatgccaccatgaagttaacaaatgttggtgattaagtatgctaggttttacgaaaacagattttccaaaataaatgtacatgttttaggacgtcgcgagccgtttgaggcagcattccccaaggacgccacttagtctgtaggtttagcggctagaaagattcagaagctgagttcagtcctgccgccacaatcaatcttcgctcctatggcttcacagaagcgtctcccatgactaccaaatttaactccttccagatcacccacgggagcacctgaccggattcatttatttaatcaatgttaagaactaggttttgtgctaagctaggggatagagcagcgaatgagacaaaactgcaaggccctgggggaattagtaggaatatccagtgaaagggaaattaatgaattttataagtatactaatcaagaagtatattcttttcctttgaggtagaatgtaatatagcacctcccctacccaaggcctgggttaagagtatattaactgcttatttctcccctatgcgtggagaggcttatctgtgttccatcgtttcacattccttgaggcacagcgagttcttgcttccctccctagcgctgctgtaaagtcacaaaactgattagcaagtgttacaaaagcatgtattcccaaggacgtaagacatatggtgtaacaaatgtaagagtaatttactgcctttgttcttgcttctgcaagtacacttcatgcaacacgtaactcccaacacaaactgcttaaaaggtgattgatccctttgttcggggctcagactttctggaccctagtccgactgagccggtgatcaccttaataataaaggctctcctgaactctgctcggtctctcccgtctatgatttgtcccgcaacaccagttgcctgcggaacacctctacctagagagctaacactcatccccggtcagtaaatccaaaactaaacccgttgcctcctcctaccaacctgtccctcctataatgcctgtgaagaaaaggcatcactgtgcacactgttgccctctccatgcttcatctaatcagtcatcagatcctataattctaccaccttaaaagtttcaccgtttcttccgtccagtcgcggtggctcacgcctgtaatccctgcactttgggaggccgaggcgggaggatcacctgaggtcaagagttcgagaccagcctcaccaacatgatgaaacctcgtctctactaaaaatacaaaatattagccggacgtggtggcagacgcctttaatcccagctactcgggaggctgaggcaggagaatcacttgaacctgggaggcaaaggttgcagtgagccgagattgcgtcactgtactccagcctgggcaacaagagcaaaactctgtctcaaaaaaaaaaaaaaaaaaaagaaagaaactgtgatatatataaatatatatttatatatttatatatggaatggaatgctacgtggtcacaaaaaggaatgaatgaatggcattttcagcaacctggatgggattgaagactattattctaagtgaagtaactcaggaatggaaaacaaaacatcatatgttctcactcctaagtgagagctaagctatgaggatgcaaaggcataagaatgacacaatggactatggggactcagggaaagggtggaagggggtgagggataaaagattacaaattgggttcagtgtatactactcggcgatggttgcaccaaaatctcacaaatcaccactaaagaacttactcatgtaaccaaataccacatttcttaaaaccctatggaaataaaaaattaaaaaagaaaaaagaacccaacagtcttctattaagccaggtgtaaaagagatttacaaaaatctaaaactatgccattcttctcactaatattttatttttgaaaatatagctataggccgggtgcggtggcttactcctgtaatcccaccactttgggaggccctggtgggtagatcacaagttcaggagtttgagaccagcctgaccaacatggtgaaacaccatctctactaaaaatacaaaaattagccaggcatggtggcgcgtgcctgtaatcccagctactcaggaggctgaggcaggagaatcgcttgaactcgcaaggtggaggttgcagtgagccgagattgtgccactgcactccagcctgagtgacagagcaagacaccgtctcgaaaaaaaaaaaaaagaaaatatagctatattcatgaaatgacattatttatgtaaataattattttcaataaacattttcatttattttaatttgtaatactgtaagttttgatagatataatccatttaaaaaaatgactctctagggttcttaataatttattattttaagtcctaatgtaaccacccaaggggttcaccttgcctgctgcctagacagagccaattcatcaaggcaggggagttgcaataaagtaattcacgcagagccagctgtgtgggagactggagttttattactcaaatcagtctccctgagcatttggagagcagagtttttaaggataacttggtgggtgggagttggggggtagccagtgagccaggtgtggtgattggtcaggggtgaaatcacagggagttgaagctgtcttcctgccttcagtcagttcctgagtggaggccacaacatcagataagccagtttattagtcggtggtgccagctgatccatcaagtgcagggtctgcaaaatatctcaaacactgatcttaagagcagtttagggagggtcagaatcttacagcctccagctgcatgactcctaagtcataatttttaatcctgtggctaatgttagtatagttcccaggcaagaaggaggcctgttttgagaaagggctgttactgtctttgtttaaactataaactacaaactaagttagtttctcccaaagttcgttcagcctacacccaggaatgaacaaagacagcttggaggttagaagcaagatggagtctggctgggcatggtggctcacacctgtaatctcaacattttgggaggccgaggtgggtggatcatttgaggtcaggagtttgaaaccagcctggccaacatggggaaaccccatctcttctaaaaatacaaaaattagctgggcgtggtggtgggcgcctgtaataccagctactgaggaggctgaggcaggagaatcacttgaacctgggaggcagaggttgcagtgagccgagatagcaccactgcactccagcctgggcaacacagtgagactctgtctcaataaaaataaaaataaaaaaataagcaagatggagttggttaagttaaatctctttcattgtctcagtcataattttgcaaaggcggtttcaggttcccttcatagacacagagcagttgtcctgtctgaagtttacctctctgctgctcctcagtgaatgggctttctttaatccctccccattaaaaaaaaaaaaagtcccattcccttgcaggaaaactgtaatgcctacccacagggattggtctccctctggcatccacagcccaccccacaacactccaaaccccaactctacctttcaccagcagagcaattcataagacacaattatgcaaaacataataaatctgattttttccgtaggaggtggttcaggaaaacggtcccatttggcacctcaagtctaggtccctcaagtctctacaacagtatgcaaagaaaatgttcatcttcattcttcttatagttttctggtaacttactgaaccaagcgcacacacactctccaaggacaaacatttttcagtgctgggacaatgcaaattcaggtaagggaagacaaacatttccctaagtgcagataaatctacactgattttcctactcttaacagaatgggttgggcatggtggtttatgcctttaatcccagcactttgggaggccaaggcatgtggatcacgaggagaggagttcaagaccagcctggccagaatggtgaaacccgtctctactaaaactacaaaaaaaaaaattagccaggcatggtggtatgtgcccgtagtcccagctacttgagaagctgaggcaggagaatcacttgaacccaagaggtggaggttgcagtgagctgagattgtgccactgcactccagcctgggcgacagagtgagactccgtctcaaaaaacaaacaagaaacagaattggactgtacaggattgtgctgagagaatcagttttcctattattcattctctggatttcagactatgctagctagagcatttgaaacaacaggaccaatgggaccatctactgctggtggatacttttcagtgacccaaaagatctggcagtagctttgaaattattgcttttctttacagtaggtcagagtaaattatcactattttttaatttattgcttgtaatttgtgtcatatctaagaaccatctaacccaaaatttatacctatgttttcttctaaaagttttatgactttagcttttctatttagaactttgatccattttaagttttgtatatggtgtgaggtagggctccaaatttattattttgctggtggatctagttgttacagcaccatttgttgaaaatactgtttttcccccagtgaatcatctgacacccttgttaaaaattgattaactgggctgggtgcagtggctcatgcctgtaatcccagcactttgggaggcccaggcgggcagatcacaaggtcaggagattgagaccatcctggctaatatggtgaaacactatctctactaaaaatacaaaaaaaaaaaaaaaaaaattagccaggcgtggtggcaggtgcctgtagtcccagctactcgggaggctgaggcaggagaatggcgtgaacctgggaggcggagcttgcagtgagccgagatcacatcactgcactccagcctgggtgacagagcgagactccatctaaaaaaaaaaaaaaaaaaattgattaactgtatatgttagggtttatttttggcctctcagttctattctgttgatctatatgtctatccttatgccagaactacactgtcttgattactgcagttttgtattaagtttgaaagtgagatcccagcactttgggaggccaaggcaggcagatcacctgagcccaggagttcgagaccagcttgggcaacacggtgaaaccccatctctaaaaaataccaaaacattagctaggcatggtggtgtaggcatgtagtcccagctacttgggaggctgaggtgggaagattgcctgagccccagaggttgaggctgcagtgagctgtgattgtgccactgcactcccgcctgggcagcagagtgagaccttgtctcaaattaaaaaaaaagaaagaaagtgagaagtatgagttctccaactttcttattcattttcaagattgttttgactattttgggtccctttaggtttatttcactttaggatcagtttgtcaatttctgcaatgaagccagctggacacttttttctttctgtttttttgtttttttgagacggagatctcactctgtcgcccagtctggaatgcagtggcacaatcttggctcactgcaacctctgccacctgggttccagagatcctcctgcctcagcctcccaagtagctgggactacaggcatgcaccaccatgcctggctaatttttgtatttttagtagagacaggatttcaccatgttggccaggctggtctcgaactcctgacctcagatgatccatccaccttagcctcccaaagtgctgggattacaggagtaagccaccgcacctggcctactttccaatatttttaaaaagatttttgggttgggcgtggtggctcatgcctgtaatcccagcactttgggaggccaaggtgggtggatcaccttaggtcaggagttcaagaccagcctggccaacacagtgaaaccccaactctactaaaaatacaaaaaattagctgggcatggtggcaggtgcctgtaatcccagttactctggaggctgaggcaggagaattgcttgaacccgggaggcggaggttgtagtgagtcgagatcatgccattgcactccagcctgggtaacaagagcaaagctccttctcaaaaaaaaaaaaaaaaaaattatcagagggtgatatggttagatcagtgtttttagaagataagtctggtagcaatgtacggtgtggtttgggcgagtctatgggctaggatatttgttaaaaagtgtgtaattgtagcaatttagcaaaagttgataagaactgacgctttcgtggttctgatgttacccagctttcttcttttctctctgtctctctctcttacttcataccaaagcttcacctagaacattttctagtctttataacttcatttctgaaggaagagtagagaaaccagttcatatcacttaaatttttttaggtcttaagtttgctcatttgttaaatgagaagatagacttcactagacaatttccaaggtccttcacactttaatgttctatggaagtaccttgcctccagtggaaaacattaacaacaaccatcattaagccaatataaacccacaggttctcatccctactgcaagaagttttaaaatagggaaggattagagacacaggctgtatagttgttaaaccaatgttatgttgcacttccaaaatggcaacaaaatatacactttaaattttaacctgcaaaataaatttatttaatatggtctcacatagaaaattattttttaaggtaacaaaaactgcactatgtccacaatatttttttttttttgagacagagtctcgctctgttgcccaggatggagtgcagtggtgccaccttagctcactgcaagctctgcctcctgagttcacgccattctcctgcctcagcctcccgagtagctggaactacaggcgcccgccaccatgcccagctatttttttgtatttttagtagagacagggtttcactgtgttagccaggatggtctcgatctcctgacctcgtgatctgcccgtctcagcctcccaaagtgctgggattacaggcatgagccaccctgcccgggctccacaatattcttaaccacttgtattaggtctctttccattcaaagttatggaaacccaggtcacactccttaagtgggtgaaaagtaaaaagtgcagaagtatggggattgaggatcagacaacataaacaaggttctgtctctctcttggcatccagctctcggcagactactacacactgtgcatgatataccaagactaaaagactcataacctacccgcagaaagagtgcatcttccatagtagctctgcaaaaagatccaaaagaaactgttaatggcctggcttaagtcaaattgtgtccggaattggtgggttcttcgtctcactgacttcaagtatgaagccgaccctcacggtcagtgttacagctcttaagatggcgcctctggagtttgttccttctgatgttcggatgtgttcggagtttcttccttctggtgggatcgtggtctcgctggctcaggagtgaagctgcagaccttcgcagtgagtgttacagctcttaaggcggcgcgtctggagttgttcctttctcccggtgggttcctggtcttgctggcttcaagagtgaagctgcagacctgcgtgttgagtgttacagctcataaaggcagtgtggacccaaagagagagcagcagcaagatttattgcaaagagcgaaagaacaatgcttccgcagtgtggaaggggaccggaacaggttgccactgctggctcaggcagcctgcttttattctcttatctggccccacccacgtcctgctgattggtccattttacagagagcccgagtggtctattttgacagggcgctgattggtgctttacaatccctgagccagacacaaaggttctccacgtccccactagattagctagatacagagtgtcgattggtgtattcaccaaccctgagctagacacagggtgctgattggtgtgtttacaaaccttgagctagatacagagtgccgattggtgtatttacaatcccctagctagacataaaggttctccaagtccccaccagactcaggagcccagctgacttcacccggtggatcccgcacccaccggggccgcaggtagagctgcctgtcaatcccgcaccgtgtgcccgcactcctcagcccttggatggtcgatgggtctgggcgccatggaaccgggggcggcactcgtcggggaggctctggccgcacaggagcccacggaagtgggggaggctcgggcatggtgggctgcaggtcccgagccctgccccgcgggaaggcagctaaggcccggcgagaaattgagcacagcagctgctggcccaggtgctaagcccctcactgtccaggccggctgggctggccggccgctccgagtgcggggccgccgagcccacgcgcacccggaactcgcgctggcccgcaagcaccgcgtgcagcccgggttcccgcccgcgcctctccctgcacacatgcctgcaagctgagggagccggttccggccttggccagcccagaaaggggctcccacagtgcagcggtgggctgaagggctcctcaagtgccgccaaattgggagcccaggcagaggaggcgccgagagcgagcgagggctgtgaggactgccagcacgctgtcacctctcaaaatggcttttcctgggtcagaatcaatcattatggttaaatgagtagaagatattgatgttagtgctggagtaggggaagagacttacacgacaaggtcagctccacattgaaatatgtgcaatgcattccccctatgaaaggttttctgatagcagaagaaggggagaggctcacatgacagacaagacaacagatggccactctatcaatcctgtctggacactcaactgaaggattactggccctggccctagtttatgtttaacaaagctatcccattcctaatggagaaaaagtaggaatggtatatttatttctgtttttaaactagcatctaaaaagaaactgttctgctttctaactccagtgaaaatcactagtaatgttgctacttataaatcgggggttgtataaaagcattatataacagaaaaattttaatagaattattttcaggctaggcatggtggctcacacctgtaatcccagcactttgggaggcccaggcgggcagatcacaaggtcaggagatggagaccatcctgcccaacatggtgaaaccccgtctctactaaaaatacaaaaattatcccggcgtggtggtgggcgcctgtagtcccagctactcaggaggctgaggcagaagcatcacttgaacccagaaggcagaggttgcagtgagccaagatcacaccactgcactccagcctgggcaacaagagcaaaaactccatctcaaaaaaaaaaaaaaaaaaaaaggaattattttcaaatgcaacatcactataataagacaacagaacaaacacacaaaacagtgtctgtaatgttttattataacattagagtgatagttataagttgtcatcatctcttaagaatgaaagaaaaaagatgcaattctcttgtatgataaagtgaagtgaaatggttcacaaacacagtttcaattataagtgcatcaaaagttttcagtttttattattgatccactggttagaatttaattgcacgcgtaaaaagatttaaagctgttattttgtccataatttcatatgctcctatcatagttagtgctcgaattagttgatctcttaaagcagcagcagttagtgataacttgttactttgtgttttccatataacaagtgcttggtgggctctctcacttaatgaaacagtgctgaaaaacattattaataatattaatagttaaatatttattaacgtttaatatatttaaattactgataattatctgaattgtcaattaagaacattgctttaaactcctgtaatattgtatatctaggttttcaaaccaattttatcagactgaagtgaggatgaaattaattggtgaagagaatctctataaaaatttggcatggagcttgggacatagaaagtgaatgttagctccagcccatcccttgtacccttatagaaaatcagcaattcaatttacattcagttctcaagacctcaaaatcataattgtgggttatttctaataaaccagtatattactgctactatactatatgctttttttttttttttttttttagacagagtcttgctgtctcccaggctggagtgcagtagcacgatctcaactcactgcaagctccgcctcccgggttcacgccattctcctgcctcagcctcccgagtagctgggactacaggtgcccaccaccacaccgggctaattttttgtatttttagtagaggcggggtttcaccgtgttagccaggctggtctcaatctcctaacctcgtgatccacccgcctcagcttccctaaatgctgggattacaggtgtgagccactgcacccagctactatatgctttatagcttgatctcacttgattctcatgacaattctcttatatgagtatattcattttaccagtgaagaaaccaagtcatcaagaagttaaaggacttgcccaaggtcacaaagccagttgtgagtaaaagtcagtctgtcctcatagcctttgttctttattatgttatatggccttccaacatggatcacaaacatgtaataaactaaaatcagctttctacagcaaagtagagattgtgttaatacgaatgtttcaaaaccatgcaatatcaacatgatatacatcagaatgagaataaatttgtactaaatgctgtcatttatacatacctctttgtaggcatatcagtttctgagtttgccaggtttagtttttgacataaaaattcaaaattggtttcagtgatgttgttggcaactatcttgaatatcttctctaaaattttctctacgtttgaacataaaataaaatgtatatcttttgaaaaagataatctattttgagttcatattatatctagttttcttatttctgtgcttctatgaaatatatatgttaagtaaaactgaaaatgacaatgctggccgggcacagtggctcacgcctgtaatcccagcactttgggaggccgaggcaggtggatcacctgagatcaggagttcaagaccagcctggccaacatgcaaaaccccatctctaataacaatataaaaattagccaggcatggttgtgtgttcctgtagtcccagctactcgggaggctgaggcaggagactcacttgaaccggggaggcggaggttgcagtgagctgagactacaccactgtactccagcctgggcaacagagcaagactgtctcaaaaaaaaaaaaaatgacaatgacagccatgcgcggtggctcatgcctgtaatcccagcactttgggaggccaaggcgggtggatcacctgaggtcgggagttcgagatcagcctgaccaacatgaagaaaccccgtctctactaaaaatacaaaaaattagccgggcgtggtcgcacatgcctgtaatcccagctactcgggaggctgaggtaggagaatcgcttgaatccaggaggcagaggttgcagtgagccaagattgcaccattgtactccagcctgggcaacaagagtgaaactccgtctcataaaaaaaaaaaaaaatgacaatgacaatgcagatctaaattatgaactgaaatttgaaacatttgacatttgttccatttttttctaaaatttgaaaaatccaacacttaaaatggctgttgaaaagaatatttataagcaacttttttttttttttgagacagagtttcactcttgttgcccaggctggagtgcaatggcatgtgatctggtctcaccgcaacctctgcctcccgggttcaagtgattctcctgcctcagcctcccgagtagctgggattacaggcatgcgccaccacacccagctaattttttgtacttttaatcgagatggggtttctccatgttggtcaggctggtctcgaactcctgacctcaggtgatccgccctcctcggcctcccaaagtgctgggattaaaggcatgagtcaccacactgggcctatttataagcaactttaaagtgacttccaagccctttaatttctccaggatttgaaatgcatttgactgcttccttcaattctggcttttttatgtgcgtgggtgtgttttgttttgttttgttttgttttgttttgttttgtttggtggagaatatgggcaaaaattgtacgtgcttctttatgtgccaacttgagaaactaagttcacatctactataaatatggtgtataagtgcatattttatattcaagtcaattatttaataagttggctgagcaattagtgattttagtttttttaattaaaacttccagctaatttgaacaagatccattttttcttgacaaaggtactgtgagttttttcttttctttcttttagacagggtctcactctgttgctcagactggagtgcagtagcataatcacaggtcaccacagcctcgacctcccaggctcaagcgactctcccacttcacccccgcaagtagctgggaccacaagcatgtgccgccatgcctggctaatttattatttttaatttttatttatttacttattttgagacagagtctggctctgtcacccaggctagagtacagtggcgggatctcatctcactacaatctccgcctcctgattagctggaactacaggtgcctccagattagcaattctcctgcctcagcctcccgagtagctggaactacaggcacgtgccaccatgcccagctaatttttgtatttttagtagagatgggtttttggcatgttggccaggccagtctcaaacttctggcctcaagttatctgcccacctcagtttttaaaattttttgtagagacagggtctcactatacttgatcttagccaaaaggccgagaagcaatagtctcactatattgcccaagctggtctcgaactcctgggctcaagcaatcctcctgccttggcctcccaaagtcctggaactacaggcatgagccactgcccccagcctgtgagaattttcagaactcgagatgtaccatcccgcgtgatcaaatatgttctattttaaaaagttttatatatactctctcaggctatatttcatgctatgatatatatatatatataaaattccaatcttctaagtaaaagtttaagaaaaaggctccatttgttaattgcagataaatacatctcccatactgatttctttctgccctcactggatgccaagcctgcaatatgaaggctccttgggtgtagggaaaggagataaatggctgagattctaagcccttctctaaagtactgtatctaacagaaatactttatggatcctagaaaaccccgaaaatctttattctatagaaatagaattaccataaaagatcctttcattttttagacggagtctcgcactgtcacccgggctggagtgcagtggtgtgatctcggctcactgcaacctctgcctcccgagttcaagcgattctcctgcttcagcctcctgagtaactgggattacaggtgcccaccaccatgcccagctaattttttgtatttctagtagagatggggtttcaccatgttggccaggctgctcttgaactcgtgacctcgtgattcacccaccttggcctcccaaagtgccgggattacaggtgtgagccaccacacctggccaaaaatccctttttatagtaacaattaagacaatcaacttgcacagtaagttaaagaagacagctactgtggcttttaattttgtattttaggttcctttatcaataaagcccaagtcttgcaaaagcctctaaatgatagccatgtatatggatgtatattgtgactttaaagactaagcaatttttcatgactgtctcactatgaaattacattagtacaagctcctgattatgtagacaagatacatgatagaatgatctgaagggatagtttttggtattccatttccccaaatctggatcataactgattgttctcttgcattaaattagaggaccaaaatctggattcattctgactagtgatgaaaagtggcaaatcagagtcctagggaaaagcctaactgttgcgaacccagccccagggaaagaattggacagtgaagattccctcccagacacttgaagccagtcttcatctagtcccttttaaagaaaatgggcctgttctcagaaataatcagacacacaacagagagctcaaggacggatgggataaagactatcaaaatatttcagacagatggtcatagtgggactgactgccatcagtggaatggctccatggttttccctcaaggccgaatgtattttatttatttatttatttatttatctttaaaatagagacaaggtcacacactatgttgcccaggctggtctcgaacttctgagctcaagtgattgtcctgccttggcctcccaaagtgttaggattacaggcatgagccaccacacgcaactccaaatgtcttttagaacaactacatttggtagaacagattggaactgacagatttatgtgtggattttgagtctggccacaatctcaatgaaacacctattgaagggcattaaggtcaatagggtaggaaacagcccacccctcctccacttggatttgcctattttcagtgcctcaatttgtgtggacctggattacgtaatctgaattatcaaaacaaactcctaaacttaagaaaagaaagatcatcaatattttcatatctctgccagattgaaagcctccaattaaagcaaaccatcttttaattcatatcagatagtgtcttgtggcttggtgtggtggctcacgcccgtaatcccaacactgagagaccaagacaggaggattgcttgagctcgggagttcaagactagcctgggcaacacagtgagaccctgtctctactaaaagattaaaaaattagccaggtgcggtgacacatgcctgcagtccctgctactcaggaggctgaggtgggaggatcacttgagcccaggagtccgaggctgcagtgagtcgtgatcatgccactgcagtccagcctgggtgtcagagtgagaccctgtctccaaaaatattaaaataaaataaaataaaaaagaaatgacttgttagatagtcaatcactcatcacctaccatctctttcatctgccctctgtagatagcgtgcaatagtatacaactgttttcctttacagatttccactggaggtctcagcaaagggttgtcatcaaaatttatctccttcagtgaaaaaatattgtagatagcactaggtagagctgtcagattatttcctagtagaaaaaaattagaattgaattacatctttctataaaagaaaactatggagacaaataacatctgttatgtcttgctggcaaagtaccagaggaccctcacaatgcagcaggtcataaattatttctgatgtccacatgctaagagcaaaaaagagtgtttatagaaagacagctgtggttcctttctctcctaggg

SEQ ID NO: 615 - DNA, 555003 bp, Homo sapiens
actctggtcaatgacaaatgtttctcaacatttgtcattgttgagacattgggtgtctaggtggagagtagttgccaagaagaggagggaggttgttcagaattgctacattgggataattgttattcatgaaacccagaactaagttcattcatcagcaactttacctagttctgggcgtagaacagtgaggcggttcctctgaatgtggagctctttaagctgggtaagctccccaatttccttaagcagtgagatcaggtctttatccctattgctgagctaaacagaagaaaacaaggagttgtcaacacattttcacattaaaaggtgctccacagaaactctcatcctcctccacgtcctctcttctaccacagctcagtcctttccatttatttacaagtgctggcggataatcaagaaacactatcagaagtagtggtttattcctgcaaaacaaaccttacttctgctcagatttacttgattctacccctacaaggctgcagcagtgaattgattttctaagaatttagataacttacttactatctgcaactttgtgagcttcccaatatctggtggcaggatttcaaaaccgttgtcacttagatagagtgcacacagggtggctgcaaattaaacagcaatatataaacagggtggcatggaacccaaccatttgaggtctgatcaatacgagggagtcagctttgattaataaccctggcttggtgaaaagcctttgacatacctagggctcccaataataacaagcaggtcaaacttacatttactggcttattgtgtagctggtgtgtccaggaaaacatctatatccaagaggactgatacaattaacaacgtgggcactagcattttggggcacagagtttcaacacattttcaaaaaagattgctatttttctcacagattacttttgattcacatttatttctccattttcatccaaagtaaaacaaagaaaactactgtgccacttttatggatacctagggcaaaaagtttctttcgagggaatacaactatgttaaaatagaccttttcctatgtaaatagcactgtgttaaaaattaatgaaaggctttctggtgatggaggctataaccacagctcatcagttccataatctgactaattattactacttgtttctacagccttaaggccaaaagtaaatgaagaaaaaggggctaaaataatggcatgaagttaacagagtaaatcctaacttcagcggaatatcagcagtcagaaatcctaacttaagcagtaatatcagtagtcagaaattaagcagaatatcagtagtcagaaatttgttcacaattactacacaatgataatatgattacaaactactgaaggctaaaattctaaagcatctgtttatcctcaaccaaaaaagctgagtataattagaggtatgttttgtttatcagtatttatttattttttagagacagagtctcgttctgtcacccagactggagtgcagtgggtcactgcagcctcaaattcctggcctcaagcaatcttcctacctcagcctcccgattagctaagattacaggcacatgctactatgcctggttaattttttaatttttgtttctagagacagggtctctctatgttgcccaggctggtcttaaactcctagcctcaagtgatctttggagctcagactccagaactgtatgttaatgtaacataataaaaacaggtgttccactgcccaagaaaatattttacagttggtttcatgtgcttgagaaagtcatagagataatgtatataaggtaaaaagtgaaattttagagaccagctcagaaaattcagattttctgaatgccacataaattactaattgaagaaatagaacactcatttaagagaagcaaactttgtctgaaatagtgcatgagttcccagaggaaaccattttttaattttcagaagcatcttcagcaagaaatttgttggcatataaaagaataaagtgtgttcacctatggccaataatttcttaatgcctgtgtactggataaataggtcaataagagtactttttaaaaggctggaaataagaatcctggctagaaaatttaagaattctgttagtgatttattaataaatatttttataaataactgattcggacttcctgggcaaatatcctgcaaagaattaataccaacatgggaggatacttttttttggcatgctatttaaaaagaaagtcaagtctcttagctaaatgtgaggcttgatctcatttaggtatataatctctctcagaatgttaatatgatgttactaagtccacttcagcccaacggtgtcacataacgatatatcaaatgcacatactgctgagctactaaggaatattcaaaaggagtctctaaagaaaaaattatctctgtccaataatttctcttggagtttaggtcctggcaaataaatttcactctgagaaggcaaagtatagtgttgaggagatttatagaactgaaagtttcttactcaggtagaagtttccagggggccgggcgcggtggctcacgcctgtaatcccaacactttgggaggccgaggtgggcggatcatgaggtcaggagttcgagaccagtctggctaacaaggtgaaaccccgtctctactaaagatacaaaaattagccaggcatggtggtgcacgcctgtagtcccagctactcgggaggctgaggtaggaggaggcagaggctgcagtgagccgagatcacgccattgcactccagcctgggggacaagagtgaaactccatcttaaaaaaaaaaaaaaaaaagaagaagtttccaggaagagaatttccgttcaagttgtaagtcaagtccagaacctcaagagctggcagagagcagaagcctcgtggcaaagtgttcagcctgttcatgctgttgcagggggacaaaaatctacatcaggacaccaaagacacatttatacagactatcaagagcacctctgtttcacaggctgaaagtgtaagagagtgccatgatcctagagtcactttatttttattttttatttttttgagatggggccttgctctgttgcccaggctggagtgcagtggcacgatcttggctcactgcagcctcgacctccatgggctcaagcaatcctcccacttcagcctcccaagtagctgggaccacaggtgcacaccatcacaccccactaatgtttgcattttttgcagagatgggtttttgccaggttgcccaagctggtctcaaactcctgagctcgagccatcctcctacctcagcctcccagaatgctgggagtataggtgtgagccgccatgcccatcctattttttttaattaaaaaaagtatttatttaatatttacattgacaaatgaagattgtacatacctatgatgtacaacatgatatttctgatatatgtatcatccatcgtggaatgccttaaatcacactatttatatatgcattgcctcatatcatatgcttgtcatttttttgtcttttgtggtgagaacgcttaaaattcactctcttagcaattttcaaatatactacatattgttattgactgcagtcaccatgatgtacaatccatctcttgaacttacttctcccgtctaactaaaatttcgtgtcctttggctaacatctccacaattcccctctccctccagcctctggtgaccattttattccctgtttcaatgaggtttacttttttacattccacatataagtgggatgatgtggtatgttgtcctatttaaactaataattttagagagcttatatattcctgaaacatttggaaatttcttagttgtcatttttctccagtggtgaaatttaatcattcttttacacaaaaactcaaaccatcacaaaatatctgtccttgtaaagaaaaacttcctgatgaatgtagtaataatatctgaaactacacacatgaagctttgtagttttcagatttttgctttatttcatttcattttttccttttaggagggaaaatcatgtttttttttttctacaactgttaaaattcaaagttatcttcaattagaatggtgatggccaggggctggagggaggggcaatggagagatgtattttagtgggtgtaggattcaggtttgcaagatgagaaagttctggagattgactgaacaacaatgtgaatacgcttaacaccattgaactgtatactacaaagacagtaatttttttttttttttgagacagagtctcgctctgtcgtccaggctggagtgcagtggtgagatctcagcttgctgcaacctccacctccccggttcaagcaattctcctgcctcagcctcctgaatagctgggactacaggcatgtgccaccatgcccggctaatttttgcatttttagtagagaaaggtttcaccatgttggccaggatggtcttgatctcttgacctcgtgatcctcctgcctcagcctcccaaagtgctgggattacaggcgtgagccactgcttggccagacagtacattttatgtgcactttatcacaacttaaaaattttttaaatcgtacaattgactcttgagcaacatgggtttgaactgcctgggtccaatgacacatggatatttttcttctgcctctgctacccctgagacaagaagaccaaccctcctcttcctcctcagcccactcaacatgaagaagaggatgaagacctttaagatgatctacttccacctgaagaacagtaaatgcactttgttttccttatgactttcctgataacattttctgttccttagctgactttattgtaagaatgcagaatagaatacatataacacacaaaatatgtgttaatcgacatttatgttttggtaaggcttccggtcaactgtaggctatttgtaattaagtttattcagagtcaaaagttatgtgtggattttcgactccatggggggtcagtgtggtgctccctcaacccatgtgttgctgaagggtcaattgtgtttgggtgggtgcgggggtgtgtggtgtgtgtgggtgtgtatctggtgttgtgtgtagtgttatgtgtgtgtgtacgggggtgttatgtgtggtgtgtggggggtgtgctgtgtgtgtggtgtgtggagggggtgtggtgtgtgtgtgatgtgtgtgggtgggcatggggtgtgtgtgttgtggtgtgtgtggagggtgtggtgtggtggtgtgtgttgtatgtgtggtgtgtgtgggggtatggatgtggtatggtgtggtatgtgtatggggtgtgtgtgggggtgtgggggtgtgtgtgtttacgcagtatgtgtgtgtggtgtgtgtgtgggtgtgtgtgcgtgtttgtgtctgtgtgtgtgtctccgatgaagtctaagggaatttttttcttttctttttttttattatactttaagttctgaggtacatgtgcacaacgtgcaggtttgttacataggtatacatgcaccatgttggtttgctgcacccatcaactcgtcatttacattaggtagttctcctaatgctatccctcccccagccccccaccccctgacaggccccggtgtgtgatgttaagggaattttttttctacactatcttttatccttttctttaagccccttatttttcttaatgccgttccctttgagcacacttaaaagccaattaaaaattaaactttaataaaagttgacagatattgaaaggtggaagggactgtgacaataaaaatcattctagtcatcgatgcttctcataacagatccagctcggtccagtcctaccaagtgggcctcaccagaaacagcagacagcagggggaaaccaaaatggaaacgtgggttccccctctcaggcagaaaacgacccagacagactacacccagcaaaactacctccacgactatctactgcaatgacagcaacaacgaacattctccatgaagtcacaaatttgtgaagcacattatggcaagtacttggcttgttgtattaccttgtaatacaggcaagatggagcttgtaattaatgctatcttgagatgaaaaaaaagcctaagagagagtaaggagcaaagatttcagaagtgactgatgaaggtgacatgtgtctggaagcaccctgtacctcatggaggtcctccctataacttgccttactgtgtgagtataattctttatgccatttgaggacagaggtatcctttagtgaaacccatcttagctcctttcccaaagaactgggaggttttttcaaactttgacaactccgtctatgtagctgtgtagttaaatacaaaaagctttacacaatcaataaagcaccaatagccccaaatgcaaacaactccaaagagaacaagaaggcaactaagatgcattcattgaaaaagaaaagtttagggctgggtgcagtggctcacgcctgtaatcccagcactttgggaggccaaggcgtgtggatcacctgaggtcaggagttcgagatcggcatgaccaacatggtaaaacggcatctctactaaaaatacaaaagtagctgggtgtggtggtatgcacctgtaatcccagctactcgggaggctgaggcaggagaatcgattgaacctaggaggtggagattgcagtgagctgagatcgtgccattgcactggagcctgggcaacaagagcaaaactctgtctaaaaaaaaaaaaaaggaaaagaaaaagaaaagtttatggctctgtcctatggtgcctcaaaccaaacagaaaaaaacctgagcttattattttcttcccaaacctgtctccatctgttctatttttcagctgtccgacacagaaacgtaggtatcattccatcccatcagttactgtctgtcaatgttaccacctgtatatttttcatataaaatccctccctgtctccactgtcactgtcctagttcacatgggacatgaagctcatgttcttactggtctcctaacctctagtttccatccctccaccctcttctccacactgatctttcataggaaaatctgaccatatctcatatccaccacttggctatgcaaatttctcaatggtcagcatgataaaattggagctcgtttatttatttacttatgtatttttgagatgcagtatcactctgtcacataggctggagtgcagtggtatgatctcagctcactgaaacctctgcctcctgggttcaaatgtctctcctgcctgagcctcctgggtagaatacctgggatcataggtgcacaccaccacacttagctaatttttgtatttttagtagagacaaggtttcgccatcttgacaaggctgttcttgaactcctggcctcagctgaccctccagcctcagcctcccaaagtgctgaggctacaggcgtgagccaccacgcctgggaggagcttgtttatttagcacagaggactttcattagcacttttgattccctgccattattataaacatttatttgtttatagttggtttcctcaactgtaatggaagctccatcagggctggatggccagtagctagaataatgcctggtacacgattgggaacttggtaaatcctcattcactgaacagcagatatccaggattccctgtctagcctgacctctgaccttacagccacctgcctcacactttatactcaacagtgccaaaaaaccgacaattcctaggccccaggcaggcagtgctgtgagtgtttaaatatgtcattcgcggctgggcgtggtggctcatgcctataaccccagcactttgggaggccgaggagtgtggatcatgaggtcaagagattgattgagaccatcctggccaacatggtaaaaccccgtctatactaaaaatacaaaagttagctgggtgtggtggtgtgcacctgtagtcccagctacttgggaggctgagacaggaaaatcgcttaaccctgagaggcagaggttgcagtgagctgcgatcgtatcactgcactccggcctggcgacaaagcaagactccgtctcaaaaataaaaataaaaataaaaaaattggcaaatatctgtccagcatctattgccactccacgtcaatcactaatttaaccagagcatttagtggctacaatttaatgagtatacgactttgcacagagactgaagcatgagtgggcagtttcatctaatagctgtgccaatgaagatggaattctgatgctgcagttccgcttggggtctatggatgtattcgtctgttctcccattgctataaaggaatgcctgaggctaggtaacttacaagaaaagaggtttaactgactcatggttctaccggctgtataagaagcatggcagctactgcttgtggggaggcctcagggagcttttactcgtggtggaaggcaatgcaggagcatgtgtattacatggcaggagaaggagagcacgaggggtcttgcaataactcactcactatcataaggacagtaccaagaggggatggtgctaaaccattcatgagagctccgcccgcagatctaatcacctcccaccaggccccacctccaacaatggggattacaattccacatgagatttggtggggacacagatccagaccatatcaatggagtctgatggagcctttagacccagaaccatggggttctcttcccagcttggccactaacctcaggggtgaccaggacccagtcccttagcccctttgaaaaggcttggcttcctctgtataaaatgaaagcactaaaacctgctttccctacctcacaaatgttaagaggatcaagtgctgcaaagcaatacacgaagacaggttatcattattattatttaccgctccccggttctgcaacctcagttgaaccaaaactcctctcttcacctttgcataaagaaagacagaggattgtcacctctcaactacagagaagaattgcaaaaatgaatgaagcagcattagggaatatattcttccctccatggcatgaaggtgctttataaactattcctatttaacacagacagaaaaaaaatcaaccatactacaacttgtctgtcagttcacgttatgcaaataagtcccttcttggtcaacagaactgagataaaattttactggacacaaaatacagtaaaaatttaacttccttattgtgccaactattagcttctcaattagctctcaaatcttcactaatgtaggccaccaaaaggacatattaaaacaataaaactttttttaaaacccaaaacacaaaaagaaatcagaaatccacttctgtgtaatgatataaatggaatccctcccctggccctacccagcacgccccttccactctctttctctccatcctttcctctccactgatactcacccaaggttcaggtgtttgagtttttgaagcctgctgatctgtgttggcagctcctcgatctggttatttaaaaatttgagcacttccaaattcttcagttctgctgtgtttggtggcaccaccatggaaacataaatgctgagtgtgaatctgggaacggaactcctagcaagggatggcagcagcacactttgtttttcttcaaagctaagaaacatataactccaaaaggaccatcgaattcacctatcggtcttacttattttttatgggtttttcataagcagtcactcacttctgagtggccgctgaaatgctccttcgtatatcattagctaagtgtttggcatagtttgtttcagacagacaatgaagagggaaacagagcaaaaaggcacaaaagagaatttctgtaccatagcagcctataaaagtgaatattacgaagcatatacacttatagctgtcatataggatcttttaagtgcaattgtttttttctttcggttttcttgcattgccaccagaagaaagacagcaacctccaaatcccttcctgggtgacatacattgaagctgtttaacccagtatctgaacagctgtcctcttaacattgcattatattagctcaattttaaataatgaaatattcaatctccctagtttctgattttggcctctggagtaatgtatcttgaacaataccacacacacatacaaacatacacacatacatacacatacacacacacacaaatgttacatcagattagcaacacatcgatatactgttattatatggaaataaaaaagtcaactcagtaacatgctatgaacactagtgtgcagatcaaaggtgaaaatcaaccactggggacctgaaaggttcctccttccctagcatatatatacttgaaaatacaaatgtaaaagccaaaggcatctttatctcaaaagtacaaactataaattggcagtagaaggactttccataggctgtaattcatctatcccatttgctattcaatcattctacaaacatttgtatgggcgataagcttggccatggttcatgtaaactctgataccaagactatccaggtaactaaaaacatgaacagggacctggagcccagtctgaaaaagtgtgatatctcatatcagtcaggtttacttcccatcccatctgcttcctccaggggtgccccaggaggccagaaaaccaacctgcttgcctgcagtcagacctaaactcagacccaagagcacttgtgatcagaaccagcacaaaggtgagtgtaaaatgccaaacatacatctaaaatatttaagcagctagccatttcaaggacaccaattgataactcctagggcaacaaaattaaaaggacaggcacattgctaattatagttttgagtaatcattttcagctttctgaaatgtctacagtatcgctgacctgatttcttttagagtgaatgcttggtgaaaggtaaaagaaatgttttcactggaagaagggactgtgaagaatacggattactctgaactagggcacatgggcagggagcagtggtctagtgagcagtccctgggtgagctcctgaagtggctgttgataaaagaacaggttttcatggggtaatctagacagctggaagttcctccagaaccctccctcttggatacctgcaggaattgaaaggaatcctacctgtacaatatggacacaaatgcacattcttaggtgcacactccatggaacacttctgtggaaatgaatggtattcaccttgtgtaagcaattatcaagaaaatcaccagggccaggagtggtgccttatgcctataatcccagcactttgggaggccgaggcaggtggattacctgaggccaggagtttgagactagcctgaccaacacggtgaaaccccgactctactcaaaatacaaaaattagccgggcatggtggcaggtgcctgtaatcccagctactcgggaggctgaggcaggagaatcacttgaacccaggaggcagaggtggcagtgagctaagatcatgccattgcactccagtctgggtgacaagagtgaaactctatctcaaaggaaaagaaaatcaccaggctgtgtcttctaggtcactggatgtcatctcctccccccagatcataaagtatatacagtgcagctgcccacagacctcatccctcccctgtccaccctccagctaccactaagccttcatctgattagtttgaagagtaataacaaaagttagtgaaatcaggagaaaacgatgatctcaaattagccacaaaccaagaataatgcagccagaattactgtcatcttcccaaagttactctgccagttgaattaaatgctcgtctaaaggtatcgcctttttgacaggatgagagattatttcactctccttgctaaatcagtccaatttaaaaccacaaattatgctaaatgtggtttagggctttgtcttgtggatgcaaacaataacctcatattcaatttacaaaacctctcccagccttttggtgagcatgtgaattttttgcttaagactccattcaagctagatgagaaaaaaaattacacagctaatattctccctaatatacagaattttttaaacccccagtcatagtgaaaatctaaagaaattaacatgcagacccatctggatgggatggtattcactctttgaaccaatacttagagaatgctgattaggtgcacagcaccatactttttacacatagcatctcaatactttggggataaagtaggagaggaatgttacttaaggaaagtaagttacaaaagatagggtatcaaagtcaataaactgaaacaggcctagtgcttggaatataaactactcccaaccaaactagttgtccagaaaaaataaccagttagcaatatgaattgtgtcatgactaaatcatatacatatgtggcaggaacaattttagctatttcaaaaaggccactgcgatatcttaccagtcaaaatattttattggaattttccaaatagctataggatgcatgagcaagaagcatttaaaacctaatagcgtgcatcagtatatttcttatcatgtctttgaaacgttcctttttcatcaatctatccagcttctgacctatgaccccagctgacctatgacatcaaagaaactgaagagcaatgtggtccttggccctacagtgctgtgtgtgcccttactcaactcataacctctctgggcctctgtaaaataagaagactggattatgaccatttccaaggtctcttccactttgttttaacattctaggattctaaaaggagatggattatgaaaatcaatgatatggctttaaataattcaacaaatggggccctcaattaggaagcttagtcatgtagaactttgcttttgacaaagaattgagtatcattttctgcctagccaaagacggttgctttaagtttgagacttcagttgctaggtttgggggaacagtcccaaaggactcagacattccctggctcctcaatgtcacattttgctctagccgcaggatcacaggactgctggggatgctctcgtcccagagcatctgctggtgttttggaaaggtgacaaggatgtggtcacatcaccccagagacaaatctcaaagtttcttctaggctctgcagcagttccacctaacacacctggcatgaccttttttccttcaagttctcctaaactgaagaacctgaatgtgattcaagagttttgtccatctgatgtgccagccctagacttggcaattcagcacccctgactcctgcagcacagtttctggaaggttccacaagcagcccaaagtgcctgaagggctcattaacttctctttggctggaagcacctccactttgctggacaggctggagaaaccacagtccatctgtgcgaaacactggcacagccccttcctgagcaacagctttactcctaaaaggacatgtatctacggccattggttatatctgcaacaggcatgagccacccggcactgcacagttgatgcacattcacaaaatcaacaatcaatcagctcaagaataggcttcccccaaccagccagcagcccgcaaactatctcccctccacacgaagaatcaaaatcaactactgttataacaatagtttcaattctgttgaattgagtaaggaaaattctgttctatgatctaaaattaataattccacaaccaacaacttaaagcattttaggagtttacacaataataattagcagggtgtgttctggggctgggctatctgatggacagccactagctatatgcagctatttgaatttaaacctagattaatcaaaaataaaatgatgaatgctattgtttggtcacagcagccacatttaaagagctcaatagccacatgtggtgtctagtggcttcactactgcatggcagggatactgaccgtttcatcaccacagaacgttctattagacagccctgctctatggcagtgggtctcaaaccacggagacatcggaatcaccagaggccttgctaaaacacagatggaggggtatcccagagtttctgatttagtagtaggtttggggtaaagcctgagaatctgaatttccagcaacttctcaggggatgctgatgttgctgttctgggaaccatattatggctcagaaaacttttaattcattggcagcatcacgattatcgatccaacacatatgtcccttaccccatgcaataatgcgatgagtataataatcaatcttatccaaatgaagacgcctactgagcctggggattgatgagaagtgaaacaaatgatactctagatagctaacacgttcaacgtgggtgccacaatcaaaccctttctagtcaacttctgcttccccacacaggattttatggtaagatcagtattgcttaagatggacaatgttccagaggagaaaagccttgaattccctagcacactgaattaagtcacttggtggcaaattcatcatgaccaagggtggccatacaaagagatgtcacctgctatactgctcagcttcaaaacactgaaccttaacggcaggatgctgggtggtagtgatggcacagacagaccggcttgggtgcagctgattagggggctttttgagcaaaagcatcttgtggcccttgaggcaaagaaacaaagctgtaaggagcgacagactctgggagcagcaggcacaatgcaaaaacataaggacaggaggtctgcttgggtgcagcccacgggagggtgagggggtcacactttggtctttagagtcatatggttaccagcaacagtcaggttctcttcagctccagaagggcagcactagaccctgcaccatgataacgcatacccacggctgccaggaagccagaagctgctccaaacacatggcactttccatccacagcacgggcatgaaatctggcggtgacctccacccaccatctccaccaaacttctggggagttgggggctgcactacacccaactgtttttgcagaagcaccaaaggatgtttttagagctagtgattcctgagctagggctggcccagagcatgaaagccaggggacaaagcctctttgaaaaaagtgaactgatgtctgaacctctgcttccagtgatggatggtgaattacagcaagggaatgaagaggaggacttagggcaggcaattgctcacagccagggctaggacagcaggtggcacaggggcatgcccgcccttgtgctgcaatggaggcaacatactgtgctgtgcccatttccaggatgcaaaaatgccacctaccctcaggccaaagggtccccaaagaaaccacatggaatgagtcacagcaaaatgaagctgagtagcattgcttctaaaaacctgacatactgctattttaaaaaaaggaggtttttgtctgttgccgtaacaaatgaaaatgcctggtcagatgttcacaatgtcgtatatttctacagctttttaaaataaagcatagaaggatagaggatggtagaggatattaaaatgagcttgtcacttagataacttagtatgttacattactacaattaagttactagaaaaaccactaaaaacctgagaatagatgaaaatgagtgagattattcattatatatacgggagagggaaggaccacttatgagaaaatggtgaaagtaaacatttccttgccccagcatttgatgaatatgatactgaaaaacaagtgcccctctttggcctgaatgaagcaagggagaaaaaaaacaaattagcagaaacgtgatgaaatatgacttggggcatccgtggtcaaagtgaaagcacaggctttttaatctctagccataataactggagaacattagtccattcacagcacaaaggtggtgtctagactaattatagacatgccaagtctttcagcaaatcatagttctcgatgccattttaatgattttacataaagaagaatcttctcactctcgcgtaggaataattaaactattcagcactttatatgcaaaaaaggtcatttgtagttatactgattaattaccttcaagtcctcctaagcactttatatgcaaaaaaaggtcatttgtagtcatagtgattaattacctttgttttctggccaaaaacacaaggtggataatgaacttattacatattaccataagagtttgaaattcgaaagtatactaatgataactggcttcacagattttacggaatttcacccaaagcagctattaaagcagtgaattacagtagttctaggttatttaaagtttatgaaacagtgaaacaaattctcatttaaaaggttctacatgttcctcaaggtaaacataaaatagcaaaatatcgaagcatctaccccaagaaaggccaacaaatattattagctttataaataacaaagttctccaaatattattagttttataaataacaaaggcaatgctactttcagttaataaacaacaagtatttactgagaacctgtgccccgaaagcacatgctcactctatgctattatgagccgcctcaggattctatagcctaagttatttagtaaacaaaaatgtccctggcttaactcactgcaacacaatggtcctactctttcagcagcaatgtgaaaatgaattgcatgaaaattagagaaaaaaggtataagcaagtaataaggtagattttagtgtataaagccaaacgtgcaaaaatatatgttcctgagctataaaaaggtgtatgcataaccaaacaaatctcctaaaaaactgacaagcatagatttcttctcctctgagcatataaaaattagttaatttctgaatcttgtgttaacttccaaagcatcttcaggaggacatatgaactctgaattcttgcaggaacaccgcttctaaattgcactccagttctgatgcgctacccctccagcaaagccatacatgaataaagagctttaattggggagctgggagggagaagcagcgctgagaggaaaggaagtggcattcaatggcattcagtggcctggggaggaagtgacatccagcgaagggtaagaaaaggaagggtaggaaaaatgcccaggaaattccaaaacaccgggaagagagagaaagagaatatgaaaaaaaacttcaacccatcaatggagaataacaagctcagtgttataaaaggagtgatctaggctcttttatatgagtacatgtctttattatgtataatatatatgaatgtatatctatatgtaagcctcgattattaacattacgaggtagacagtaagcaagtcacattctatcttgcactctcttacacgcacacataaaaagcatgttttgtcattagtttctgtcttcttttacaattaagaattaatctaggctgggtgcagtggctcacacttgtaatcccagcactttgggaagctgagatgggtgggttgcttgagcccaggagtttcagaccagcctgggcaacagggcaaaaccccacctctacaaaaaattagcttggcatggtggtgcatgcctgtagtcccagctactcaggagcctaaggtggaaagatcacttgaacctggaggttaaggctgcagtgagccgagattgcaccactgcactccagcctgggcaacaaagtaaggccctgtctcaaaaaaaaaaaaaaaaaaaaaaggaattaatccagcaagaggccaaaactggactgcttcttttcctactggaccttatctttagggtcactgcatgaggagggcaggaatgggagggaaaggaagaggcccagggctgggaaaatccaccaaatccacatgggagctttgatcttcccctttgaactaacacagctatggcttttaaccttaggaaatgtccctgttcttctaatggaatgagtaaggatccagagccacaggaacactttgtccatggcgttcctagattgacctgatggggcatctcaagtgcacaagtgcacacacacatcacttgcagagacagcaggggacatggtggagcagccacttggaagccatgcagaaagctctgtcgttccctcgttctggtcacttaaccactttacacctgtttcctccacgtgatatagagtgggggttcaacaaatttgctcttttccctttcatctcctgctgaagttattacataggtgttgttcttgatggtccccaggctgtggggtaccttgtatttctttccacacattgctggttcagttggatgaaaaggagggcttcacagagaaagatgagcattcatctcaactttctgaaggatgagcaaaattcagagagaggggtaggaacttaagattttagaaaaaaacaggtaactagaacaaaaaatatataggcaggggaaaagaagctaaagaaatagcaaaaaattagacaaaagagggttcagactgaaaacagcaaaatgcaaggtccattagtttgttaactggttatcaattgtattcaagtggttttggcctatgaggctgactgacgaagaaagcgaaaaatggaaatgggaaaggtattccatttaaaagtatctgcatgtgtccacaccatgttccattcaagcctgggagctaaagattacaaattcttatttaaccaaatgtaaatttaagcagataaataaggtggcacttatcaacaatttttaagaagccattaagaatgagttctgtgatgcattaaaaattatctaaagttttaaacaaatttccaagaagcatctcctttaagaaatagcatcactaggccaaggcagatagatagcttgaggccaggagttcaagaccagcctggccaacatggtgaaagccgtctctaccaaaaacaaaaactagctgggcatggtgatgcatgcctgtagtcccagctactagggaggctgaggcagaagaatcacttgaacctgggagacggaggttgcagtgagccgaaatcatgccactgcattccaacctggatgacagagtgagaccctgtctcaaaaaaaaaaaaaaaaatagcatcactatgtccacactgcgtacaaacatactagtgttatcttcacccaactctggagtttctaaatctgagctacgtagacctctaaaaaattcatggatgaacacaatgggatccataagcctgctgaaattagaaccatcacgtgcacttctctatggatcagggttgtagttttcactctattatttaaaaaagtcagtgacttaagaaaagttaagaaggccaggcacagtggctcacagtggcctgtaattccaatactttgggaggccgaagaaggaggatcacttgagcccaggagatcgagtccagcctgggcaaattagccaggcgtggtggtgcacatccatctaggaggcttgcttgagcccaggagtttcaggttacagtgggctaggatcatgccactgcactccagcctgggtgataaagacactatctctaaaaaataaaaacataaaaaaagagaagagatgctctagaagaatgtatgtacctaagtatcgcacttcttagtgtatctcctctaacatcctgtacatacactcacatgtacacacacaccaagttatttaggagagagtgcatcaactgaaaatctatgtataatattttgctattacatcaattctgtttgatagacattctatcatcaatagcaaaagaaatctttttcaggatcagccgtgcacatgggctaactaggagttggaaagtgacagacttacactcccccatcttattttctccacagcctgccaccgttctgaagttctcacgattggggtggttccatttaaaaatatactgtggaggaattagcatgttagctagctgccacttagcacagtacaggacctcaagaaaaaggattctggaacaggtacattttggttggtggggccgagaacaaagagaatgggggcaagggggtggccacagtctacaagctgagaatagataagatgccatcgggcggacacttcttcaacttcacccgctggccttgggttgcactggttctgggtccctgggtcaacagatcctcccatgggacaatctcaggagctcactcactaaagacaaaaatagcaacacatgcccaattgccagtgatttctgctcctctcccttctgccaccctccaccctattaaatgaaaagaacattccatgctcatagataggaagaatcaatattattaaaatggccatacttctcccccagatttacagattcaatgctattcaatgcattgaatgttaaaacccagattctcaccgtgtgcaatttgtcagtggccaatgtggaagaactcagaagtgctccttaaaaaatactgaggtctcggggcaggcacagtggctcatgtctggaatcctagcactctgggaggccgaggcgggtgctctggagttcgagaccagcctgggcaagctgggcaacagagggagacttcatctcacaaaaaaaaaaaaaaaaaaaaaaaggcagggtggtaaagaaaaggacaggcagcaccattgcaaggacaggtagcaccattgcaagctggagccaaaatgatatcacccctgatgggtcctcctttttgagaatcccattatctcctatgaatcctgatgttctgaaaaaaatgtgtgagctgcttggctaagttgcaaatgatggtagagtagattctcaggactgtattttcatgctgtttcctttctttcaatgtaggagacaatgacttggcccagcagctagcagttctctgtggcagagagatccctgggcccatccggtctactgagagtacacattcatccgcttcaccttggactccagtgtaaccagggcaggcttcaatgcatcctttcacaagagtaatgagtttaaatatttttttaatcccatgttatcccatctcctctcctttcctctctctttctctcttcttaatatagttttctgggcaccaggacgcaaggcaagtcagaggacatgggtctctgcccaggttctggatggctggctccccttatgtcaatgctgagtcctgatccaaagcactgtggccaagtagtacaaaagtgtcctgccttaaggtctctgggtggggcatcttcactccagaggaggtgtgtccatggaatgcatgagagagagctttaaagcaatttttcagcctaactaagggctggaactagagcacagctcatatccataactcatcgaaggagcaaaacatcatcatttatccttataaattacttggttaaagtcatccatttgagggttggcaggaagagtttgttgctcttgaaatatgaacttgatgagtcaaaaacaggcaccatatatgggatgccatcatgcacaatatgattgagacttttaaaacttgacatgtgaagtccagtaacagccttaaatccaaatcaaatgaaaagtaataaagtagtccatggaagagtgaaagactcccatgtttttaactgtaaaacataattttaaagtagattctcaatctaacattaaaaattaatctaatatttcctccatgcttatatataccttttataaagtagggagcaactgacgataaattgtgttcctcacgctcaacagaggaaggctgcatagtggcttaagagcatgggctttggaattagacctaagataaattttcacctctgcaatttaactagctctgtgagctgtctacctttccttgctgatgagcttctagtccctgaaaactggagaattaatgcctgctcctttcatcctcttccttcatctcctgccctctcactctcatgtatatattaatatgtatggcagttcattatacatacatacatatgtatatgtatatagtgatggtagaaccattgtaatttatttgtatgtgtgtatatatgtgtgtgtatgtatgtatataatatatataaatatgtgtgtgtatctatgagtgtgtgtgtgtatatatgtgtgtgtatatatatatatatacatggcagctcatggtctagaatatatttcaaatttaacctgtgatataatggactttggagactcataagcaaggaggatgggtggggtatgagagataaaaaactatatgttgggtgtaatgtatactagtcaggtaactagtgcactaaaacctgagacttcaccagtatgcaattcatccgtgtaaccaaaaaccacttgtaccccaattagatagatagatagatagatggatagatagatagatagatagataattcataacaaaaaaaattaacctttgaaaactgaacacttaattcccacccttttccatgccactacccccgcccccagttctacactcctcacaatgttagcaaatggaaagtacatttttctcattatttaaggcaaaaatcttgatgttatttttgatgtttctgttggtctcatacttaaccatcaacaaatcacactggctctaccctcacaatgtatctagatttcaaccacgcccctccatttctgttgctaccagcctagcccatgcgcctatcatctctccttggcctcaggcagtcccctttttattggacactctgctcctgccctttgctgccctccactccttacagtttaaggactgcacatagagtgatattttcaaatgtaagtgagatcatgccattctgaggcccaaaacactttgtcttcctcttcttactcagagtaagtcttttcagtttccagcatgacctagacatgctgctacctttggaatctctcattctgcctcatccattctgacttccatgatgtacctctaccacatcaagcctttacactaactgttttctgaactggaatgttttctcccacatatccatctggcttgattcttttatttcattaatgtctctgctaagatgttactccaatgacgtggcttttccaacttaactctgacaataaagtacccttctccctcctcccgtccatttttctttatagaatttatcaccatctcacatattatgtatttgtttattttatgtcttccccatctataaagaaatctttatgaaagtaggtaatttgtcttcattacttacctctatatcccatatctcagtcaaccaccacaaactgagtagccaatagcatatgctcaatacatgcttgttatactaatcatttcctacactctggctttattttcaagaatttttattgcctacactttgaaaaccccccaagaaaactaagaaagcataaaaatccagttgccaatcctatttaaataatctacctttgtttctttgtgggaaggctgcggcggatatttgcatgcagacacgggatcattacgtcccccaagtatccggagacctacccatccaacctcaactgttcttggcacgtcctggtccaaagtggcctgaccattgctgtccattttgaacagcctttccgagattcttcttgcaaccagggggattacttggtggtaggtcttgcttgctaccctttctaattacgttttccatagacttcattcagaaaacaaaatgataatttttctctcctgggacataaatggataagaattatgtactctttcttttgcaatgtaaaggagttgatgcaattttaatttgtctttccagctaagaaatggtcctgatatctatcctccacccttcggaccctgtggaggaaatgttcatttttgtggcagtcgtgcttcatcgactctgttcacctcggataatcaaatgtttgttcagtttatttctgattagagtaatgaagggcaaggatttcagatcaaatatggggaaaagagtttacgtaagtattttcactgagaattatatatacttttcctgcaattgcttggtcttctttgattaaatagatttgagaaaaaacatataaagttttcttttctgaactaacagtaatagaattaataagaatgcctactctcaagtacttattatgtttgatacattcaatatctcatcgtgactacttttcaagtaaagtatcattatttcgattttaaagataagtaaaatgaggcttggacttttccaaggccacatatctaattagtgaccaaagtgaaatgttccatgagtataagatacgctattcttcttgatccctgaaattccttagacctttccattataagatgtctaattgtaagttaaatctagttatagaaacattataagaattacatttgccctattttgtaataatgtgtatgctgtttttaaaagaatacataatcttttgattctattattactgatttaattatatattacctaagatctttacttaattgcttgtacttaattacacttgattataattgcatttaattttactgtaatgatttgattttggggacatttactttttagtaatgtttaattgaataaataaataaataaataaataggcatcacttccaaaaaacggagtaatgtcagtagaaagcaatataataataaatttttgctctgtcccaccagaagttagataatatagatttcaaaatgatcctattacttgtatcccagattcctaaatgcatttatatatatatatatatatcagtgaaatcatgttttattgcacattgtatgaaatttaaagtcaacatcatttcttcattttgctaaaagaaatgagtaagagtgtttaccaactgacacacaaaaataatcgaatagctggagtaaggtccaaaacaccagagaaggggctttggtcacttcccagtgcacagagctgtggcacaaggagggagctttaatgcagctctgtgggcatctgcactatggctttctaggctgggaccttctcatccctccctctctccatgctgagctttgcagctgagtcatgaattggcaggttttcacctggtaccaaagcatttcaagagtagcagtgtcttgagtctagtgagtagatgtcagcccatcctataggactctacttttctatttttatttatgataaactcagtctttttttctttcttgagacagggtcttgctctgtcacccaggctggagtgcagtggtgcaatctcagctcactgcaacctctgcctcccaggctcaagtgattctccttactcagcctccctagaagctgggattacaggtatgtatcatcacgcccagctaatttttgtatttttggtagagatggggtttcatcatgttgcccaggctagtcttgaactcctgagctcaggtaagccagctgcctcagcctcccaaagtgctgtgattactggagtgagccattgtgcccagccaatagacttagtcttgatttaaatttttaaagtcaacatttaatggtaattcagatacactatttgacattgcacctcttctatttctttgtggactcactgttcatgcaagtatggtcatggctgttgctttctccctatctttcttgaagcttgttatgactgccgttaacatcagacttaaacaaaagtattttgatttcacaacctattgttggcaacctgaaacaacagcatcactcttatttctctctacttaccaactcaatcatgttccataactatagtcagccttctacttcccacatctatctggctatcttcccaccatatctacttccatgccactcctatttctcagcctttaacataggtccttttgtgaacatctttcgacactgaatcacctagttttataccgtttttctccagagacactccttcgctatggttgattgagatttctaggatcctgtggtagatgccttttattctcaccagattaataggcctattaattaatcaatcaaacatttacaaagtgtttcacatcatgaaaactactagagttctggcaaggagttcacagcttggtagacgagacagacaagcaaaggcacagttagaacatgatgtagggctggacacggtggttcatgcctgtaatcccagcacttcaggaagccaaggcaggaggatcacttaagcttaggagtttgagaccaacctgggcaacacagaaagaccttgtctctaccaaaaaattttttaaagtagctgggcatggtggcacacttctgtggtgccagctactcagtaagctgagttgggaggatcacttgagcccgggcaattgaggctgcagtgagccatgatcataccatggcactccagcctgggtgacagagcaagaccctgtctcaaaaaaaaaaaaaaaaaaaaaagaacatggtatatggtatatggtataataagcgctacgtacagaacagaaacacctacttcagcccaggacatcagagagggctccagaggaagtagatgaagagatttgccaatcagtgataaaaagatgtgagtgcatagaaagtctcaatgttaaaagtcatatttaataatttgaaagaattcaccactgctttggaatagagtcaaaaagaggtaaacataatagtgatgaagcaggcaggaatcactgtgctcagggccatggatgccaccgtaagttagttagatgttaatcaaaaagtaatgggaggcattggaagattttactccaaagcctgaacagtgtgatcagattaaaaacactaatgtggctgcaacactgaaaacattggaggcagggaagactaaagagagagagaccagatgaaagagtaatttaggaaaaaatattactccctgaactaaggcaatgccagtaagaaagtaggagagagggcatatcaaatatattatcaacacgggatggagtgaatttggaggtcagctggatgtgaggcaggagggaagggatgggaggagccttaggagcagttgttaggtttttggctgggtggatccattcatcccacagacatttattaagaactttccatgggacagacactgtattaggtcccggggatatagcagtaaacaaacaaaatccatgtcctcatggagcctaatcctagtgttaagacgtagacaataaataagtaaaatatataacatgccatatggtgaaaggtatccaggagaaaaataaggcagtaagggtggatacagagtgtccataggaagaggggctgatgctgtcatcagcagactcaggtatggaactctggatgatgagcaaatgagagtgttcatttgagacatcttcagtttgaaacttctgaattacccccattggagatgcccagtaagtggtcggaacaggagtttggaggacagaacaggggtctagactgaatctgtaaatatcaacagaatttgaattatccagaatttggaattatcaatagactgcttacagtttaagtcattaggatgtataacagcaattggggaattatttagagtgagaagaaaggcctacaggaggattcctgagggccttcagcaatgtcagggaagccctgaagagaggcgcccaagaaccagaggcagaatgatgcgaggagtaaaaggaggagaagagcttggtgtcacagaagccaagcgacaaaaatgtaaagaaagacaacgtgatcaacaatgttaaatgctgtggatataaaataataatttaaaaagtcatttgggcatataactgcgaggtgacttgggagaacatgagtgctttcatagggttgaagaaagaagggcgaaaagagagaaagagagagacagacagacagacagagagattaaatagaccaggatcccggaggagacaataggatgggaacttgatccagagatacaggaagataatatacagaggagaaaatagagtgtagagatgtggatgaatttattaaggatagtaacaaatgaaggctaaaaaatggaagggattattatgtaatttcttctattttctttgtaaagtggagcctaatgtagtgtgctgagaaccaaaaggaattggggaaagtcaagggtttatggagtaaagttacaaaaggctgttgtagtttatatgaaaagaaatgggtgaattgcttcgcagtgttgagatgggagaacgtatatttgcagaggcatcagtttccatgaatgaatggattgacttgaacacaaccacggagttggtattttgcaagggaagtctgaaggaaagacatgaagcaagggagctggaggtcatcaaagggatttgcaatttagagtttcagagatgggggagttggaggtattgacagaattcaggatgtgactgtaagtggatgagtgacagtggacataaatgttgctagagttgagcagatcaagtatctgtgtggctaagtgattggacaggttaatttcactggcattgtaagtacatttactcctgtctggtttgtttgttgaaaatgccaaagaatatttattgataatagaaaagtattttttgataatactttgtttttttttagaaaagaagtattaaaaagctcctttatcttctggcaaaacatggctaataaattgtctgatgccattgatcttgtttctcaaatgcatctaaatcccgaagaaatgtaatgaatgaatgctcccagagttgtgcaaagatatatctgcttagtcttttaaatataccaagatcatagctctgcatcattctgctgtactgaacgctcagtgggaagcggtaactgctagcatacttacatgcttatcgaagtgctggatatttattcatgcttctgtgatgttctgccccatgcacatgtgccataatcatttggttggttttaagaaagaatgaaatttccaatgagaatagatagatggtctggcaaattaaaaagtgtcacacctggtagctccctccatagcaaatagagaattcatttgctgggaaaaaaatgaggatcataacagatgaaaggaaattgagacaagttacagagaattcgactttaaaagatgatttgtgtccattaaatgcatctccttcaccagatcgtagactgatttaactgtgtttgctgacagcctgtgggggcaacatctacatccatgaagctgattctgctgggtatgtgacctcccccagccaccctgataattatccccctgcacgctgattgcatttggatcttagcggttccaccggaaacacgcatacggctgcaatttgaaggtcaattcgatattgaagtaacacccaagtatgtcacttccattttcatttttttcctacccgaagttagtattttttaactgtcatgtctcagaacaattcatttctttcagtagcacatactgcaagcaaatctagggaaaaagggaaatgcttaataactcaggcctgaaaacagtctgccagcaactctctcatcagctgagcaggttatgtacatgggtactgtcctttgtgaacctagacacttcctgcaagggacgctgagggtggctacttgagattgatgtttatccattcttcctcccacaggaaatatatcgtgtttctgagagatgaatatttatttgcccagcctcgtattcagtgtcacaaatgataaaatgtctgtttaacaaatgggaatttgtgtggtatgtcaccaggggtcaccagtgtcagaacagtactaaagcacttacagtataatttcccagtctttatttaataagagttctgaaagtattacaaaacagagagtaactcttactatattgaagagaaaggaaaactatatagattgtaaaaaaactgtttttctctttcctttaacaaagtgtgtatacgtttgcatgaatgcagctgtggtgcaaaacttagatataagagcttttgttgctatttctggcactggatttaatactactcttccactcatggagcattaattagctgatgtaacttcctcgagaaacgctagatacatgcttgtctacttttacggacacagaaaattccggttgggactctccgttagtcccaattacagagctgttagagaatttatctttgtcatgtgaaatgtatcaaatcactgtgtggaacaaaatactcgttgttttttgaaattcgtagggattaatttgaaaacaacatttatatttgtaaaagcaatacagaatatggaagggaagtaaatattcttcaatgtaggacatgtaaaccctgtctttttgagctgctaatgaaagaatgtattactatgaaaaatgtcatacagcattttaatgtgacacgtggcttacgctgattctatcatagtcttttatgctaagaaatgatgatttaataatatcgtcaaagaaagtaagtgaagttgtcattatcaaaataagtcaaggcaattgaccatgtaaatttaacataattttgtttccgctttaactgtacttctaactacctctagttgtgggatggagtggattcagatgcaccaatactttccaaattttgtgggacatctttgcccagcagtcagtggtccttaggagaggttatgtatttgagatttcgatctgacaacagccccaatcatatgggattcaaggtcaagtattctatagattatatatattttttaacttttattttaggttcaggggtacatgtgcaggtttgttatataggtaaacttgtgccatggggctggttataaagattatttcatcacccaggtactaagcctagtatctaatagttattttttctgctcctctctcttctcccaccctccaccctatcaaatgaaaacaacatcccatgctcatagatcggaagaatcaatatcattaaaatggccatactgcccccccaaatttacagattcaatgctattcctatcaaactaccatgacattcttcacagaactagaaaaaaactattttaaaactcctatggaccccagaaaaacccaaataaccaaggcagtcctaaactaaaagaacaaagctggagccatcacaatacctgacttgaaactatactacaggggtacagtaacgaaaacagcatggtactggtacaaaaatagacacatagaccaataaaatggaatagagagctcagaaatagggcctcacacctacaggcatctgatcttcaacaaagctgacaaaagcaagcaatggggaaaagactccctatccaataaatgatgctgggagaactggctagcaatatgtggaagattgaaactggaccccttccttataccatatacaaaaatcaattcaagatggattaaagacgtaactgtaaaacataaaactataagaaccctggaaaacatttttatgttaaataaaagagtggttatagaatgaatatgttaaaacttttttttaaaccatgactttttaaaaagaagtcattctatctgcctaattttaaaaatattttaatgctagaaataaggagtgtaaatgtttaaaaccacagtcatcaactttaatttctcttttaatttttattttaaaatgtaatcttagtaaacctgaatattttatattttttctaacttatctgggaagaaatatgtgtagttaaatcaaactcctgtttctcctgcttactatgaaattcagtagttctctcttatccatggtttcatgttccatggtttcaatgcacttggtaaacagaggcccaaaaaataggtgagtacagtacaccaagatattttgagagaccacatttacgtaacttttcttacagtatattgttatgattgttctattttattattagttattgttgttaatctcttactatgtttaatttacaaagtaaactttatcataggcacatatatatagaaaaaaatcgtctatatgtctatatagggtttggtaatatctgaggttttaggcactcactgggggacttggaatgtatcccccaaggaaaaggaagaactacagtgtgtttattactttaagtaatacaactatttaagaaccagataactatatttagaacaatgtctttgaattcctcatcatatataaaataattaagctttttttttttctctgagtctctagtgccaaatcagtcactggataaaaagcaaatatatctcttcaggattttgatttccttatttaaaaattgagcagtaactttgcttgttgaagattcactatagtatggtcacaatagcacagaatttagtatctaataggtctagacacaaaccaaacaaatatttaatatagcaaaagttcagaaagcctagttgtaacaatatttagctacaccatagatcatgttatatcccgagtcaagctgcatataattcaattagctatcacatccagctaataagacataattgaatagtaattttcaaggccttgagatatcagttattgtagtgaacagtttaattgatagtaaaactagaaatggcaggtgtccccccttccagctaagcttgggttcagtctttagaatcaacacagggttctaggcaggtcagatgagtctaccagtttgttcttgagatgaaacttgcttgcaactaatagctcttatatagtgtcccaaaagaattaatgtgacattacagaatatgccatttggccgtcatcttgtttcccattattggattggacttgtggtatcatttctgtttatatcaaccctagaattcaaataatgaggaaagcactaaccattttcagaattttaaaaacttcaattcatagtcacttggcacctaagttttcacatgtgctggtgaaatgaaaaaaaaaaaaaaacaaaatttgtaatagaatctttctttctttctttctgtgtttctttctttctttctttctttttctttcttttctttcttttctttttctttctttctttctttttccagctcagtgtggggggaagagtaacagggcaaagtggtgttgttgaaagcattggccatctaacgcttccatatagagacaacttattctgtgagtggcatctccaggggctctccagacactatctcaccaactctttcgaagattttaaccttcagaattcctctggctgtgaaaaagactttgtggagatctgggactatcatacttctggttagtgaaatatatctgctctctttggggtgtttattttcgcatgtacttattcagcctctgaagtttctgcacttccgagaaaggcaaaagcatgtctatactctgcagagaagtgcagattaatgagctttgggcagtaccagtgattctctacctcaattctaccattacaatggatgtccagagcccaggtgtcatatagcctaccctggaggccacctggggagagcaatggtagtgggaaggcaacctgttgctgctgaggcatcccattgccacatgccattatttgaggggtgttctatagcttgaggcagacagagggtcatgcatgtctcctggcagtagcataaggcagatatttgtcactctgtttgtctcagaccactttttcaaccagataagcaagccttcctcattgtcctgagatatccttcccctaactggttgcatttttttcacttcttcatatatttgaacatgttaattttcattcatgttttcctgttttcttgacagagagtaacttttcttcatgggcaaggtcttgttttttattattttctttgtatacgcaggacacctcgaatagaggttaaaagaaatcaatcacctggacatatatatttaattatttgtctctcacaggaaacatcttgggaagatactgtgcaaacaccattcctgacagcatagacacttctagcaatactgccgtggtcaggtttgtcatagacggctctctgactgcctcaggattcagactgcaatttgaatccagcatggaaggtgatttcattgattaattcaaaacaacattgagcacctgcattggacagacactatgctaggcactggtgttacaatagtttgaaaagcaaaataaaacatgacctctatcttcttggaccttaatcaaaaagttacactgacaaatgaaaaattacagctgtgatcaatgctataagggaaaactagttataataagaggatgagagttatactgcaatgcttgccttaagaaagtcctgtagttactcagaatttgctttactgcaaatccaacaaactcagatgaaataaagatcttgtttggaaaaactggatacttacattaacctcctgattttcctgattttttttttttgtaaaaatagggtcttgccttggcctcccaaagtgttggggttacaggcttgagtcaccactcctggctgattgccctgattcttttttttttttttttttttttgagatggagtctcactctgtcacccaggctggagtgcaatggtgcgatgtcagctcactgcaacctctgcctcccgggttcaagcgattctcctgcctcagcctcctgagtagctgggattataggtgcccgccaccacgcccggctaatttttgtatttttagtagagacgggattttaccatgttggtcaggctggtcttgaactcctgacctagtgatctgcccgccttgggctctcaaagtgctgggattacaggtgtgagccaccacacccgacccgattttcctgattcttaagttcattatattcattggtctcttatatttcttgggtcatgatgataattaaattgctgtctgtggactatcatccatggaagccagggttaaatattaatagagataggaaatgaatgtatatattcactaaaatcctcacacacataaatatggagaataattttgtctagaagggtaatttttaaatacctgaattttgagagctttcccgatggaaggagatattttgatttgattggaagttttcttggctttttttcccccacaccagagtgtggtggggatctcagggctctgctggaacatctacttctcccaactacccgaacctaaatcctcatggccggatctacgagtggagaatcaccgccccagaaggaaggcagatcaccctaacgtttagcaacctgaggctggccacgcatctgtcctgcaacagtgagcatgtgatagtaagcgttccctgtggcctgagatgttatattccatcatttaaggagtttactgacccataaatcatagtcagaaaactaggtcaggaaaattgctgtctatgcaactataactcagacaaattctaagtattgttgagagaacaaaacacggtaaactgtcaaaataattgtaaacattgttttaagagactatcagctatcactccatgcatgagggtcatagatagaatacattttaagagtgaatgataatgacaaatggcaaaaccggggaggctgtgggaagctaagcctacaggagcacatagatgaatgggaccagagtcacagcacaagccaccaccgaaagttctgagcagatgggttgtcctgcataatgactgctctttccaggggtgcagagggactcctggtgggagagcactactacctgacctccatgtcgccaacctccagtggtttcagatgtgccctcagcactctcagcttcctgcagtgaaagaaagcaaatgagatccctgagtgtgaataacaaatagattgttaactgtgaagtgctatacatacatatgtgtgtgtagataggtagactggattaatattagtacatttctccacccaacttgccccttctgcagtatatgctatctcagtaaataattccaaacttctggttgctaaggtcaaaaatcttgatgtctattttggaatacttcctctcacaccctatatggcatctacaagcaagtcctctcacaccctatatggcatctataagcaagtatctttaaaaatattcacaaactacttgttatatctactactgccacccccaccgttcacttggattattttataagttccctctggtgcccctgcctccattctcatctccctacattctcaacacagcagcatgtgatggttttaaacctcaatcagatcatgttgctccctttgaaaatcctctaatggcttctcatctcactcagaggaaaatcccaaattgcacctgtggcccacctggccaacattatctgctgcccctccctcttctacctgtctgtgttatctcaaactcccctcttctctgctcgctggggtccaggcacctggcctccattccgttccttgaatgtgctgagatgctccctgtccagctgttgccttcatctggaatgcccctgttcagatggcagcccgctccacaccctcacttcattcaggtctctgcttgaatgccttttaatccatagggtgtaagtatcttatattacagaccccaccctagcctgacacttctctgccatgttgttttatagcactttacaactgctgccatacatcattttgatttgttcatcagtttattgtctgcttcccccactagaatgtaagctccttgagctcaagccatagtttcattcactgctggggactcactgaatccccaatgcctgtatataatagagataaataattgttgaatgaatggatagtagaggtactatcattatccctttaataagaagccacttttgttttcagtttaattgtctcctgttgggtggtgaatctcaaaaatatgaaatatatttgtaacttatgaccactttgtatcaccctaaaatgatctcattcaaccttcagattttatttccaagttctaatatctgaaggacggaactattgtctttcagatcttgaaaataagaaaccaagtgtgttttcttttatttgagagccaggaaattttggactaaggttgtttattataaagaaactttgtttcctattattgattgaatatatataaagaaagatgaagtagaaaaaatactaaccactcccactataccatattttgatgcattttctcatctcttcttggcaaagcatattttaggtacttgtaatcatgtgatataaatccacttgaattctaattttagtctatttttctggttataaatatcatggatgcttattgagcaatatttggagagttcagaaaataaaaaatataaagatatttttaattctactcatctattactaaaatttagatatatatgctaacagttgttttttacctttgaaattatttttatagtttaaatcatactgaatataatgattattaggaattttacaagcagagtattaacatgtcctttaggaaagagaatacgaacagtcatagttttggaactcaaataaagataaaagttatagccacaaccacaaattccaaagcagatcttacttgtcatctctctataccttaattatcaacttataactcttgcagctactgctggtgggttttatgtccttatttctaaataatattcctattctactactccttgctttttttggacattatctatccacatcctactctggaagatgagaattagccctctgccaccacaaatgcacatggggtatacacagtttatatactttcccaaaagtcccccaaaatacatatgtcacagcttttgctgaaattgtcattcagttgacattaccatgattatgtaaacaccattcacaactgagccaagtagtgtactatggcaacatttgcttttgttttcccaaggaataataataattgtgccctctttacattttcttgggttttacgcattgatcactaattcttccacaccctttccaccctaggtgtgcatcttaaccttctgtagtaaaacatgtcagttccatttcttttcctcagtaatatccttccttgagcctttgtccatcagctgcaagcctgatgatagctgtcatttcagaatttccctttgccatcagatttgcaagttccttcattctgctcctgggctagaaagctggctttgtgttgctatgtacatccctttcttggttaatttcctcttttgtgaggcataccctcttgtaactccccaaggaaatgggcaagggcaatacatattttaagaaatgatatacctgaaattatctttattttaccatcgttcttcgaaaaatatatatttaaatattttatatgttcactatattaatatatccatgaatatattaataattttgaagttttgtgtggcttatctggggtcagttttcttcatgttcctatctcgtgtttacttatattggtctctgccttttacattagtcacttccctaaatatctgctgatccttggctattcattcatatttaagaatgaattactgaaaggatgactggcatctctgtatgcatgagggtgccttgactctttaaatagggaaacctacaaacctacaaatctcatatccacaggtcttttctcttggggaggttaaaactccagcaaggaatcactctaagaactaatttttttctgaatctttagcataatgtccacattcctttttctaaaatatatttttatatgttcaatgtttattttggttcctctttactctgctccaaacaagggcatgtgggttggcctttgcccccactctatttgattgagaacttgccaaaaaaaggaagaagaaagatgaaagagggagaagaaggagaagcaggatgagaaggaggagaagaagagggagaaggagagggagaaggagacagagggagaaggggaaggagaaaaaaaggagaaggagaaaaggggaagaagaagaaggagaaagagaaggaagaggagactgagaaggagagggagaaagagaaaagaagaaggagaagaaaaaaaaagagtaaagaagaaagaagatctgctggtgcagaggcagctttaactttcattgcactgcttcgtggctaatgccttatccagctggtctgagcctaaaatttctccaaagccacctgcctatctgactctctgtacagacagagaaaatgaaaagctatgccacccggtgtgacctacaatatgacctatatctgattttgtcccgttcatagcaaattttatagcctgtcctaaatctcacgtacctacagcctatccatttgtattctgagagttgtagtttctgagtacaaaagggattagaggacaatgatgggaattgcattctggttgcttctaacagcagaagtccatgtgataaatggatgactataacatgttcagtcattgtgattctacgccaaaggcagactcagaggcaggataacagccattgatcatggtttccaacatgtactgttaaccttgcagttggttctaataccttttgattttggcaatgtgatgcccattcctgttttcagcattatagaaatatttgtcctcatctgtttctttatacactacttcatggtttggaatcagaaggatggtttgaatcccagttctattattactaattatttgaacttcagcaaattacatcatctttctgaattctggtatcttaatctggaaaacagggatactattatctgcctgggagggtgttgtgctgattagataagacagactgagtagatgatgagcaaagactggcatttttgcctgctcagtaaatgatagcaaactcttcttctggtcccatgagccggaagacactttagaccagaagcctccagacagctaaatttaattaattatagtaaattttaaaagctgacatcttttgttgtggagtgcattctcctactgcataacttttagtgccatagtctgagtcattatttctaatcttgagtcattcaaatccttttaaacactggaatatcaatcactcaatcaatgaattattgtttagttatttcatctaaatgttttttttgattttgtacagcattggaacaatgtttgccaattattgtaactatgtgaatgactacagttattatttaatattttggagtcaataataatccattcttaaaaactcaactgagtaagaaaattgaagctttgaatccataactaataaggaaagaactattatgtttaattgcatatggagattgatttttcaaattacttttcaaggtatttaaaaatatctgcttgctggtcatggtggctcacacctgtaatcccagcactttgggaagccgaggcaggtggatagcttgaggtcaggagttcgagaccagcctgaccaacatggtgaaaccccatctctactaaaaatacaaaattacctgggcacagtggtgcatgcctgcaatcccagctacttgggagggtgaggcaggagaaacgcttgaacctgggaggcagaggttgcagtgagccgagatcatgccatcgcactccagcctgggcaacaagagcaaaactgcatctcaataaataaataaataaataaataaataaaaattaaaataaacaaaaacatctgctttattatatacatcaaataatcagaaactaacatttaagcttcctttccaaataacgaaagtcctgatgcattgttaagaaaaactgcccatcagtgagctctgcacaccacattgtaagcacgatggcttatctcctttacattgggagctcggtttccagttccaaactgtatagcagcttttaatctatgaccacatggcaggaaggcattactgcaatactttcattctagtgaaatcaccctgaggtcacaaaatgtgttcagggtaacatagtggcttgtggcactgggatagaaacctgcattgttaggtcattcattttaggggagggttcccatagaaggaagtaggtctgggctgggaatatcacctcctaggaaatatgcagtaagatggattgtgtgtctaaaggttaaactctttttccaacaggtattcaatggcattagaagtaactcaccccagctagagaaactgtgtagtagtgtgaatgtaagcagtgagattaaatcttcaggaaacacaatgaaagtcatttttttcacagatggatctaggccgtatggaggattcactgcttctcatacctccagtgaagatgcagataaagtgggatgttgtaaatgtacttcattttaatcaggtgcattgcagatgccccccagctactgccaatggcagcagagccatccattttccctttagtgatcaaagttcacttggaatctttgacataagacaaacacatataagcagatcaaaaacttactgcagacagaaaaaaagctttctgatttcaggaagaagctgctatggtgaatttaaaacttgtaatgccattagatgagcttctagcacagtttcagtcatgttaccatgaggattggtgtgacctgttccatattccgtggtccattatttggtgctgaaagagaccatctacctcctagaaggtaacttagtctcggagagtaattaattttgctggggacagaacaggctttattgtttctggtcgtctattcacacacgtatttccagtgaaaataaatgggaggtttgatttgatatagaatatttcaaaattaagcaagatatggcctctaattataaatatcctcctatttcctggattggtgctattatctaagggttttaaaatttagaagtgggagtgaatatttaaaaaaacccactaagttatttcactggtacaggaagcatctgttcctttattaaaagggggcaaattcattggtaggccaaggtcctattatctgtctgatttaaattaaattattagatcaagtggagaattgctaatcaagccattaggacctgccaccgttatatttgggtattcctctaaattaaatattaatgagcacagggcctcaatatttggacaaattgatacagagccaaaccccagccacctgatctacaccaacaggaaaatagagaagttgttgatttttgcacatttttcctttttaaacttgcagaaacttccataatttgcatgccttttacccataatcctgattgcatctagaaaaacaaatcaaagcagtaatgttgatgttttagttactgttcctatattgtttatctcttctgttgtggcctgaatcttactactactttctgttgccttctgttttcttagtgtgtggtgggtctcttccaaatactcctgaaggaaactttacttctcctggctatgatggagtcaggaattactcgagaaacctaaactgtgaatggactctcagcaatccaaatcagggaaattcatctatttatattcattttgaagatttttacctagaaagtcaccaagactgtcaatttgatgtccttgagtttcgagtgggtgagttctaagaacacattctcccatttatctacaatattctttttatctttttgttgttgtggctgctgttgttgttttgagacaggagctcactctctgcccagactggttgtgggcagtccaaaccttgggataatttgttgtaggaagattgaggtaacctcttttgccctcttggtggtggtgggaaaggcttcaatctgcctgttgaaagtggtcaacaggggtgaggatatagtcatgtttcttgagagggggcatatgaatgaaatcaattttccaggtttgtagtggcctctgaacactggaaggtgccctttagcttgatttctcggctaagtgggtggtctgagtgctccctggaaagaaacttgtttgcagatggtacgggcctgcgtgagttgttgaaaggtggtggccatggcaggagactgcaggtgaggttataaaaactgaagcagaggacgatagctggtgtgaaagaggctgtgaatgtgagtgagtttggattttttctgggacatgggcaaaacgagcttattgtctagaaagaaccagccctccgtttttgtggccccagccaaagaaagattgaggctttctccttgtgagtatgagggctgttgagctgggaaacaggtagtatgggatggggcttaagggctgactgtttagctgcagaaccagctaatgagtttccttctgataacaggtttgttaagagcctggtaagaagtgcaagattgacaaaggtaaggttagtagcggaggtaagtgaaagcttgaatataggaaaccttggaccacttgccattgcagtggataaaattttcaagatttcgttgaatttgaaagtcaaagattccattttaaagccattgactaccattgtccagtcgctattggggccaggccatgttacaaaggatattgaacgtttgggcttaatgtgagggcttgtgacctagagtctggaggttgcaagggagacagccaagtgatgtgtcatggggaaaccttcttcaggtggattttgaggcttcactgcaatactagcttcctgttgctgctgcaacaaattattattattattattattattattattattattattttcagatggagtctcgctctgtcactcaggctggagtgcagtggtgcgatctcagctcgttgcaagctccgccttgtgggttcatgccattctcgtgcctcagcctcccaagtagctgggactacaggaacccgccaccacacctggctaatgtttcgtatttttagtagaggtggggtttcatcgtgttagccaggatggtctcggtctcctgacctagtgattcacctgtcttggcctcccaaagttctgggattacaggcgtgagccacacacttagtgtctttaaacaacatatatgtattctctcacagttctggaggccagaattctaaattccctcccactgagtcaaggtgggagcagggcaagtgccttcggaggctctgtgggagaatccatttcctggctctggaggcagcctgcactcctcgacttttgatgccctccttgaatgactccaatttctcgcttccatcactacacctcccaccactctcccatcacctgctctgctcttacaaggatcagtgagtacatcaacttgccacctaaagaagccgggataatcttccctgccaaaggtccttaacttcattacatctgcaaagcttcttttaccatataaggtaatgttcacaggttcctggatcaggatatgggcatattgaggggccacttataagcctaatacagctaggctgcaaaatactacaagtagactgcaaaaccattacaccctctggtgttttaatgattgggagaaaaacagttgggattttttgctttggggtacttcttaactttgaatttttaaggtctagggtacctcttaaacttgtatttttaaggtctagccctcatcaaccctctcttccaaccagagacacccactgcagtgtttccttgaaagtctggtgacatgtctaaatctaagttctgatgagaggcacagggccaaccagcagcccccacggcagcccccttggccagagggtgcccacgtaggccaaaccaagtgactgaaacaagctcatggctgggaaggaacatagagaagggtctagggcctggtgagggcaccatggaggccatggggtgagcgaggtctgctaggacagtgcaggtctgcggagctgaagtgaggctgtagagcctggcctagtgccacaggagccggaggaagcagctgggggctatcgtcccggtccacagagatgctggagactgtggcactaggagtagccctgaggctgtggggagagcatctctaccccacagcatctgggggtgacggcaatttcctcacctgacaagggcagcttccaagtcccagatgctgggctttttctttgtactcggagactagtgggggcagtgacaggaagccagggagcctctcttgcaacctcctccatgctctgtatccaaagactgagggaggtggagctggctgggaggtcgggcactttatccacctgctctttggtactggtcatctggaggtgggtgcagaggtggtccagccattccagttgttcacgtcaccataggtgcaccgggtacttcttgagcattgggatgatctgcttcacctccagtcacacagcttccaggcactgggagtggtcctcctgcaggatgttcagcttcgacttggccaggtatggaggcatatggccagcttggtccagggcatccaccaggcccctcgtcgcagcagtatggtgatgacagagttgtggttggtacaggccagaatgtggtcattaccattgcaggagacagagtgtagagctgtgtggcccttgtcagctgcacagggatccgtgccattttccagcagctaccgcactttttccacatcgttggcactggtagcattggcattgtctccctcattctcttcagagctgcacctctttgcccgagccaccagtgaggcctggcagtgagcctcagccgccagcagcgatcttgcagcacagctcctggtgcagctctgcgtcatactgccaccagtcgtgtagtagtgcaatggggacttggcccaggaggcctcctggcccgggaggcccatgcagctgcccccgtgcagacccgaagtcagcgaaggagaagaggccccaggtaccttgcagcttttgttgttgttgttgttgttttgttttttgaggcagggtctcgctcttttgcccaggctggagtgtagtggcgctacctctgctctctgcaccctctgcctcctgtgctcaagccatcccccggcctcagtctcccaagtagctgagactacaggttcactccatcaggcctggcaaatttttgtatttttggtagagatgggggtttcactttgttgccctgagctcaaagcgatccgcccgcctcagcctcccaaaatgctaggattacacgcctgcaccaccatacctggccactctaaagtcttatttccacacagctaagacatgttttaggaagtctgctaaaatacccctggagacctccttattgtggtctcccttttgtcgtgttaatttgattgatcttttctgccctcctgcttttcagaaatttaaaggctaaaaagaggacctaaactttaaaacttctcttttagtctcccattaaactaattgtaagaaccaccaaaaaagggaaaagttctttggaaaaattatttggaaagcagtaaaatgatatggactgttaggatgtaaaacataggatataagtcattatatgttagtggtgctctgacatagggacctattactgagaatcaacttttgctcaattttcagagaaatggaatggttgcatcacttatctacgtaaacaattgaagaattgtctgaaagaaaatatggtatgtttaaactggaaaagtcctgtaatactttgttcatgagcatttacacagtggagttactgttaattttgggggtactgtggacaagcccagggctgccagtgaatcgagtcatccttacacgtctctctttgtaaggtgctttgcagtgtctgtctaagtactagaaacattctttgtttctagattactgcaaagctaaggaaaagctatatttccttaattatcagctagcatttcttttaaacttttagcatggatatttggggatttatttacatatttattgcaaagccctggattacagagatttaattgaagattttttaaactaatagtttctctgaatctgctttgttaaaatcagtattcaccaggatgcccctgttgtctctgtttttatcttaatgcatcactgagttgacgttaaatttcaaattcttctttgcccttaatactattctatcctgaagccacctttatatactgatgaaagaagtaagcaatctgttattatcatctgtttgtatatatcaaatgctcacctcacaatagcatcaaccagtgaaaaacttcacgttttactgtttttatttggataactatttactttgcaatcaactagcaaggtataaaattgtatgatatgcagaactttaactggattgctttaagtgaacatttaaatatgataagccatattaatgatatttaatacacttaaaatgaacatgttttattcatcatgagtaatacaacctaccactcaatgaaaatctaaagttagagtaaatttgctcatgaattcaataacttttccataatatttttagttatttggttaaggttctcttaatgtttctttcactttttaatagtttacgccttttttgcctgtgttttttattggtttgtttaaagcaaaatctcataccgtgtgctacctggaagcactgtaacctagtgacaagatcataggctctagggacacactgccgggccacgtctcttctcctgtctgaaacttggtcttttgtggtcatgagaactgaagatctatcctgaagattggataagatagtaaagtgcttcacattaattcctggcatataaatacataataaatgcttccactttatcttggctcactgcaacctccgcctcccgggttcaagcagttctcctgcctcagcctcctgagtagctgggattacaggcacttgccaccatgcctggctaatttttgtattttttaatagagatggagtttcaccatgttggtcaggctggtcttgaacaactgacctcaggtgatccacccacctcggcctcccaaagtgctgggattacaggcatgagccaccacgcctggcctatattcttaatttagtactattctgagtaaaaataattagctattagttttataaatttaccatgactattttataaacatcagtgctttccataaagtgaaacaggttatgttgtggtgcatttctttaccttgtgctggccaatccctcattatgctgttcccctgttgtaatacttacattaaatgttaccagtttgtatttaagtgatttatgtctcctgattggactctgacaaagagaaaaatgctaggaagagtaccaggagatagccccacaaagatgggatttgggcataggtttggttattcaagtagcagtgcttagcttcttgccaatgggaaatggaatgctggtaatttataggaagtgacctcacaatgacccaagctcctgtttgttgattgtgatgaaatgcatgctgaggcacatgccttgggagctaagtggcagctatacttcactactatggcagtaaagatgactataaagactggcgggggatggatcctttcaaatgtacctgagctgggatgcccagcttgtggaacgcacagcaggaggtgagcagtggccagtgagtgaagcttcatgtgtatttacagtccctccccatcgctggcattaccatctgagctcttcctcctgtcagatcagaggcaacattagattctcataagagtgtgaaccctattgtgaactgcccatgccaaggaagtaggttgtgttgcccttatgagaatctattgcctgatgatctgtcactgtctcccatcatcctcagttgagactgtatagtggcagaaaaacaatcttgggcttcccactgattctacattatggtaagttgtataattatttcattatgtattagaaagtaataataatagaaataaagtgcacaataaatgtaatgcacttgaatcatactgaatttatcctctccatccatggtctgtggaaaaattatcttccatgaattcatcctcttcctttttttgctgcccaggctgatctccaactcccagcctcgagcaatccacccttcaaagcctccccaaatgctgggattacaggcacaagccacaatactaggtcaaaaccacgtttcttaaacaaaataaaaacttggcgggaagattgcttgagctcagaaggttgaggctgcagtgagtacttatcacactactgcactccagcgtaggtgacagagaaagatgctatctcaaaaaataaaataaaataatcccactctgcccacatcttaaaaaaatatattgtccgtatcttcatgactctcattcctggcccttaaaattctcctcacactggacctttgtattcatccacttgtttgaccccttctgggacctgacctgtcccaggaagagtccccattttcctccaatgcacttgtctttgagtctacctggccagacacccaagagttaccttgaggtgttacttttctcccttcccacatccagcctagcaaggcttgctgattccgccctgaatacaaatcccagaccataccccatcttccttcactgccttccagcgctcagtcaaagccatgccacagagcagccaggttagtttcattggaagtaggaggtgaagcctgtcattctctggtctgccatctgtagtggcttcccactgtacctggaataacctcacagcccctgatcgggcctgtaggggcgcgggtgagctgtgccctgctgttcctctgtcatcccatcatcccctctgtggattgcttgctctgtgccagccaccatggtggtctgtgtacctttcttcctctcaagtcacagcctcctgcactgtcatgctgaggggtggtgtttgtggaatgctctttctttagggctttctgtgcctctcctttctatttgtgtcacagtttaaacatgaccatattggagaggtctcactgagcaccatcacacctcagccttgaggctcgctgaactcatcatccttttattttccacgaagcagtgctgactgacatttttcctcttactgtagcacagtaaaaaacatccaaggtgaaggattagagctttaaaaagtttggtagtgtccaggcacagtggctcactcctgtaatcctagcactttgggaggccaaggcagatggattgcttgagctcaggagtttgaggccagcctgactaatatggtgaaacctgtctctactaaatacgaaaagttagccaggcgatgtggcccgtacctgtaattccagctacttgggaggctgagataggagaattgcttgaattgcattaagctgagtttgcaccactgcactccagcctgggtgacagagcaagactcagtctaaaaaaaaaaaacgcgagaaaagagaactttggtagtatttaaggaaagcatacagagtgagtagaagtttgccaggtgaagagtcaggaggatgatatttagcagaaggaaaatttaaccagattgtgtgtttggcagaaggaacatctgaaggaacacctgatgaggctgcacccttggcggaaagaacacctgacatggctgaaagcttggtggaaaaaccacctgatgaggctgcacccttggtggagggaacagctgacaaaattcaatgtttggggaaagcaacatctggaaagtttgaacagtcagcagaagaaacacctaagaaaattatgaggactgcaaaagaaacatctaagaaatttgcatggccagcaaaagaaagacctaggaagatcacatgggaggaaaaataaacatctgtaaagactgaatgcgtggcaggagtaatacctaataaaactgaagttttggaaaaaggaacatctaagatgctcacgtgtcctacaaaagaaacatctacaaaagcaagtacaaatggtaagatgcttgagtgaactttgtaaggtttattggcatttcaggtttcttagtgaaaaaagtgtgatatgggagtagctgggaatgacttgaatatctaaataaggcaagcttaggcaacactttttcatagtatagaaataagtagatattattccgtaggccctggaaaaattctcacaatacttctggctgtaaatactaagtgaactaactaacaatggctaaaaccataggaaccaaagttgttttggtggtacagggatattataggatcccacatttttttgtttgtttttcatttgagacagagtctcacagtgttgtctgggctggagtgcaatggcaagagcaatctcggctcactgcaacctctgcctcctggtgattctcctgccttagcctcccaagtagctaggattacaggtgcccgccaccactccggataattttttgtatttttagtagagatggggtttcactatattggccagactcgaactcctgacctcatgatatgcctgccttggcctccaaaactgctgggaattcagccatgagccaccgtgcccagccaggactccacttttggttggctaattagcaacagctccaatcatcatgctctctcaagacaatatttaaaggctggaagggctgcttttgttcacatgtttcttttaaatagggagaaaacttggaagcttgcagtaatcttcctgtgacattttattggctggattataccacatgctcatttctaaaccagtcactagcaaagcaaatgtaattactgtgattagcttagaataatgatttctctttttgagatgggatggggtagtggaataatgaatatctaaataagcttgtgtttctgcagcaagaaagaataatgtctttgcataggaagccagcaatgttttctgtagggattcattggaaaagtttaagcaagggagtcacaagattagatttgagtatcagggcatactggtcatggtataaggcagagattggcaaacttttcttgtaaagtgccagataggaaatacgttaggctgccggacatggtggctcacgcctgttatcccagcactttgggaggccaaggcacgtggagcatgaggtcaggagttcaagaacagcctggccaacatggtgaaaccctgtctctactaaaaatacaaaaattagccaggtgtggtggcatgcacctgaaatcccagctactcaggaggctgaggcaggaggattgcttgaacccaggaggcggaggcttcagtgggctgagattgcaccaccgcactacagcctgggtgacagagcaacactccatctcaaaaaaaaaaaaaaaagaaaaagaaatatattaggccatgtggtctctataacagctattgaactctgcattgtagggtgaaagcagtcatagataatgtgtgagcaaataggcatgattgtactccaataaaactttgtataaaaaaccatttggtaagctgaatttggcctgtggcctatagtttgctggcccttcatataaaagatagatggagggtaattacataaaaagatttaaagacaaagtaagcttgtgtagtagttcatgctatagtctcctttttgtttttttgtcaccaatctgtggcctagtatcaatctattatgaaagtttgacccatccaggataaaatgaatcaagttcagaagctcagtttacacatttaaatatgtaagtctttctttgccattattttattttgatttgttttactgaaatttttttaacttaaaaaataacagtagtaactgttagggtttctttttccctgtgaaagccatcagttaaggggccatgtctaactaggcaatataaatataaaatagtttgtatttccagtggcactggaaagataaagcaaaggcagaaaagatgtacagttaatatggtttagtgattattgagtttaaaaagctaggggacagatacaatctcaggtcattcataagtttccagattgtgcatgagcatttacaatgctcatggggaaggagtaggaaattgtcaggttaacagagaagagcaaacagtcatgggacagaccagcagttttctttacataatgagtttaatgaaacattcatgtgggatattttcagtaggtaattggattataggcatttctagctggagatagaactctggttggagatgtaggcttaggataattttattataattattgggcaaagccatagatctcaatgagcttatccgtgatgcagaagatatagaataagaagaaagccattgacaaaaccctgggaatatcaacatttcacagagtcaaaggacttggtaaaggagactgagcagtggctaaagaaaagtaggagaggagtcagagaaagtgatgttgcaaattttttttaaatgtgagaatttcaagcagtaagattactgaaaagtgaattggatttaacttacaagttcttcagtggtaatctgttcaaaagaattattttagagttgttaggtatactgttgatgtggttgatatttctgttgtccaagaagaaatctcccaagatcctacctaactttttgtaactaaagcagcatacatacacagggtctgggaaattatctagactggtgagtacacctgccaacatttttccagaattgtcaaaacctaagcgtcatgtgtgaggaaaagtgttgtcttttttatctgtttcttgtggatagtggagatctgtgttgtgtgtgtctctcacacgaacacacacacccacgtacacaaataagtacagtaattcacccttatccatggggagtattttctaagacacccagtgaatgtctgaaattgtggatagtatgaaaccctatatatacatgttttttctatttatgcttatttatgataaagtctaatttataaattaggcacagtaagaaattaacaataacttatgataaaacaataacaatatattgtaatcaaagttaggtgaatgtggtctctcaaagtgtcttgtattgtactcactcttctttttcttgtgatgactgtgagatgatataatgcctgtgtgatgagatgaagtcaggtgaatgaggtaggagttgtcatgtggtgttaagctattaattatttctggctatctgactacatatcagaaggtggatcatctgcttcatgtggatcattgagccatgataatgttgatggttggggttcaggaacagaccattttgatgactaatgggcagatagcatatacaaagggatgattcatgacctgggtgagatggaacatgatgtcttaatacttcatcgtactctttagaatgacacattatttagaacttatgacttgtatatttctggaattccccatttaatatttttggactatggttgaccatgagtaactgaaatcatggaaatcaaaaccatggctattatattgtgaaacatatgtttggtcttcaacactgttttctggcataaaactcataaaatgtttagaatctccaaagtgatgtctttgtatgctaataattgagtgatggctggcggtccctaggtagcttcaggataggagctggtcacaaaaaagaacaaggcatgattagagtgttgggactttcagccccacccctcaacctcctaggaggtgagaggagatgaaagttaggtcaattaccaatagccacagatttgttcattcatgcctatgtaataaagctttcttaagaacacagaaggactgggatcagagaccttccagatagttgaatgtatggaagtgtttggaggccgatgtgccctgggagggcaaggaagccccatgccccttcccctatatcttgccctatgcatctcttcatgtgtctgctttgtgatacccttcataataaactgttaaatgtgtttcccttagtatttggggcactctagcatgttaatcaaacccaaagagggagtcatgagaaccccaacttgaaaccagctggttagatgtttcagagacccagatttgcaactgttatgggagggcagtcttgtgagactgagccctccgcctgtgggatctgagactatttctagatagacagtgttggaattaaataaaggacaaccagctggtttctgctacagaattggttgcttacttgttggtggagaaaatcctccacacatttggtcgcagaagtcttctgttttgatgattgttgtggtgtgagagcagagggaaatcatgttgtgtgtgtttctttctacacatagagcagataaagagtgactactgtatactctgttctaactgcttctagttcatttgtctagaaattgtagtttctaagattgacactgtccacttacactaattctgctaataatacaattttctgtcagtcttatagggttctgtttggattatgactattgtatactgtagttcacttgtagataccaaattgtgataaattctatctttgcttgcacttgagaactataaaggagtggaaataagagttgttaatgcattaatttcctaccaatataatgcttaataataattttactatagtctcaatgtatggtctcaaatgaatgctttatgacaaatcatctgagtctttgtaacaaagtattggagtattatgcttttttaaacaagacctgaatcatgcacgaaagtgtgcatgattcttttaaattaagttgaagtctcatgatgtctcccaggctgctttcagactcctgggcttctcaggtgatcctcctgcctcaccttcccaagtagctgggattacaggcatgtgccatcatgccctcttatgtttttaatattctgtattttttatttatatttgttgatttaatatattttactttttttctttaatagtggatgtgagttctgtagagtctatattcaggtaagactttccagttttttaaaacatgtatgttaactcagaaaatataaagaaaccagtatcttttgagtgttctactctgggatagacaacatgtgcttaatatgtattatctcacatagtcatcacacagttttgcaaagcatctgtgctactatcacctactttgtattaaccaggcaaatgtggttcagagaggttgattaattggcctatgatttcacagctaaaaagtagctgacccttgagtttgccatcagcctaccttgctcccaaatcccttctcttgccccaaggcatagattgatggagacctgtgcatcactagaatcaaggtacaggtccagatgggatcaattcacaaagtcacattttgttatatgttacctctttttagagttttcccttagaacactggttaatccaagactttgttctaatatgtttaatagtcaaagtgataaccagtaccttgtttttattaccaaagtttttagagcagaccttacttagctgtggccacaagacataggtttttgtttcataagcaagacctggtgaatcctatagatgaattattttactcttagtggagaatatctacatatagatatgttatattaatcatatttagaggctatttcttatagatttctctatttactgacttcccagtttagtttttcttcaaagcagtaccctgcctagttgcatgcactcttcatttttttttagagtcttttttcttcttccatgacttttctatagtcttttcctggttactttcttctctgctttcctcggtgttcttttcgtgtatgattttattctttccaccagccccatttttctatagctaaaattaaaagcacatggaattttaggattgtaaggactcttggagactaatcaaaatactttcatatttcaatctgtatttaatatcctggaaaaatggttgttcagatggagaatctgaaactcaaagtgacttatttaaatatcagaggtagcagaagtaatatttaaactcatttcaaagcccattactcttgtttttataacatcatgtgagtgagtgtttgaataatagaaagaaaagggaatgggtctaattaaacaaatggaaagggataagaatggaattagctggagaacccagtggaagtagataagaatggaattaccagggaaaggccaagtttgaagagaaacaatcccaggactggtaggagtaaggattttaccaaagagatcagaatattggatcttatgacaagtttgatgaagataaattagaggaacaaaaacacagatgacattgggagttatctagaaactcatactaaaatagggttcaaaggaagtcctgaataggtcgctgctttttcgcttctttaattggagaaatggacacacttcatgctttctattgaaagattaaaaaaaaaagccactgcaaaaattctctgcaagcagatagaaatgtcctattgtgttctttcaccccaaatctcacaggagtggcttagagccccttgagtgctaggggattgaaggttgctgaattacatagatctgtggcccagggcaggtgtcccctcccctttgcctctttttccaagcctctgatgtcttacccatgtacatgtaaagcaggggtaagattggctgtcaaataagtcatggttcagttgggtttttgataacatgcttacgctggaggtgaatgactgactgagactccatttagttgttttccaggaacaggtaaatacagagcttctaggttggtcattgagtttatcttttcagtaatctgtgctttgatgagcagaatatttaaaggttggagactgccatgaagctctgcagaagaaagatctggaagtgggagacacttttactatatatagtggctcccacttccagatctttctctctgtgtaaatatagtatttagagaaatccaactatcaggactcagtttttctagcagtctctctccttgggtataagtacctatgaagatttttaaggcttttctagtttatgtagacctgaataaggaaagacaagtacaaaataagtaattagattttattatttttaatgtttcaatttttgttgagaaaaacattcccaataacaaatatacatttgtgttttgacatttgtaggttcagcttttcaacatttcaaatatttcagggcactctctgcagtgttttagggtgaagggaagcaacagggccttcttaagtggtttttatgctgaaaaacaaagaatgtcattttccagtgacacagattagtctttgaatcagagatagataatggagaagaaacaaggtaaatgtatctttctacctcattttaggttatcaagtttgttccagtttagatatcaaaagttatgtcagccattaagtagattttcagttaatcattaaggacagtttgtgaggacgaattatactcagggtatgccaattatattggctgtcactacttattatggaactaagagtcagtcttcattggatgttataggttggggaggtagagtcaaaaataggtaactaaaatcttttttaaaaacagagggcatattttaattataccaagaagcatgatttaatatacaaagactgatttttcccagattttggtttttgttttcattttttggagtgagcaccaagatatgaactagcagattttctttttaaatatatgaatttgcttatttttgttgtatctttttttctctaaaatctgttcagcaaactgactattgaaaattcacagtctacaaaacttaaggaagactttaatcttgctaccaatgtaaaatggtctcttgtgaagttgattttctcagttggaatctagttctgtatagtatttacttttcatgtttagcagtggtgtaattaccattatttcatgttggtaatataaagttggtcagataaaaacattttatggaaatatgagtagttgatttaacgtttttttttttttactttagtaaataacaaatgattggtaaatattttgagggtgtgagtgccaacaaaaggaatggactggagaatacatagtgataggaacattatattagaaaaaacttttccacaatacagaatatataaaatctggtaaaggtttatttggataagtgtacttactgtgacttttaaaattattctattgtcacttaaaaaactcatgcttaaatttatatttaatggatccagttacttactatagtaatcaaggaatctctctgatactgttcagttccaaaactgtgccacatagcatatagggttttttttgcacgtattattttgatatcatgtagtttttaggagagagctttttctcagtttctcttcttggttctttaattacaccaaaataatattagaaattgtgaaaattttgggggcatggtggtacatgcctgtagttccggctaccaaggaggctgatgcaggaggattgcttgagcccaagagtttgagaccagtgtgggcaacatagcgagaccttatctctaattttattttttatttatttttttgagatggagtctcgctctgtcacccaggctggagtgcagtggcacggtcatggctcactgcaacctccgcctcctgggttcatgccattctcctgcctcagcctcctgagtagctgggactacaggtgcccaccaccatgcccggctaatttattttatttatttatttatttatttattttgtatttttagtagagatggggtttcaccttgttagtcaggacagtctcgatctcctgacctcgtaatccaccctcctcggcctcccaaaatgctgggattacaggcatgagccaccatgcccggcctatctctaattttaaaaaataattgtagaaatttagaaatgtaaattctctttctcagagtctgtattattaaggcatgccagtgtgttttctaaattatttcattaaaagtatattttacactcttcatctcaatgaagaatgcaggttttaccccaagtaaacaaccagtgtatggaagcagagaatcttactaagcatatggtagaattttaatttcagaatttttaaattgcaatttttaaacatattgttaaaagattttttatcacatttgaaaattttaaattttggaagattttgtattgagttgtttaaataatcgttttgaagttcttgcatcactataagatactgcaggttagaaaacatacttgtgtgcagcctagtgtacccagaatacagtcttgcctataaaaagagttttaaaagttttcaatgtgaataaataagcagaaaaatgaatttttatgtaatgaaatgttacaagtaagataatatgcataatatatcttataataaaatctaatgcatttccaaaatatggcttaaatgtatattttcttttaatatttagaatgcataaattcatgtgagttatcttgagaaaatatgtcttaaataagacaataaatcagaggtatgtagtaaacaggaaagaaggttacactatatcctccaagtggagtttagattaaaaaaattttaatatatttaaatatattttagtctcaactcattttttttttttttttttttttttttttgagacagagtctctctgttgcccaggctggggtgcaggtgtgcaggtggcatgatctcggctcactgcaacctccgccttctgggttcaaacaattctcctgcctcatcctcctgcgtagctgggactacaggcgtgtgccatcacacccagctaatttttgtatttttagtagaaacagtgtttcaccatgttggccaggatggtcttgatctcttgacctcatgatctaccagcctcggcctcccaaactgctgggattacaggcgtgagccaccgcacccagccgaaactcatgttctattaaacatatcatttcaaggaatacattactctttagaattctgattaccaaaactttcttcaggtgaaaagtttacgaaacattcctttttaaattttgtctctctgtagtaaaaatgttctagcttttaggtattggctgaagaccatgtttaactaattgagtgtcttattatataataatgaaattaaaatctttattacacaggtattaacaaaataactaattgtaatgcaaatactgaccagcattataggaatatattatgaacagaagtctgtattttacgtatttcatcacatgtcttatatagtagttgtttttccttttctttcatgactgaagctcatacttgattgactggttatgtctcttgtttgtttctccctcctccttcacctttttaaaaatgatttaccccagacttttttctcacagaatacatttcttcagtgtctgctttttagggcatctctgtctcaattgtcagcatatttatttacaggtttctatttagttgctatgtattattttcattaatcaatcattgccgccccccatgatttattctttttttctctgtttcttggaagaagcagaatttatacaattatttatacttagctttttgccacacagaatagaaacaacctatgctatttcaatgcaaacccagttaaataaggtactattaaaaactaagctctcacacttttccatacaagaggtaattaatacaactgtaaattgtgaagagatatttcaaaatataacatgtaatttaacattttaattatttctacaattctataatctatgtaatggtaaatttttgtcctaggttattttggttaaaaaaaaatctaatggataccaccatatttgtataataataaattagatgaagggggatgaaaggaaattattcattgaagaagggtaagataaacatagagactacatgagagagtgaagatgagacagactattataaaaacacagcaaaaatagtggtttaaatgagagcaggaactctctagaataaaagatataatataaattatttaaaataaaaattaagaaaacatagccaggtaataaaacactgctcaggtgtttttgactgacttatagctgattttaacaaaaagctgaaagaaaatataaggacgagtataggtaagagcaatttgttgtactctttaaaatacctagtagagaatagtttgaatgtttctagcataaaggaaagataaatacttaaggtgattaatatctcaactattctgatttcattatgtgaatgtattaagttattatatgtaccctcgaaacatatacatttatattgtgtgaacaaaaaaattattaacaaggaaagaattctcacttcttttagtaactttatgttttatatttaatctagtcatacttatattaatgcagaatgcaaagttaaattggttttaggccttgtcagctttattgtgaattattaatttttgactctttggtttctggtttaagatttctaacttaatgtttgacatattcttaggttatttaactaatttatcctactctttgatataaccttggtagctgttttgaatatttttgttaatagagtataaataaataagcattttatttaatcttattaaaattaaattttctgatcatatgaacaaggtttttaatctatatctcttaaaagagaaaaatcttttttcttgagaccatcatggctaacatggtgaagccccgtctctactaaaaatacaaaaaattagctgggcgtggtggcgggcgcctgtagtcccagctactcgggaggctgaggcaggagaatggcgtgaacctgggaggcggagcttgcagtaagctgagatcgcgccaccgcactccagcctgggccacagagcgagactccatctcaaaaaaaaaaaaaaaaaaaaaaaaaaaaaaaagaagaatcacttttaagctacaacactctcaaagaaataaatgtagaaattaatctctagaaatattctgacatcttttgctcataatatctgtatgtaatggtattatatgcacacatcaaatgaatgtaatcaatctttgtgaattttttaaagtaaagtacctattattatagaatcatatgtaaggaaaattgttaacagagtaaacaaacttatcattggaagaatttttttgctcttaaaaatatctcttgcaatcgggatattttatattatttccaggaagccttaacttagtcttcataattattaaaccttgcacatatatttgtttatttctaaaactcaggaatcctgtcgacttgaattttgtagtttctttcttcacttctcctgtaaatactggatcctgcttgacaatcatagatgtatgtaaaaactattaaatcttcaacttgaataattattggttaattttctttatatgagatcttttctccaattttaaactaccatcctatatggtgtaaataggcaatgtgagctagcattctattgtttacaggaacataagaaaaacatgtgaattttaaaacagggtttcacatttctatctcactttataatggtaattaaaaatgcctcataattctataattaggtaagcatttctcttgtacaattaaaaatttcaaagttaatttttataaaggttcttttgcagaatcttggtgttttagaattaaatgttttcattcaattcaaagatgcatattgcaatatttcagaaatatttacctatataaataaaattattttcttgaaacaaatttggaaatatataactgagaaacttaatcccatgtttttgtctctcctttgattttcttttttttttttttttttttttttttgagacagagtctcaccctgtcacccaggctggaatgcaatggcacgatctcggctcactgcaacctccacctcccaggttcaagcgattctcctgcctcagcctcccgagtatctgggagtacaggcatgcgcctccacgcccagctaatttttgtatttttagtagagacggagtttcaccatgttgcccaggctgggctcaaactcctgacctcatgatccacccgcctcggcctcctaaaatgctgggactacaggcgtaagccactgcacctggcccgatttcactttcaaaaattcaacagtctgcataggttacttaattctacccatttagcctatcttataaatatttatcttatcactatgtaattttcctcatgtaggtcatctactcatactccaaatgtatttatccagatctttcttccaagccccttgggtgccccaaatcttataggtctcaaactgaaagcatcatttttattctgttcctgttttctgactcttcgtaatctactctgtcatctggtttccccatcctaggaaataacacctaggaagtagcggtgaaacactcaagcacttaaacctgcacttcaaccctcccccacatcctaaacttcaacccttttccatgtcacccatccagtcacacacctaattttgtattttctaccttcttataattttccatatcttattaccataattaactctctacctataattttgaagtactcctttctagttttgccccatctccccatgttcatctatctttacatcgctggaagggtcacctttctaaaatgtatttgtaatgatgtaactcatctgcatattgagtgaatacccattacacgaaggggtaagttcacattctagcgtgacacatatcttatatggtttggccccattttatctcttcatctctttcctctgtgttccagttttacgacatcaccttggcacccctcaattgccatgttgtttcatgccttattattttacacatgctattgcacctagagtctttgtatcctgactctgcactttgtctgtccttcccaatatggccccattatggcagcattttctatgcttttcagataaaactgattgttctctcctttgtgcccttatgtattatattgacttaaattgtagaactggtgaattatacttttctgttcttatttgttttcacgtctctaacatttcttgaatataggccagaatctatcttctgtgtatatttcctgcttctcccaggatagtgcctgtgattcgatagatacaatgtatgggtttttttgtttgtgttttgttttgtcttactgacaaattgagtgaatgagtgaataaataaagttttttctgaagttgttttttggtgctttttggtttttgtttgtaatagaaggaagcaacaaagacagcaactgaacaacaagaaaatgatattggaattattgaatgagcgccataagatctaacaagtaatgacaattttctttttttataccaaaataatagaagtggtaagttagtatctctgaaaatttttctatgcttaaatgctattatttagaaaacaattttatagactgaaatacaatgtctaccttaaaaaatactttttgctatctttcatcatactatcaattttctgaacctgctttgattctgaaattctatatttgctattactttttgaaatattcataaatggaaatagatttgtgtatgtttttataatttacagtaataaatgttctcatatgtgtgtctgtgaataccattctgtagataagatgcccacatcagagtcaggacaaaaagaagatacgaaatcaccttcagtttctgaggtaccgtgtattgttgttattttaaaacttaagtaatgagtaatcttaaaacataaaaagatgactttgtctcacgtctgcatgtgtccataagccataagaaattttctgacatttatcagaacatactttataatcatatgccaagtagataacagctgcatagtgcaattctgctaatttgcaggattaatttacaaagccagtgtagaatagagcaaaagaaaataaggcatagaagaaaccaggaatctgagttctgaagataagtttgtctaaaaacaaaataatttctctgcattcatttatgggcaaatacatgattctgtgtatatctagatgtatgaaagctttacttggattcagggagaaagagtttaaactgtagtcttagtgttgctcaacttggaacttgaaaagataatgcctgggacttgaaagtattagtatatttcgattatccagtatagatctgaaggaacatttcaggagttggataaacatgagaaataggacacctgtaaaactataacacaacaatttggttgagtagtattttaataagtagacattcttttcacaaatagaactctttgagtccctttgtggcagccatgtttgcaaccacataggtatcagataataatgatgtattccaaggtcacagctatggatgtggaagagataggaaaggcctcaccacttaagatagaagcagcagctgcatagtggtaacagcaatgagtggatgtcaaaaggtaagtctgtattttgattctgtcacttactagctatgggaacttggaaaaaatcatttaacctaatcaaatactagtaaccttgtatataaaaatagtgctcatatctacctcttaggtacatgagatgaaataatgttgtaacaaatgtgaaaacattctgtaaactgggaagtctgtatccaaatgtaagacaaaacgatcaaagtggcatttatgtgaaagcagaattgttagcacaagaatagggagtaagaacaggcatgtggatttctaattttgggtaagaggatggtaactttcagcaggctaccactgcagattttccatagaaatatagcagtttggaaaattagactttcctgttgagattttcaatgttttgacctggagtaatttctttctaagtaccaactgtgtgctaggcagtgagtctctgaatatccaagatgagggattatgctgcagtagtaggaagataataacaaatgaaaaacacttataaatcactgtaactttttcttaaaaacaaaacagagaatgtttggttagagaaaattgaagaactttataattagcatgggtatgggagtggcagtggaattctatggtcagagtagatctttctgcgactgccattcaatctcctgtctcaaagatgaggagtaagccatatgaaagtctaggaggaagacattctgaacagagaacagtggaccatatttgttcatcattttgttcttaacaacctagaatgactaggaagcagaaagtggggtaaccaccaacatcatcatcatcctcattattctaaggtgaagaaaaatctgcacatatgtgtctggcacatgttagatgtttcacgaatacatgtttttatttttctctttttgtgaaggcttgctctacttttctgaagttatgtcttaagaatcaattgcatactttatctaatgattgttttcatttaaaaataacaaatatatattttccttatgaatctttcattttattcaagcagttatcagcaaaaacttatcaaaattattcttaagcctttgttttcctaaatgaaacagatttagagttcttttcctactccgcatgacatactctgaaaattctcgtgccatgcatagtttttaacaaaaattctgtaattatgcatatgtcaaatgtttaatcatattgtattttgtttgcaatgccctattatttttggtgaggactacagtgtaaggcagatactttgaagttaattccttttgaaatatacacacgtgaatttttttgtgaatatgatttatttttcatgctcagtaacccagtcaatagccacatgaagataaaagataagcgtgttctacagagcatatgcaaggttttctcttgaaatgtcttggttttcaatatgtgaacagcctgaaatctaattgcctttaaagtaaggaaatgtgttttaaaaaagatttgaaataaaaaatattgatgcttgtcattatttttaaatcaaaattatttattgaggcagaatgtggtggcttatgcctgtaatcccagtattttgggagggaaaggtgggtggatcacttcaggtcaggagtttgagacccacctggccaacatggtgaaaccctgtctctattaaaaatacaaaaaaattagccaggtgtggtaggcaatcaatatatatttgttcagtgtatgaattagtgattgttaaaatatgctgtcctttatatcccaaagtactaatatattttatttctatctcctcctcaagacagattcaactagcctatcaatattcttgggtgcagttccttctcatgaaagagcaagggaacttaaaaaatatcactgtgaacaacttacagcaaaaataaaacaaatgaaaaataagttttgggtactacaaaaggaactatcagaagcaaaaataaaattgcagtaagtgaatcaaaaggttaaatgggaacaagagctctgcagtgtgaggtatgacatcctagttttaaataaatatttcaactatttatactaaaattatgtaggatactttttgtaatagctgacttaccttctgaggtttaactgcagaaaaaaacctgtcttgtagagtgtcaaattcctttaaataatacaagttcttaactttgaatacttctactgataattaaatgcatatttatttaaatcacaattttaatgactatatagaaggccattatttggaaatcccattatttacttaacaaattaatttttttgatttttaattttttgtattataagtgctgcaaggcataactgcaagtaaatatttttctacctttctaattattgatttggaataaattcttcaatataaaaatatttggttaaattataggaagttttaaaaagttctttgttcattacttccaaattgttctcaagaaaatttatattcatttacagttcaacaaagagagtgtgaaacggccattcctctccccccaagaatcaatttcctttaattgtacacttttaatcttaatgtgtatggaatataaggaaaatacttgtttatatttttaatcttttcctttcagaactgtgataactaaaagtgcttgttacaatgtctcaacttataatttataaatataattcttaaaattatatttttaaaaatagaatatctatagaatattctcaggaaaaaggaaatgaaagggctttgggaaattttatctgtctaaatataagcagcactaatattgggggaactggccagcagcccgcaatgcaacagggctccttctttgttcccaggcggattggcaggttgagaaataaaagacacacacaagatagtgaaagctgtgtccaggggggtcaccaccttctggtcctgtgatgccgccaatgcactggatataccagcatttattattaagtttagtgagggtggggataggttagtgagggatttatggtcatttgattatgaggtgagatggtcacgagggtgaagtaatttaacataacatcagtatgcagaagtacagcatacagagataagaatttacaatatagtgtgtgcatcagcaatttctaacagagccttaaaacagaaacacagtctttccataacctatgattagcaagatattaatcagcagtaacagttgcagcaaaagctggttgcaaacaatccatagaaacaggacgtgaagctagacaactggttagaccacaaattctcagaagggagtatgctttaaccctaaagaggcctagaagagccgaggcaagataagggcatttatagccccatcttatccatataaacaggcgcccctcatgcgttcgcttataggctctccacaagagtcacattccattcccagagctatgaacatctgcttttctgggataggaatcatggtgatgtgaaacctccctgactgcatatccgttcataggctctctgcagggggaagcgtatcacgcactgttggcttattctggcagtccaacctggcattgtctttacacaatcctgcatgcaattttgtatttacaataatcaggagtatttcaccttttattccaaagcaatagtttcaaggggtctccctacacactaaggcttctagtatggggtcttgtataggttagacatcagggtgtaaatcaaatttttgtatgtagtcaaagtgattaatcttttattttatgcttttgcatgtgttgtaatccagggaaagtttgtttcaattctgaagctcttaaaaattctctagtcatttcttttttactttcatgaattcattgtgttcaaataaatgtttgaactttggggaatttatgctctatagcatttgaagttttgattcaatggttcttcaactgatacctacttacagaaaccctttcagtggataaatgtaaaaattattctttaagaggaaccatgatatcccattttattgagtgctagctaaaaatttattttatttaggtttctcatgcttatgaaaatgaaaatgatctcttacatgaaaatggcatgttgaaaaaggaaattgccatgctaaaactgcaaattggacatactaaaacatcagcaccaggagaaggaaaataaatactttgaggacattaagattttaagagaaaagaatgctgaacttcaaatgaccctaaaactgaaagagaaaacattaacaaaaagggcacctcagtatagtgggcagcttaaagttctgatagctaagaacacaatgctcacttctaaattgaaggaaaaacaagacaaagaaatactggagaaagaaattgaatcataccattctagactagcttctgctatacaagaccaagataaagtgtgacatcaagaaaaaaccaagaacttgctttccacagtgctcatttgcaaggaaaaatgaatgttgatgtgaataatatataacaatgagaagcttcatcaaccactttctgaagctcaaagggaatccaaaagtctaaaaattaatttcaattatgcaggagacgctcaaagagaaaatacataggttttagaacatgcacaaagagacctaagtgaaacatagtgtcaaatgaagaaagctgaacacatgtatcaaaacaaacaagataatgtgaccaagcacactgaacagcaggagtctggagcagaaattatttcaactacaaagcaaaaacatgtggcttccacagcaattagttcaggtgcataagaaagctgataacaaaagcaagataataatattcagttttgagaggaaaacgcaacatcacctcctaaaagagaaaaatgaggagatatttaataactgtaaccatttaaaataatgtttataccaatatgaaaaacagaaagctgaaagagaagtatcaaaaaaaataaatatttttcaaccttcctgaaagaaaatttaaagtcatatttggccttagataaatgctgaatctagtttaatatagataataaatatatttaccatgtcagcttagaaacatggcttatttccaccaaatgcaagttaaagctgagagatgttttactttaagacattgtgtcacttatgaaattttaagaatttaagttaaaggtttttaatagattaacattaatgacattggcttatactgctgaaataaaggtttttttttttttttttttttttttgagacggagtctcgctctgtcgcccaggccggactgtggactgcagtggcgcaatctcggctcagtgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcacccggccaataaaggttttaatatctctttgtggccacattttatgaccacgatgaaacagataaatgggaatgcccatatcagcaatgagtattttgaaattgattcaacaatttactttgacagttaattctaaattttccagaggaactgaagtgtatttgaagtatattttgaagtgtacatttctgcatcttgtaatactactttttcagtaactttttgtatattttagttggtagaattttattttcatttatgtcaatttgacttaaatctgaacatatctgaatctcaaattatgtattgttatgacaacttaattttttaaagccatctgtgttttattaaataatagcttaggacaaatgtagtggattttagcaatatcaaatttgatttaatcatcccactggtatttataatttactttgaatattgttacaaataatttgctcataatttctatttcaaggctcaaagactgtcatgtggatagaactttgtcccagagaaagatcattgtagctatctgtgatttattagctttgcattggatccccatttttcaattcatggggggtggcagggttcatgtatagtacaaaaaaagtgagtagaggagagaaacttagcagctgcggtcaggagggatgtggagaccaggttacctagggcctctaaagcctttgaaacaaaaatacttttattctgagatagaaacctgttggaaaaatttcaccaggtgattgagtatgtgaggaactttgatgttgatttgtgcttcaataaaaaagaaggaaagcattccacagcatagaatttaccaccactagtcctgcccacatattttcttgagacttcagtaagttgtgaagcattacagattcattaggggacaaatgactagtgggatgaatctggtgtctagtaagagagtaccagtttggcaggaagataataccttcttgtgtccttaagtggattcagtaataagcaggaatgtgtacacataaagaaaataagctgaaccaatatatttggtgatatttttgaaagtaaatattgttaatttgataaggtgatttacaaatcaataacaaacatgtcaggtcactgtgagacaacttcaaaaaaaattggctgatctcaataaacaatgtgtgtctgaggcttcactagaagctgcatcacattaccacattaatctcaaagttgaggtacaggatttaatgaaaaaatgatttcgaattgaaagtcaagtatgtattaaaagtaacatgccaacagtgaatctatagctggtgaaattatataaattgttttatgatactaatctccatggggagacttcttttatatgttcattataattagttgtattacaattttattatcattataatgtgcttatttttaaaactgtggctataattctgcaatgtttttcttatgattaaaaattttctcataatatctgccctcaagaaggttaaaaattatacatcatttatcccacaagttgagagactattcttcggataaacagtatttttcagtgatttatgttgccatggtgaggcaagcgttatttaatcagagaagaatgtttaatggaatattccagaaaattatctgtctgagaggctgccttaaatacttcctaaaatgcttgctgaaaagtccggcaagatgaatatgacttggaggctgggtggcaggccggttttttggaggccggcctagagcctgcctgcatgggagtctggtcgaatgacaagtcttctggcagggggagaggcttgctggaacgctgatcgaaatgctggctgcatggaaggccggtcttcaggctggctggctggctaggaggctgacatagaggcttgctgggagatttgccaagaacccgggtgagaggcggccgactaggaggctggcggagagtccgtgtgagagggtacctcaaattcttgctaattttgcttgctgagggcctggtaggctgagtccggctaagagcctggttgtaccaggctcgcttgttaggaggctggctacaagatcccgtgaaagcctcacggctctactcaacaaatttctctagaaagaggccggagtgtacaagggcttcactagaccacactttttactgatgttgggccggatgtggtggcgattaagggcaagggcgagcggcgggggctggggctggggctggggctggggctggggaagggcgagtgagaggagcggcctctctcttaaaaggtggctgcagccatgcagaggctttctgccactgctgtcaagggcgtgacaagcctggagtgccagagagccttcactcagctggtctaccaccaaagactcttaagtcatccactatagggatatcagaaagatgcacagagctgcctcccggggccacgcctggaagcttgcaggggatgatgtgaagacgaggaccatcgacctgaacataaaagatgcgaagaagaggcgccgtgccctgcctgagctggggctgcaggaggaggtgacagctgtgggaggatcgccccttcagcgtggggtgtggtgggtgtccccgggacaaaggcagcaggtggaagagtgggtcggcagcggggcagaaatcttgggccccggtatctgggccttcttcctgggcaggcccccagtcctgggatgggggcgccctgcagggcacagggacaaggcctgcagggcagagggacaaggccaccttaaaatcaacctcaaactttggctgccttctccttcactcccactgaggctgttggaaacgctggctgcaagggaggctggttttgaggctggctagtcaggaggccgcctaagaggctctctaagaggcgtactgggaggctggccacgccattggtggcatgggaggctgattctgaagctggttggctaagcggctggctaacagacttacctagaggctggctggaaggctggccaaggcgcgggctgcatgggaggctggtgtactgaaggactctcttgaaaagtagcatagaggcttgctgagaggctggctcactgggaggctggcctagagcctgtgggagaggctttctgtctgagaggctgccataaacgcttgctaaaaggcctgctgagatcctggcaggctgaatctggctaagagtcggaatgcaagtctggcttgttaggaggctggcctagaagctggctgcatgggaggctaaccaagaggctggcgaggaaactggcagagtggcagattgtctggctgtgcaagaggcttgctggatggctgttaaaaacgctggctgcatgggaggttggtctggaagctgattgtctgggagattcgcttagagactttctgaaaggctggatcggaggctggctgtctaggaggctggccaagagcctgcgggagaggctgtgtgagaggctgccttaaatgcttcctaaaacgcttgctgaagagtccggcaagatgaatgtgacttggaggcctggtggcaggccggttttttggaggctggcctagagcctggctgcatgggaggctaatcaaatcacgagtcttctggcaggggaagagggttgctggaatgctgttcggaatgctggctgcatgggaggccagtcttcaggctggctggctaggaggctgacacagaggcttgctaggaggcttgccaagaattagttcaaccatcgaggaaggaagtgtgttgactcctcaaagatctagaagcagaaagaccattgacccagcaatcccattgctaggtatatatccaaaataatataaatcattatattataaagagacatgcacatgtatgttcactgcagcactattcacaacagcaaagacatgaaatctaccaaaatgcccatcaatgttagactggataaagaaaatttggtacatgtgcacgatggactatcatgcaggcctaaaaagaaacaagatcatgtcctctgcaaagacatggatggagctggaagccatgatcctcagaaaactaatgcaggaacagaaaatcaaacaacacgtattctcacttataagtgggagctgaatgatgagaacacacagatccatgaggggtaacaacacacaatgggacctgttgtgggggcaggaggagggagagcatcaggaagaatagctaatcaatactgggcgtaatatctgagtgatgggttgatctgtgcagcaaaccactatgacacacgtttacctatgtaatgaacctgcacatcctgtacatggaccccagaacttaaaagctgaagaaaaaaaaaataaagaaactttagtgctgtccagggatgcacactgaacagaaaaaatggccttgtgatttgctttataatattcctgtaaagatagatgaacagatagatgaacaaaatgtaggacaatcttgatcacagaaattgaataatgggtattttagtgttacttttactattttctctacttttgaataggtatacaaattgtaattaaaagataaaaataaatatattaatccctgctttgaaaccacatacaaacagtactctgaaaagattcaagcaatttacatggtactatatggatctccctcgcacctctgtatgtaacatttaaatattttgcaactggccaggcacgatggcccatgcctgtaatcccagcactctgggaggcgaaggcaggtggaccacctgaggtcaggagttcaagaccagcctggtcaacatggtgaaaccctgcaggagaattacttgagcccgggaggcggagtctgcagtgagccaagatggcgccactgctccagcctgggtgacaagagcaagactccatctcaaaaaatataaatataaataaaataaaagatcttctttcttaaattcttacttcatgttattagcaccaaatctgaagggctccattacagaaactctttgaaataagaaacaaatgtatttttgagaaaccacacaagatgtagtaattatcatagctgttaaaagaaatgtgctcataaacaaataacagtaaaggattagaggctttcggtcacaccaggaagtgatattaattataattcttctgttaattctgaaagaaaatatataaacctacttctaacaaacttcccataaaacaaaacaacaacaaaactcttggagttgagaatgaacagcagaagttctagaaaagcagaagttctagaagttctagatagcaagcaactgtggaacacagcgcactgccttctgcactgcccagtttctggcacctgactcacaggtgccaaatggctgcaggattacgacgttggaagtagtgaatatttcctcaatacttgcagtggttcatagcaatgaaaaatctaagatttcctctctgcctttcaggagctttaagggaagcagcaaatactactagcttctcacaagtggttacgttccaagatccacctaaagccatgagcagtacaaagagagccaagcttttattgtttacaagtaaatgattaataaactgttattaataaaatattgttttagctataatagccaaaatattttccaatggccatattatgtgagcaaaataactcgacagtctcctccttctatgagaaagatgtaagcttgcttggtggcaagggtcaatgattctattaggtttagctgattctttatctttttttgttaggggcagggtcttactcagttgcccaggctggagtgcagtagcctcaaactcctgggctcaggcaatcctcccatctcagccttccgagcagctgggaccacaagcacatgccaccacacttggctaattgttaatgcttttgcagagatggggcctcactctgttgcctaggctggtctcaaactcctggcctaaagccatcctcctgcctcggcctctcaaagtgctgggattccaggtttgagtcactgtgtccagccaggtttagcaggttctttttaccatgctcaatttccaaaaaaacacaggagggcagaggtgaggcctcttatgcagatccttcttctcaggtgtcatctcctcacgaatcctagtgacatcacagtggtatctctaatgataaacaatgttcaccacctgacctattttattgcatgacttaaaaatataatgatttgaaaagtgggagagactctttattgatcactggctgatttataatcaagtattaggggagatcaaatatcacaaaaagtaatgaggagtagaaacttaaaattttcaattttttcaatatatgaatttttagagacttaaagtagtataaatagttaaaaactaagtacatgaatcctgcaagtaacatacaaacagtgacctaagtttgtagttgccaaatgagttgcacctaaaacctggtctttgaagactcagtgagtgccacgcaccccacttcaaatccatagggatataaaacgtctgacacatgctgaatatggtaacgacatgacataataagtaattagaagctcccaaaggggttctagcacagaatgagcgctaaataaataaataataaaaacaagaaaaatgcttagtaccttaataaagtagtaaataataaaaaatgacaatgataataacaaggaagatgcttagtaccttaaagatacctgacagttatttgttaagtggacaagtggataaataaataaaaaacattttttaggaaattctgttggaaaaaatgcagaaattcaatagggacagctctactgtattatgagcaccttaaagacccagactatgtgtattccatctttgtctcctgcaacttgcaaaacctaacttatcgtttgataatttatcctttgataaatatataataaagatgtgctcatacagttcatattgtaccatgcattgtgtcacatttagatatcacagtagcatttttgttattgtgaaaaatgtttgtaattttattataatttgttgagcctagagttaagctatttgaatacttataatgataatattttggctattagaaacagagtatcttgttgtaacaaaattactattaacacgctaattatccagcagatagaacaacatatcttgttctaatgaagtaaatatatcttatttggtttcagcttggaatgaagttgataatagtgagaccttgttggtacaagactatgtaacacaacctgcacttctcaacaaaaaattgcttttctgacttctgcactcagtaggtatctttggaaaataatctcctattggtactgaggcaccctggctaagttttgtaattcttgttgacatttgttcgtggtgccagaaaagtattattaagtattattaactattctaaagatagttacttttctttaagacagagtctcgctctgtcacccaggctggagtgcagtggcataatctcggctcactgcaagctccacctcccgggttcatgccattctcctgtctcagcctcccgagtagctggaactacaggtacccaccaccaagcccagctaatttttttgtatttttagtagagacagggtttcaccatgttagccaggatggtctcaatctcctaaccttgtgatccacccacctcggccttccaaagtcctgggattacaggcgtgagccactgcgcctggccaagatagttactttcttagtgacacaagtcactatgtcacaaagttgatccttgaataagggttttcactgtaggagcccactaacagacagatttttcttttcctttggcactgcaagatagcaagacaaatctctcctctgcctcctcatcagactactcaatgtgaaggcaataagaatgaaaacctttatgtataataattcacttccacttaataaatagtgaatatattttttcctccttgtaacagttttcctcgagttcactttattgtaagaatacagtatatagtacatataaaatcgaaactatgtgttaattgactatgctttcagtaaggctccaggtcaacagtggactattagtaaaggtttggaggagtcaaaagaaacagattttcatatgaagcagattttcagctgcatgggggatcagcaccctaactctcatattgcacaagactccattgtaattaattctcatttactaaatgcaaaccgtttattgtaaaaattaaatagagcccagaagttcaataccagcctgggcaacataaggagaccctgtctctaaaatacataaataaataaaaccatgtttcttcataggttattgtgggagttcagtcaggctggtgggaaacattttaagatgaagttataggacatagacacaaatcttcttggaatgccaaaggttttgtaaaagtctcaagatagggttatggctgaaagcagcctaatccttaccttgagtaagtagcttaaagtgggtacaaagaaaggtagagtagtttatccaaatagcttgtttactcatgtggtcttaagactaccctttgatcacccacaggcaagatggctctcctggggtaggggcacccagattaattacccacaggtgtgttggctcaaagcctttatcattaaaactttgctaataaatgcccacagggccagctagccagggctgtggctgctgactctttacagcaccttccttggtgcctgtaatcggctcagaacccttgctgctctttcactgaatattggtgtctgggtatgtgtctcatccgtcatgcagccggggtctgtgggacagaccaccgcaagttaaaatattcaaatgttacggttttctgttattaattcctacttttcattattagatggtcaattctttgtggcttctaattcagggcatgtaagctactttaaaatttgtaataaaatttatttataaatatattaattcattaaattggataacctgatcatcccctattactgagctcatcaatcacactaagggttatacattttgtaacaagcctaagttgttatgacaattgaagaaacatacaatatacaaacttaaacattgcattacttatttatacaaaagtattatgtaggattttagggaccataattaaacaaatattttttcagataatattttttgagattataagctacctacaactaaattcttaactaattctgaattataaactaaaaaatttaaatcaaagctatatatatatatgtatatatgtaaacacatgctatttacacattgctttttgaattgcttttttgtgatcaatagttccataatcttatgatagcaccaccaagagtagtttactatcagaggtcttacctggattgctattttgaggatttttagatatctttcatatatattccaaaagttgttgatgaatgctatgtataaaaatgtaataaataaaattactattttaacactgatataaaaaacatttaccaaatttattattagggtatttcagataatatcagagctaacatcagaacattacttatttcatagactttgagtttgtaagctctatgaacttactaagcttttaattaaagaagaaataaagtaagatgaaatactcatgaattgagggcagtctaactcagtaaattaactagagttagcttggtataacggaaaatgcccctaactcagaaaaactcctagcatggtaaccaacaggtattttttcttgaacaacttgcttctcttaggcgcaatgtcttctaaaaatgaggattttagagccttatttcactaggttattataagaatttaacaagagaacatttttaaaatactctgagaaatagtgaagcaatgaaataatttgttcttgaaccttattgctgaaactattttaaaattcccaataaaacccaatgtgttggcctggtgcagtggctcatgcctgtgatgcaagcactttgggatgctgagacagggggatcacttgagcccagaagttcaagaccagcctgggcaacatagggagaccctgtgtctacaaaaaataaattttttttttaaaaaactgtttattcataggttataatgttcaaatgttacagttttctgttattaattcctacttttggttattattagatgttctattctttgtggcttgtaattcaaggcatctaagctattttataatttgtaatgaaatttatgaatatattaattattaaattggacaatctgattatcctctattactgagctcatcaatcacaccaagggaagaaaactatagatgtcagcatctggcttggactactactaatctttctctacctccctaaactctgaaccaacaaatctttcttagaatgatgcttagtcactatgttcatttccagctgctgtggaagacaaaaacctacctttattttttgtaagttccacaaagaagatgccagttggtattttctcattggcctactaacaacatattgcacacaagatcctatgtgttaccatatctcatttcatagatcaccttacataaatatttttcatatgaaaatcacaattgcaatactggctgtcacccattttgctttgactcacaccatttccttggagctagttagaaagtagtcaaatgtccttttggggactgcaagaaatatgcaacacttcacagatttctgtgtcatccttgtgcagggaccatgctgatcttctcgacattgtttcaattttagtatatgtacccctgaagccagcacaaatccctacttttatatgtgaagactcatcagtgatggatgaggcttagctctgtttaatctaagcaacctccttgagatagagtgaagtctattgaatggcttcatggtaatgcagaatttgaaaatattttaaaaactcgagatagagatgcaagtagcacgggagatttttaacttttgggaaaaaaagaatcacttgaggggacaaccacaagttggaacccactacaactttggaaagatgacatgggatcttacagaataagatgagaccttccactacctacaaaatggtgctacacgggatataaagtgccagggatatacatctggtaacaaaataaaaatggaactctaattccttcctgtaacattatttcaacctgacttacagttttaaactgtcgcaactaatatttgctagagaaaacagaaaagtcacttaaaggataacttatgaaggtctaggccaagttcaggcaagatgtgggtttcacatcaggttttgagtgggagaagggtcaatttgctcactatgtgtgtggcaaaagataaaagtcctagctgccagagcagggtgctggtactttggaaacaatggctgagaatatatatgtgaactttaaaaaactgtaataaatttgaagtctacatatggatcaccataaaatctgtgttagtaagggcacctggtcacaaaggtcaatcattaccagactgcaggaacagtttcaatggcaacgatgcagcaacagaatcaatggaaacaacaaaatgaagagaatggccattttcccccccaatccttctgacttacacaaaatgaatctcttccttgtacttaaggaacccgttagattctttttaaaaattcaagtattaaggtatggaagacagcccccaggggacactatcaggttttctggtaaagtggacatttcaagacccaaataactaattagaaaaatcaaaattgtgacactatgtttatcccatgcataggggttatacttaaaatcaagtacacaacattaggatccctagggataaagctgttgaaagtcctaaaataaagaatcctggacccattattccttctaactagtctagctttttgactagtttctggccgatgaagtgaactaactcactgtcattcaaaaattacctgaaacaaactataaaatctcacctagtctttaaatgtaaacaccgattaagtccacaagcaacagcataacgttctgcagtcattccacatgtatcttcagcacagatgtcaacattttgctgaagaaccatgccaactatctctcatgctccatgacatatggcaagcatgagggctgtgctaaaataacaaagagttaacttcattgttaggaacagaaccaatttaatatgtgcctgtcagtgtagaattaaccatttacatgtactaacaaacataactatcttgagtgctcaagtgtttatccttgtaaatcaccaccaaggctaaaaggaaggggcaaaaagactcatgtcccactggaatatggcatactagaattggctaacataaagtcctttgaggggcaaagacttatgctttgttcactaacctaaaagaggcaaagatttaagtgaagaattatctatttcttccttactctgatataatattttgtacttcaaaatcagctagaagtcagacaaataagagcaatctgaaggcttaaaacagtattaggaataatgatattagtagtagttacagtaagtttacttaatgatgctgataagaatgtatgaaacactgaattaaatgctgttgatatttataatgttacttcaacacaatcgtccttaaaggacatattattattctccttttcatatagaaaatcatagttggtattaactaatgtttgcaaggtcacacctatcaagtgaggaagctagaaattaaatttagtattgtgtgaatcaaaagcctatctcttttctctttatcactcacctatggcttatcttaattaactaaaatgttaatccaattaaagatgtctttcttccctctacccatacaaattaaaaataaaaatacactatgaataaaaaagaaaaaaataataaattcacagtatctggtgatagcaattaatagtcacgtagggataacctaaaattaatactcttcaaagaaaacaaagcaaacaatcatcctaaagacaaaatgattttaaactcctatttctatttaatattgctttttctatgagacagaatctatctcactctgttacccaggctagagtgtggtggcacgatctcagctcactgcaacctctgcctcccgggttcaagcgattcttgtgcctcagccccccaagtagctgggactacaggcatgtgccaccattcccggctaatttttgtatttttagtagagatggggtttcaccatgttggctaggctagtctcaaactcctggcctcaagtgatccaaccaccttggcctcccgaagtgctgggataacaggcaacagctaccgtgtccagcaaatattgcatttttttaaaagtgtataaaaaaacggaagttagaaaaatactataaaagtgttaatcattcaatattgaattacaaagtaaactaaaaaatcatacttcttaaaactaatacagaaccactttagcttatggaagataatgcaaccaaaaacatcagattacacataagaatcaatcaatataataagagaagtcctactacatactgctctttatgttgatcagtccaaataattgctttacttctgataatttgtgttgatatgtttcactataatctaataattttaagtaaatattaatttaatatttctgacttgagtcttatttctctagaacactactcaagtgttttttaataaaaaaaaagaactactataccatttaaacttattaactgcatttgcattttttttgtctgtaaaaattccacaatttgctcacgtcttttcattatggccagtaaaagtggtgtgaggctagcctgtaaaacagtaaaacgatttataattcatgaaattacatatttctcagctgaactgaatactttatataatatcctatgaacttaaacacataaaatataaagtcaatcaatagcaatcccttccttctcccttttctgtgctttctcatgcactgcaccttaccttgtttcagcctctgcatcaccaaattaactctggttatctccaaaaatcattatattgtaatgattttatggtttctcttctaaaccaagagcttcttgagggcaagggctgtatcctttatctctatatccttaaaccctaagacatagtagtaaatattttgtttttgactaaattagtaatctaaattattacctctagagcagtgtttcttaaactatattctaaaagataattaccttaccagaagtaatgtaccccaacagattccaccattatctatgttgaagaaatattataaaactgtgaattaaatgtccattattcaataaatgacttgaactttgcctaatccttatttgacaatatatttttgtggcagacattaacatttgacaaattagaatttcagggatacagttttgaaagctttgcaagaaaaatggaggtttcctctgggtgatacaaactcacttgattctcttctaccaataatcccaagatcccagatgccaatgtcaggcacacctgctctaaatgggtcactaaggaagtggctctaaattaaaagagtttggcttcaaatgaactttgattgcttattattaaataataatggggtttctcctattacaagacaacagaattttatctcagctattagaaattcagtataaaactttattctcaattataataatcatcctaggatcctaatgcatatctttttaaaatgcaataatccatttttattctgatttctattagctgctacttaatttttgacaaaatatcaacaatattaataaaatggcttattaattaaagttctaactcatctatgtggattagcataatataagccactaaatcacttgaattttaagggacgattctgaggagaaggatataatattttctacaatatgcacaacctattcaaatacaaccatgattaatacaaaaaggcttaaagtcattctaatagaagatgattatttatggtttatatacagaaaaatcattgtttaaaaaatctaaattctagaagtagcccattattaatgaattaatgtaaaatataaactatatattataaacagctatcaactgtcttgaataccttgaaatctctaccaaaatatactatgagagaggaattgataactgaaatatttacagaggcaaaagaggtaagttgaggaagtgatgtaactaggtgggcacagtagcaaactggaaacatatgctttgtgtaaagttagaacgtcttcatagcataccaaacagtcatatgggctcaagagacaccagattcaatcctttaagaggaaatccagatttctgcatgtctcctacattttacatgttgactcaatttatgcaggcaaattttgctttcctgtagtttcacactaattggaaagaaaaaaaacttgggtaggaaagaatatttgaaaaagttttacctttaacaaattcaaatatttatcataaatgcatagaaaagccacactctctggtaattcttgtaaaaatattaatatttaaagtaaaatcttagaaaattaagttctttcaaaccattttcattcaaggaatgtttgagcttccaaatataaaaaaccttacatatgttaatgttaaaacaaatggatttcaaatattttgaaaataaccttggttaacgtccaccttgttttgcactttgatgactgcaccatgggacagcagttttgccaccattgacaaattctcactataaacagtataatggagagccgtgttgccatacacatctacaatatttagatcggcaccagaatctgtgagaatatttgcacaagcctccctctggcattgtagagcctgtcagtattaaaacaagaagtaaattataaattataggaaatcaaaataaatattccacaggtttcacaaactagttgtatttcaatgagataaattcatttttattctatgtatttaaaccaaatccatctcctgctgaaaaaactggctacgatttaccttcatcagaggtgtccagttttcgccatcaggacgtcaagctggcactttctgtctaccagaaatgttactacttccgcatggccgttgacacaggcccagtgtagagcagtcctacgagagtgagaggacttttaggcaaagtatagtccactgtctcaaaacatacaacgatttatgtaattgtaaacattaaataccatgctctttctctgccttcaaaagaaatatttaatattctcctgaagaaagtacaacatttgttcactcttattactcactgcattaatgaaagagtggcctatttgaatagaaagagtttggcctttggattcagttcaacttgggcttgaatattactttaagaagtttcactttctagctgtcacttaaactttctgcacctcgattttctcatcaataaaatgaagatgaatacagcagttatctcacaggacatcactgtgatgcctcaatgagaatctatgcaaagtattttggagagttcttagcacatgtaacagctcagtagttgttagatataattatgactactacttaacaaaggcaacattttaagtaaaaggtgcaattatgcctgttttgtggtgtgctttaaaggttagagataacacggtattttaatgattctaagatgctcaatttctcatattttaacatttctgacattgaaatgccacttataattcattatttattacaactatatttagcagaaatttaaacaatcttttattggtgcataaaataaggaagcatcacacaattcacagtgccttccaagaagtggaatacggtatatacaacaggacgatggcagtcccagtcgcaggattaacactgaaagaaattttaacttttaagagtactacgcaaaaagagagttgaaataaaaacaactgtttaatatttaatattaaattaaattaatatttaataacttctttaatattttaaaaacttcaagccaaagaaaacttgggattcaaataaataggtatggctcattttattctgtatttagatttacagactatgtaaattcatatttaaatttatagaacccatgtaaattagatatttccaatgattaatattactctttaaagctgttataaatgtccaacatcgtgggtggtagttatcacttactagtttcccacttcagaattgtttttgttttaaagatgagagggaaagcttcaactgagattcagtcctaatactccaattttaaatctctcactttcctcaggctgagcaggtaaatgtgaaatttttaaggatgaaaaggtcttcagagttaataggatgtctcttctacataataggcattcagcttacatgtgataaatggattaaaagaatggatcaatacagttgggaagttcaatatcttaaaaaactgctataaataaagcacttatatttgctattttatttttctaataattacactaaaatgattaatctataattattggcacatacataagtctatatatgtgtctaataaaatgtatatgtaaatcaataaccacagataaaagattctcttctgaagatgctaaaagttcacagaatatactaatccataaaaaaattatagaacatgagaaattatttttatctgtgaaaaattcatattcctgcacttctcaaaaattatttcattaataacaaacttttactaacagcattgtacatgctcaatgcagaaatcaaagataataaaaaggaaaaacatttaaatttaaacaaatgccctcaaataataaattttatcatatttcatacataatttcagataacacaagaccatagtctgtatgtgtaatcaaactgaactttaccttcacttgatacaccaaaatatattttcaaatgtcaacatacttctgtatatatttctaccttgagtggtcacatattatcccatgctgtaaactcactgaagtgtatttataaaagccattatatcgattcttcttaatacattgatattttaagcagtgctcagaaaagaaattgtgtgtatgtttcattattttgtaaaaacattttagtataatagaattgatcactaacaggcataaacagtttttaaatatggtacttaccatcaaattgtctattgaaaagtcatctgcaacttaaactttaaggagcactataaatatcactgctttttatcctcacaaactttgtggacaggaaacagtatttgagtcctcttttaacttaaatgccttctctaaccaggaacactaaatattgtttcctgtgtgcataggccacttacagatcttaaaaaaggactttgcccaattttaaattagaggtcaagtagtttttttagatctgcaatttagacctctaatttatgttgcccaattttaaattagagggtttttttgttgatttgagtgaattctctataaaatgaagatttttaaatctaatatgtatacacacacgcatatacatatgtagtaaatattttacaagtatgctgccttttattttttctcatgtgcacggtgatttaatttttgttttactaaattaaccttcagaatgcttgcttctgagcttcttagaaaggttttgtcaacataaaaatgtatctgtgtgaacaggcattttgttttcttctggtatttttatcattttgtatattaaaaactttggaattttgtggcataaaaatctagttttctccaaaaagcaggcatttcacttatgaaattagttattttcctactagtacaaagtgtgaccattatcaagatctaaattcttacatatatttgggtgtttctggattttctattctattgtatccatttacctgttagcaaacagtttgtgattttatttatctcatttatttattttttgagacagagtctcactctgtcgcctaggctggattgcagtggtgggatctcggctcactgcaacctctgcccaccgggttcaagcaattctcccgcctcagcctcccgagtagctgggattacaggcacccgacatcatgcccggctaatttttgtatttttgtagagacggtgtttcaccatattggccaggctggtcttaaacccctgacctcaggtgatccatctgcctcggccgcccaaagcgctggaactacagacgtgagccactgctgctggcccatcttgtgcaaattgatagcacattttgacatctagaagggcaagacttttctactcaattacaaaatatttaaaatgtcatcacagtagtaaaagacagcctgtgtaattttttaaaaaaatgttaaaacgttgataactttatttggtttatgtaaaactgataaagaactcgcatcttgagaaaaatgagtcttcttaaattcaagaatataaaccatcttcccacctcaaagtttcctttctaagacccctcagcaaagaacatatttacatagacattcattgatatcaaaatggatattggacttcatccaaagaacttttagccaagaagtccatatattataggaattatttcattatgcaccatttcataatgtatctaacattatcttttaaaacctgtacattaaaagtaaaaccctgtatgtacttaattttgtgagttaaatcactttaaaattttctacacagtgctctgtgagaggaagtggaagtgaaggagaaagcagcgaaagtttggggttgattttaaggtggcctgggccctctgacctgcaggacgcccccatcccaggcctggggggcctacccgggaagaaggcctagaccccagggcccaggacggccgacctaccgctcgccactcctccacctgctcccctcgtccccaggcctcccagcacctcattcttaaggggcgatcctcctacagccgcctcctcctcctgcagccccggctcaggcagggcctggtatctcttcgtcacatctcttttgttcaggtcgatggtcttcctcatggttatcccctccagattccaggcttggcccagggagacaactttgtggatcttcctgagatccccatagtggatcacgcaagagtccttgttggtatagaccagctgactgaaggggctccggcgctccgggcccttcacgcccttgccagctgcggcagagagcttcttcatggctgcggccacctcctagagagagcctgtgcctcccgctcgcccttccccagcccccgccgctcgccctcgcccttcttgagtccccacacccgctccaacaccagtaaaacttgctgtctggccaagctcttggacactacggcttctcctgggagaaattcgctgagcaaagccattaggcagcagtgcatgcgcagctcagcaggctgaggagacacgcgccctggccgccctcccccgggcaccgcatgcaggtggcacctgccgctgaggcgctgtcgggctggcctccctggagcagaacgtgggagacaccctgccacacggtccgcttgacatagccgcccctggcccctcctcgacccgcgatccaggagctgggccctggcgctgggcaccgtgcagcctcctcgatggcgctgagtggcggttcccgccctcctgcagctggggacccacccctgacttagaatccctggacgcttctggcccagggatccgcgctgctggtggcgctgacagggtccgggttggagcccctgctgccgcgtgccatgttcagatgagagctgcacctgagtccacggtggaggctgcagggctgggcccagaccgctgagggtcgtcgagtgaaccgccctaccaccctgggctctgctctttcttggccggcgctggcagctcaggctcacgacctctgagccccgtacagctgccgagatgaggcactgaggcagattcccgccctcctgcagctgacgtcccaccgcctgacttaggcgcagtgacgccgtccgaccctagggtgtgccgctgctggtgacaaggacaggttctggggttgccactgctgctgccacgttcgaataccagctgcagctgagcccaaggcggaggctgcacggctgggcccagagggcctgagggtcgccgtgtggcacacgccctccctctccaggccctgcacttccttggctcgcgcccagagcactgggttgcgggctctggacactgcagacgccaggatggggcagagcggcgggttcctgtcctggtgcagatatggggcggaccgactgacatcaacgctgtagcagcatctgtccctggtccgcgctgactgggcccatggagaagaaggaagtttagggttgctcggccatatttgcctgttccccaagtgcaggtagaggctaaagctcagacagcggcacggatggcgggtccgtttgacggcttcaggttgctgagtgtgccccctgctcggccccagagtcccttcctcgttcacccgcatctggaatatggcggtggcgctgggtaatctgcagtcatcctggatgtggctgagctgcggttctctcccttgggctgaaagggagacttagttgagtagagcagatggagaaaaagttagattgaactcatcctgcttaaagacttgcaggctgggtgcagtgcctcatgcctgtacttccagcgctttgggagactgagataagaggatcacttgatcctgggagtttcagaccagattagacaacacagggagacttcatctctacaaaaataaaacgaatcagccaggcatggtggtacatgcctgtgaccccagctacttgggagattgattgtgggaggatcacttggttccggaggtttgtgggtacagtgatctgtgattgtgtcacaaacaagcaatgagaggccttgttgctccacatcctagacagatttgacatttgcagtcttctggatttccgttattatttggttatttctgcccctgcattttaagcctaggcaacacagactcgctctctaaataaataaataaataacttctagtcactgtatcatatctatgttgaattctttacacacgaagcttgcagagttgaaactcccagcaccctctaattatgtgatagggaccatgtgattaaagtgggtgaccacgttcttgcttttggtcattccaataggtatgcagtggtagttcattactgcatttccctaaggaaatattatgtggcccatcattacatatgcttattttttatttgtatattttatttggtgagatgcctgttacagtctttagttcactttttaattgggttgtttgtttattattattcaattttaagaatattggtaaattttggagaaaattcattattcaaatatgttttgcaaatattttcttccagtctgtggcttgtcttccctttcaatggctttcacacacacaaaaaagtgacattttaatcaagtccaacttatcatattatttcttttaggtactgtaactttggcgtttttctagagatcatcaaacccaagagagtctagattttctcctgttattttccagaagttttatagttttgtattcgacatttatgtctgtgattcattttgagttaattttggtgagggggtaagatctgattttttttcacttgtggatattcagttgttccagcaccaatttcagaagaaaccaatctttgtttcatcatattgcctttacttttccatcaaagattaaatatattgatttgtctctatttctaaactgtcttgtttcattaatctgtctattctttcatcaacatgatacagccttgattaccatagctttacagttaagtcttgaagttgggtagtgcctgtctttcctccaactttgttctctccttcaatattgtgttagctattcaaggtctttttcttctccatataagctttagaattagcttttctatatctataaaataatttacttccatgttgagtagaagtgcattgaatccgtacattgggaagagctgacatcttgacaatattgagtttttctattcattaatataatgtatcttctccatctgttcagttcttttttgatttctgtcatcagatacggacagtttatgaaattacataacttcctctaccttgaccaaagaacagtgatgaattcctcattctgcagccaacaagtcacctgtgagagccatgtgtctaaacatagacatgtgggtaagaaaatgataaagagatcctgggaaacataggaaattcatgaatcagcaactgtgtctaagtaactcctttccatatccccagtgcacctgttgcttcagccaatacctgctggtgtagccgaggatgctggtgctcctggctttcccggccctgcccccagggctaccttcgggtgtgtgcctcttgaccttagcgagaatgtagttctttatccctaccatgggtgaaatattttcgcaaataaacactttttaaaataatgtcaacttttatattagaggtgctgcgtgtgcaggtttgcatgtgtctttttggtacagtgttgtattttctttcggtatatacccagtaatgaggttgatagttcaattagtagctctatattacattttttgaggaatctccaaactgctttccatagtggctaacctgatttacattcccagtgacagtgaataggagttttctattgtctgcagcctcgccagcatttgttaacaaatatttatatatttcaggcaaagatcatctgttagtttttatttcagcacatcctctgaagaagatagtgtttttaacaaccaaagatgattcaacatttcaaacttgtttttttatttttctttttctgacgccatgtggaactttctgtctgcctcagtttaaggtataggttaagagcactgtaccttgaagtgacccatctcagtggccccatgcagtgttctatcccagaactcttcacaagcttttgccctgtgtgaccagtgtggaaaggagcccccccagatagtgtttcaccaggcaagtgaccaactaaagaattaccacaattatgtgtgactgttctcaaggttcccaaacatacagagggggacagttgcaggtaataaagctttattaaaggcagtaacatctcaacccagcaggaaacatactgtgggctatgagaacaggttacaataaatattgaggaagaaaaattcactttaatcagatattcgccccaaaatcctcttgctcaaatattaaatgttcttcctgcacacgtggcaataccagacttacagaaagcacacgtggtgagagacaaagcctgctgcctatctgtgagcttcagtgcccaatgagactcggcaagctgttcatctcttctttctacactcctgcttttattgcacagtatattttcatatatgttttattccatttttgaatgttgtattccattggtctctcagactaatgatgaaacaatatgacacaattttaatttccaagtctctacaatattttacaggggaagtcactctctcaattttcagacttttcatggatattttgtttgctcttctatacaataaaatttctatattcagaacacagatggtatctacattggagttaaactcaacttatttaattttcgttatttatttaaattttattttaaccttaggggtacatgtgcaggatgtgcaggtttgttacataggtaaatgtctgtcaggggtaagggttgttgcacagattatttcaccacccagatattaagccaagtgtccattagttatttttcctgatcctctctttctccccaccttccaccctccagtagaccccagtatgtgttgtttccctctatgtgcccatgtgttctcatcatctagttcccacttatatgtgagaacatgccatagatggttttctgttaatgcattcctttactaaggatactggtctccaccttcatccatgtccttgcaaaggtacatatacaccatggaatactatgcaaccaaaaaatcagcttattaattaaagtacctttgatgtcttaataatgttgaccctgcctaatcatgtaatgtcataattttcatttatacaaatctattttgatgttttcaagaaatattttgcaacaattccatacaaattgatttaaaataattgttcaggaaattttggcattatctgttttccatctatgaacatgaacacaagacagtctcattaattcaattaacataatttattgtgttaatgaatttcctaattcgatgactctcacttgcatttcaggcataaatggaattcctaatgatctaatattttaatgggttgacacaatgctttttaacatttaaaaattttactttcatataatatgttcttattatctataatattctatacagcatcaaacaagtaaagttgtatcacttttatatatcctttctaaaaactattgggaatgttggttaccttataacttttaaatagtttaagcagtattggtatattaattagttcatgagtaaaattttcttctggacaatataaatatggtgctttcttttgtgcaaaactaatcttaaataaacgttccgtttcttctatgaatactacttaatttagcacctctatctctatgaggtaaatgaccttaaactatatattcctagactatatatgagccacattttaatactcatttgcattgaatcacacaattttgttcctgtttttcattttaatatatgactttaaattcttctctgcacggaaacctgttgacacctccttttcaagctctttgtgtggtcccatctgtttacaattcactaatacttcggctcaggaatttcggggttaactgaaaatcagattttcagcagaggcagatctcagggaagcacggaatctggtaagacacatgtgctttgctgtcagtctttcatgtctcagactcagcatttccagttctctccatgtgagcccctgtctgcctccagggattacggaaaaacagagcctctcccattttcatgtctttgaaggtgcttgggtataacgttgtcatttttttggtaattggaaactaagacaaagttattcaaaaatcactataactcatcaaatatgtactgtccttttatctacaggtgagatgacaattgtagttctctggggaagtaaactcataggatcacaagcccctatcccagcgtctatgcgctcaatggctgttgtgaacataaacctgagcccattgtcccagcagcagaaagaaatcaggtgagtagtttatatttcaatctgtaagcagagtctattgtctgtggatcaatagacagaatacgtgctcttttcttgaaaaaaaaaatttctgggtcacaaactgaccaggaccaaatccacgcatgaaaaaggaaataattactgagtcgtgagcttaacttttggagaaataatggatgtccaagaccataaatcaatccgtaagtgttcctaaattaattgtatgtcattctcactgttcatcattgttgaattttgatgtatgaagccataaaatttgttttctgggcgctgtggctcaagcctgtaatcccaacaatttgggaggcagaggctggtagagtatgaggtcaggagttggagaacactctggtcaacatagtaaaaccccgtctctactaaaaatacaaaaagttagccatgtgtggtggtgtgcgcctgtattccaagctactcaggaggctgaggcaggagaatcccgtgaaccggggaggcagaggttgtggtgagccgagatcacgccattgcactccagcttggcaggctgggcaacagtgcaagactccatatcagaaaaagaaaaaaaaaaggtttctgaaggttctctagtataatttgaaagtgaggggcgcccttccacaccgcacgcttgacagagccaccccggctcttcctggacccgcgatccaggagctgggccctggagctgggcaccctgcaggatcctggatgacgctgacagtcagttccctccctcctgcagctgggaacccatccagtgacttgggcgccctggaggcttctggccaaggatccgcactgctggtggtattggcagggtcagggatgcagcccctgctgccgcgtgccatgttcaggcagcagctacagataagtccacactggaggctgcagggttgggcccagacagctaagggccgtcgagtgcatgagcctttcaccctgggatctgctctacctttgccaatgctggcagctcaggctcgcgacctctgggccctgtacagctgcagggatgaggctttgctgcaggttcccgccctcctgcagcccagggcccaaagcctgacttaggcgcagtggcggcgtccgaccctagggttcaccgcagctggtggcacggacaggttctagggttggcaccgctgctgccaccttcaaatgccagctgcagctgagcccacggtggtggctgcagggctggacccagaaggccagagggtcgccgtgtggaacacaccctccctctctaagccctgctcttccttggctcgcgcccagggcactgggttgaggggtctgggcactgtgcagccgccaggatggggctgaggagccggttcctgccctggtgcagacatagagttgatccacagatttctgtgcagcagcggcacctgtctctagtccgcgctgcctgggcccagaggggaagtggggagtttgaggttgcttggccattttgcctgtgcgccaaatgcaggcagcccctacaactcagacaggcacggatggcgggtcccgtttggacggcttcaaggttgttgactgcacctgctgccaggcctcagggtcccttcctcgttgacccgcatctggagtatggcggtggtgctgggtaatctgcccccatcctggatagggctgagctgcggttctctccctcgggctgagaaggagacttagctgagtagagcagatggagaaaaagttagattgaactcatcctgcttaaagacttgcaggctgggtgcagtgcctcatgcctgtacttccagcgctttgggagaccaagataagaggatcacttgatcccaggagtttcagaccagattagacaacacagggagacttcatctctacaaaaataaagcaaatcagccaggcatggtggtgcatgcctgtggccccagctacttgggagattgattgtgggaggatcactggggcctgggagttcgtgggtacagtaaactgtgattgtgccacaaacaagtggcgagaggtccttttgctccacatccttgacagcatttgacgtcttcattcttctggattttgcttattgtttggttatttatgcccctgtactccaagcctgggcaacagagaatctctttcaaaacaaataaatacatacatacatacatacatacacacatacataaaagaattctagtcactatatcatatctaagtcgaattctttacacatcaacttgtagagttaaagcccccagcgccctctaattatgtgatagggaccatgtgattagagtgggtgaccatgttcttgcttttggtcattcccatagatgtgcagtagtagctcattactgcatttaagaaaatattatgtggaacgtcattacatatgcttatattttatttggcgaaatgcctgttacactctttagttcattttttaattgggttgtttgtttagttttaataagattggtataatttggataaaattcattaatcaaatatgtttttcaaatattttcttccagtctgtggcttgtcttctctttcaatggctttaagagaacaaaaatgtggcatttaaatcaagtccagcttgtcatattatttcttttatgtattgtaacttttgcgtttttctctagagatcatcaaacccaagagagtctagattttctcccgttactttccagaagttttgcagttgtctatttgacatttacgtctgtgattcattttaactttggtgagggggtaagatctgattcatttttttttttacatgtagatattcagttgttccagcagcactttctgaacaaaccaatttttgtttcatcatgttgcctttactttttcatcaaagattaaatacattgatatgtctctatttctaaactgtcttgtttcactaaactgtctcttctttcatcaacatgatacagccttgattaccatagctttacagtaattcttgaagttgagtagtgcctgtctttcctccaactttgttctccttcaatatcgtgttagctattcaaggtctttttcttctccatataagctttagaattcacttttctatatccataaaataatttgcttccattttgattagaagtgctttgaatctacacattggggagaactggcatcctgatgatactgagtttttctattcatgtatataactcctccatctgttcagttcttttttgatttctgtcatcagatatgaacagtttatggaattacataactccctctaccttgacaaaagaacagtgatgaattcctcattttgcagacaagtcacctcaaagggccatgtgactaaacatagacaggacggtaagaaaataataaagacatcctgggaaaaataggaaattcaagaaataataactcctgttagtgagctctcatgagacaggatggttttataaggggctcttccccctttgctcagcacttctccttcctgctgccttgtgaaaaaggtgccttgattccccttctgccatgattttaagtttcctgaggcctccccagccatgctgaactgtgagtcaattaaacctctttccttcataaattacccagtcttgagcagttctttatagcagtgtgaaaatggactaatacaattttcaaactacaaatttaaagaacatactacatacctgggaaataatcagaccagaatgacctataccctacaccaagtcatactccagtaaaattacaggacataaaattgtatcaacaggctttcagacaatttatgccagaagcaataaagtaacacatcgacaacactccagaaaagaaactttgagtctgtatacctgtaaaattgattttcatgtaaaaagaacacaaatttttatgtactatccacaggaaaaactgggaatattattctcttgatacctttctgaggaatatttcagagtacaagcttcagacaatcaaaataaatagagatacactgacctaaggactcttgatgtgcataaaagatagaggtgcctgtagaactaagactacgtgagggctaaaggagagaaagtatcataggaaatggctatatgtgctgaaaatctagatacagttcgagttccaaggagcagggagccatatttccacagttaaaaacagattagagatgtatcgcatttctggttagcaaatagagtctggaagttgtcactaccatgctcacagtaagaaaaaggctgagcaaacaaaacaaaaaactattccgtagattcatcagaaaattgaggtcacagggcaagccaccatactgaaaactagagacaggcaaacacagagaatcacagcatactaggagcagaaatacctgctggagccagcaactggtaaggatgcttcaaggataactgcctaattgccagagactgagtggtagactagtttgagagattaaaaacaacaacaaaaaacaacttctgggagcctggtcttaaggggtctcctgtactttgctgagttttacctccaagagccctatcggtttctcagggtgaaaaaattagataggaaaaaaaaatccctttgtgcttcatggaaggggagaagagcaaccactgtgaaataaggccaaagtattctgctctccttaacaaaggagaaatgattttagcagagcctaggctacctgggttttaccagagcctgaccaataggaagtaatggaaatacccaactccagcccgctcacaccttcctgtctcacttgggggacatgcagggaagctgagaaacagctgtgaaggtcacagccaaggctcactaaaggacagagatctaagcacaggattacagagcatttcccttttcccgatcctgtcttgtcagaagggctcctataaaataacatggaattatggcagaacttcaatgctcacacagtatttaaggattcaacagggaaactctaagacaaaaggggaggaaaaaacaaggaagacaaaagagaaaatgttaccctctgacacccacagctacaaaaatgtgagaactcacactaaaagcctgtttacctcagttcattttacccaatgcatcatgtctggcttacaacaaaattacaagctactctaaaaagaaaaaaatacaggctgaagagagaaataaagcaaaagaagtacacttggatatagcagatattttaaagttatctgactggtactttaaaattactatgattgatatgctaagagctctaatagaaaaggtagacaaaatgcaagaaaagatgggtaatgtcagcaaagacaaaagccctaagagagaactgaaatactagagattacaaacactgtaacagaaataaagagagcctctgactggctcattagtagaatggatacagccaaggaaagaatcagtgatcgtgaagacatgtcaacagaaacttcctgaactgaaaagcaaagagaaaaaagaagagtggaaaagtgaaacagaatatctaagaaaatgggaaaattacaaaaggcataacatgcacataaagggaatataacgagagaaagaacagaaaaaaatatttaaataactcagaatattccaaaattaatgacagagaccaaaccacatatccaagaagctcagggaacacaaaaaaggataattaccaaaaaatctacacctacacatatgacattcaaactgtagaaagtcaaagacaaagacaaaatattgaaggaagtcagaggaaaaaaacaaaacaacaacaaaaaaaaaaccttacctataaagaaaccagaataaaaatcacattggatttttcttaagaaaccatgccagcaatggggtaaaatataaagtgctgaagggaaaaacaccctccaatctagaatcctgtattcaatgaaattatctatcaaatataaagaaatactttctcaccaaaataaaaattgaagagacataaaatgtgctaaaaacaagctcgtcacagagaataaaaacaatacagcagaaaatagtgtctacataaaggaagagtgttaaagaatgaataaaagtaatataaaatggtgtattgttcttattcttaatctaacagataacagattgttcaaaatagtaacagcagcaatgtgttggttgattatagtttacggataagtgaaatgaatgttagcagttctataaaggacaacaggaaggaactggaaatgtttgattttaaggcatctgcactggctctgaagtggcacagtgttatttaaaagtgagttgacattcattgtaaatgtatattgcaaactctagggctatcattaagaagtttttattccttgccttatcctccttctaaaaaaaataaatttttggctgggcgcagtggttcacgcctgtaatcccagcactttgggaggccaagatgggtggatcacgaggtcaggagatcgagaccatcctggctaatacggtgaaaccccgtctctactaaaaatacaaaaaaaattagccacgcatcatggtgggcgcctgtagtcccagctactcaggaggttgaggcaggagaatggtgtgaacctgggaggcggagcttgcagtgagctgagatcacaccactgcactccagcctgggtgacagagcgagacgctgtctcaaaaatatatataaataaataaatacatacatacatttttacatgtaagtttgctgagaggagagaaaatggaatatgttttgagtagagaaaatgaaatcatacaacatgctcaattaaagccatggaaagcagaaaaagagcagaagacaaaaaaaaaaagaacaagggcaagaatagaaaacacttattatgtaggtattaatctaagcaatatcaatgatcacattatatgttgataaccaaacatatcaattaaaagactataaaagactatcagggtggatttttctaaaagaaaaaaaacaggatctaacgatatgttatctatgagatatccactttaaatataaaatatagaaacaaattaaaagtaaagggatggagaaagatacatgacactgaacactaagcaaaagaaagctggagtagtcatgttaatttcagacaaagctgacttcaaagcaaggaagattatcagaaataaaaggggatattatataatgattaaaaggtaaactttccaagaagacacagtaatccttaatgtgtatgcatccaacaacagtgtcaaaatagcaagacaaaagcttacagaaatgcaaagagaaagaaacaaacccactattatacttggagacttcaacactccattctgttagtaactgacagatccagcaggcagaaaatcagtaagggcagagttaaaaacacaacaccaccatcaatcaactggatataactggcatctatagactactccatccaacacaaaaaaacacattcttctgaagcttgcacagaacattcatcaacatagaccacattctgggccataaaacaccccttaaagagaatagaaattatataagctctcagtccacactggaattaaactagaaatcaaacagaaagatagctgaaaaatcccaaaacatctggtcattaacaatgtatttctaaataacacgtcaaagaaatctcaaaaaattttttaaaatattttaattaaatgaatatactacttatcagaatttgtgaagtgcaggggctgggcgcagtggctcaagcctgtaatcctagcactttaggaggccaaggcaggcagatcgcgaggtcaggagatcaagaccatcctggctaacacagtgaaaccccatctctactaaaaatacaaaaaattagctgggcatggtggcgggcgcctgtagtcccagctacctgggaggctgaggcaggagaatggcatgaacccggcaggcggagcttgcagtaagcggagatcacgccactggactccagcctgggcgacagagggagactccgactcaaaaaaaaaaagaaaaaattgtgaagtgcagcaaaatcaatggtaaaggaaatttatagcattaaatgcatgtattacaaaacaagaaagttctattaggttggtgcaaaagtaatggctaaacggcaattacttctgcaccaaccttataaaatcaataatccaaacttctaccctaggaaacaagaaaaatgagaatgaattgaactacaagtaaacagaaaaaaaattaataaatattagggcagaaatcaatgatacttaaaaggggaaatcaatagagaaaatgtctgagtccaaaatctggtttttggaaaagatcagtaaaactggtaatcctctagggaggctagccaaaaaaaaaaaaaaaagaactaattactaacaacagaaatgaaagaagggccattactactgatttcatggatgttaaagggataataaagtaacattatgaacaactctatgtccaaaaatgttataacttagataaaatggaccaactgctggaaaggcataatctaccaaaactcacacagggagaaatagatccttttagtaggcctacgtctattaaataaattgaatcagaaatattaataaccttctaaaatagaaagcaccatgcccagataggtttactcatgaattctatcaaacatttaaggaagaaactataccaattctctacaatgcctttcagaaaacagaagcagagagaacaattcctaactcattctatgaggtcagcattaagtcaaagacattacaaaaaggagaaactacagaggaacatctctcatgaacatagatacaaaaattctcaacaaagcatttgaaattaattcaaaaatgtattaagagtatacacaatgaccaaatggaacttactccaggtatgcaaaggtggttcaaattcaaaaataaaagcaatccatcacttcaaacaggcgaaagaagaaaatccatatgattatatctatagatgcagaaaaagcactggacaaaatccaacacccataaaaactcttagccaactaggaatagaggaaaattttctcaacttaataaaaaaatctacaaaaaacctacaattaatacgatacttaatggtaaggaactagtttctttcctactatggttgggaacaaagcaaggatgtcacctgtcacaacttttagccaaaatcatattggaagtcttagttaatgcagtaagaaaaagcagaaaaatgtatgcagatagggaaggatgaattaaaactgtctttatccacagataatatgatgtctacatagaaaatcccaaatcatcaacaaaaaagaactgaaactaataaacaactacagcaaggttgcaggatacaaggttatatacaaagacaactgcttttctatataattagaattttaaattaaaaacatatcatttacattaacaccaaacaaatgaaatagtaagatatatagctaacaaaatatgtacaagatctatatgagaaaagtttcaaaactagtatgaaacaaatcaaagacctaaataaactgtgagatagcccatgttcatgaataggaagacccaacattgttacaatgtcagttcttcccaagttgatctacatatcaattccagtcaaaataccggaaagtttatggatatcaacaaactgatcctaaaatttacatggaaaggcagaacagccaatgcaatattgaagaaaatacaattgcagcattgacactgcccaacttcaaaacttagagtatggtattggtgaaacaatagacaaatagatcactggaataaaatagcccagaaatagaccacactaatacaatcaactaatctttagcagaagtgcaaaggcaattcagtgggaaaaggagtcttttcaacaaatgatgctgaaacagatggacatcaacacacacaaaaatcaatctagacaaagacctaacacctttcacaaaaataaactcaaatcacagacctattatataaaacacaaagctatcaaaatttctagatataacaaaggagaaaatctagttgacctgagatttggcaatgacttcttagatacaataccaaaggcacaacttatgaaggaaaaacttgataagtgggacttcattatatttaaaaatttctgctctgtgaaagatatcattagggaaaagaaagaccaactcaaacaaggagaaaatattcgcaacacacatacctgataaagaactggtatccaaaatatgtaaagacgacttaaaactcaacaacaaagaacccaattaaaaagtacataaaagatctgaatgaacatctcaccagagaagatatacatatggcaaataagcatatgaaaagatgctcagcatcatatagtcactagggaattgcaaatggaaacaatgagatactactgcatacccactagaatggctaaaatccaaaacaccaccaccaccaaatgctggtgaggatgtggaacaacagaaaatctcattctttattggtagaatgcaaaatagtacagccacttgagatgacagtttgatagtttcttccaaagctaaacatagtcttatcacatgatccagtaatcacattcctaggtattcacccaaaatctgcacaagaatgtttacaacagctttattcataattgtccaaatttaaaagctgccaaaatgtcatccaacaggtgaatggataagcacagtgtggtacatccagacaactgagtattattcactgctaaaaagaaatgagttatcaaaccacaaaaggcatggaggaatcttaaatgcatattgctaagcaaaagtagccaatctgtaaagaccttatactgtatgattccaactatatgacattctggaaagggtaaaattatagagacaaaggcaaactgtaatatttcagtggttgtctgagatttaggaggtagataatgagggagaggggatgaagaggtagagctgagaggatttttagggcagtgaaactgttccatatgatactgtaatggtgaatacatgatgttaatttgtcaaaacccataaaactatactatatagagtgaatcttgatgttagctataaactttagttaataataatgcatcaacagccaggccaacatggtgaaaccccgtctctactaaaaatcaaaaaaaaaaatgagctgggcgtgatagcgcatacctgtaatcccagctacttgggaggctgaggcaggagaatcactggaacctgggaggcagaagttgtagtgagccgagatcgcaccattgcgctccagcctgggtgacagagcgagacgctgtttcaaaaataaaaataaaaacaataatgcatcaatattggttcagcaatcatagcaaatgtaacacaccaatgcaagatgttaatatggaaaactaggaaggggagatggaggagagatgtgaatctgtacttcctgctccagttctctgtaaatcaaaaagtgctcttaaaaaaaaagcctattttttttcaaagagggagaatgaagatagcatatgcataaaacaattgtttttagcaatactgacattagtaaaattagtattgttaattgtgtgttgggtaccaaacacgtgattgtgagatgttctaattctatcatcaccaaaatctgtgagaggcagggttctgagaggaagggagaaggcccagatgaggcatagaaggagttaaataaaagctttgcagtctgttatgtatttccattggaactaccagtataagctcacgatgctggcagtctcatgacttaaagggagagtgattgggaagagcaggagctcccaacctactaacgtttcttgctttgaaaatctgtcaacttgtactgtcatatatgcacttatctatgtgaatacttcagtaaagctttttggagtaggattttttaaaaactatgtgtaagtattttcagaagatgaaggttcctgtttccttggttcaaatggtatcaagataggtaggttgcgtccctgaatgcattcctaaattgatacagaatcattagcccagacagggtagctaccatagcttctagaacatgaccagatggccacaggcactcagcgtgctcgctgaattagctgttcatcttcttctcttccacagggtatgtgtatatgactgtcagaaatgagtaaggcgaaacaggataagctaagaacactgcttctgaagtctgctggtgtgggttcaaatctgggctctaccacttattttctgggtgactttgagcaagttaatgaagctctctaaatctgtttccttacctattagataataacaattaaactgtgaggtttgaaagattaatccatacagagggcttagcacaatgcctgggacatagtaaatgtgtgtgtgtattaatacaccccatgcatatatggcatgttatttcgatcatattatctattattttcatcctcctaacaaagggtgaacaactttatagaatacaaatatataataaatcatataggtatctttgacacggcctaaagacttaagcacttacagctgttttattatttgttcatttattttgaaacagagtctcactcttgtcacccaggttggagtgaaatggcgtgatcttagctcactgtagcctccatctctcgggttcaagtgattctcctgtctcagcctcccaagcagctcggattacaggcatgggccatcatgcacagctaattctcatattattagtagagacggggtttcaccatgttggtcagggtggtctcaaactcctgacctcaggtgatccacccaccttggcctcccaaagggctgggattgcaggtgtgagccactgcacccggcctcacttacagctgttaagaaaaccaagttacatagactaccattcaaatattgagattgcaaaccatattaccattctctggtctgcactatgtcctgaaaaaccatgaggccaaacccccgttgcaagtaattgcccgttctgatgtgtgcctttcatttgacctcacccttaaaattataagctacacagagtccaaaggaataattaatgtatatgcagagaaatagatgaaataaaaaggatatttatgaggtatgggtactataactaaaactaccatttaatgtaattcgcgtttattctgtttgatacatgaaccaatatttccccaacacaatcttttccagcaccatacttggtactgttttaagctaatgttctaagtttgaagacagaagaaaatgaattaatatatggtataaaaagatctcacatctgttcattccattctgttaagattaatagttttttaggaaaccatgaagaaagtggggagggttctgctaatactgatcagatggagattaagttgcttcttatgttttcctcaatagttgaagctctgcaaccatcctgtaaatccaagtttccaagctggcagggttttcaattattatccataccaactgtagcactggttataatggcaaagcagtgggtgttatggtttcttatggtgaaaatataactacttcacatctaataaacaccttatcgtcatcttaacacagcaaataatactttgtcactagataatcttaaaattcaatataaggctgggtgcagtggttcatgcctgtaatcccagcacttcaggaggccaaggtgggcagatcacttgaggtcaggagttcaagaccagcctggccaacatgggaaaacctcgtctctactaaaaatacaaaaattagccgggcatggtggtgggcacctgtaatcccaactacttgggaggccgaggcaggagaatcacttgaacccgggagacagaggttgcagtgagccaagatcgcaccactgtactccagcctgggcaacagagactgtctcaaaaaataaaaaaattgaaaaaatagaaataataaaattcaatataaactgccaggctctgcttacataatgcctatcataaaaaatacattcaataaattgttattgcaggacatagagtattttaattattactggaaaaattaccagtttccaaagcatgtctttcattctcaacagaaacttggccacaagcacatcccaacaaaaatcctgctgctgttcccccagccaccccctgggctatccacagctctgaactcaccagtgtgtggccatagctgttcctcttgaccccagcacactgggcccagccacccaacttctcctgggaattctgaattagatgaagaatgaggcagtgggtgtgcgggtacaatgagaccatgagacaggtgggcaaagaccactgagaagtaccatcactaagatttcctagaaataaagagatattgttttgcattggttatatcatcacagataaaacggtttttaaaatagttatgcaccgcttaattatgtttcactcaacaatggaccacctgggaggccagcgcaagcagatcgcttgagtccaggagttcaagaccagcctgggagacacagtgaaaccaagtctctacaaaaattatccgggagtggtggcaagtgcctgtagtctcaacttgggaggctgaggtgggaggatcacttgagcctaggaagctgaggctacagtgaggcaagatcatgccactgtagtccagcctgggcaacagagtgagaccttgtctcaaacaaacaaacaaacaaacaatagaccacaaatatgacagtgttcccatgagagtacaataaggtactgtatttttgctgtatcttttctataaagacacaaataccactgtgttacaattccctgtgatattcagtacagtcacatgctgtgcagatttgtagcctaaaagcaaaagccttagtcacaagcataccatctagcccaggggtgtagtaggctacaccagctaggtgtgtttagggacactatatgatgatcacacaatgacaaaatcatattaagcatttctcataacatatccccatcattaagtgatgcatggctgtactaatagcgagtattattaagaccaataggtaccaggtggtatgctaggcccttatagatattaactcacaacgaccctatgaggtgctcttattattcccaatttatagatgaggcacctgaggcacagagaggttaagcaacttgcccaaggttacacagctagtaacaaacaaaaaagatgcttacaaaaaagccaccgtggccactggggccggaatgtcagaggactgaaaaacagtcaaatgtcattactggctcagttataccaaagaggctacaacttttgtttcagtgaaacatttccagttttaaccctatcctacaatcaaaaatagaagttgtcagttccatcttgttcctgatagctggaaactacttcactctggaaaccgggaagaagcctgcaggaaggagacagagtacatgctcttcctccagagctatgctttcttcattaactaacctgaatctctttactaaaagcagtaacattctttcttcaataaatttttcccaagtactacgccaagtagagagacacttcagttaggttggatgggatggtgggtcagaactgagtatactcaaggggcttcctagaagaggtgacgtgaaatggagtcatgtgaataaataagtccttccttctttcaacaagcactaactgacaaggggacaagggctagctggagacagaaaaaggaaaagagcttctcaggccaagatgtggcatgtttaaaaacacaaaggtgagcacatacacacaacttagaggagtgaaaacataaatgattttaaggccaggcacggtggctcacgcctgtagtcccagcactttgggaggccgagatgggtggatcacttgaggtcaggagttcgagaccagcctggccaacatggtgaaaccccgtctctactaaaaatacaaaaattagctggctgtggtggtgcacacttgtaatcccagctactcaggaggctgaggcaggagaatagcttgaacccaagaggtggatggaggctgcagtgagccaagatcatgccactgcactccagcctgggcaacagagcgagattctgtctcaaaaaactaaataaataaaaaataaatgattttaataaagattatagctaaaattacaggttctccccagctcttttatctttcccccaaagaaggtctacatggatggcatgtgttccaggcttaacaagattttgagacagctcttccagataacccatgatcatatttgtttattattttgcctggtcctttagaaagaccacttccttgaaagcaggttgttttccaagatttatctgaaaagtgtcagtctaacctggaaaaaaaataataaaggcttgaccacccagagagggcaataaacttgaagagattaaaaaattaggaaacaaacaagagaaatgaaagaaagttcctctggctgcagctgggattctgtctctatggaaatggaagctgattacagggcccttcaaaaaaaaatcagcttcatcaaccagctgaagacagttgctgcttgggaaagagtttctacagtgaaatctctttaatacacaaaatcagcagcattacaattatgcctggaagcttttttttttttttttttaaagagacaaggtcttgtcctgttgcctagtaacaggatcatagctcactacaaactcaaactcctgggctcaagcaatcctcccactgtagcctccctaacagctaggactgcagacttgcacaccaccctcagcttgtttttttaaatttttgtagacatggggtctcactctattgcccacactgatcttcttggaagctttgagaatgtgtgtgcaaattacatgtcatgttaaaacaaaaagaaggaaaagaaataaatcaggacaaattttaaataaatagctatctatatcaattagaaccctaggcaaaagtaccaaacactacaggttctaataagccacacaaaaaatcccaacaccattacaaatgccttacccagtctagttaatgaagcgaaattcttagttcaggccattgactatgttggaactgggtatgtctgaggcatttgggcctgtagctggatattcacattaatagttaacatttaatgtacattattgcatctaacactaactagttaataactaacatttaatgtgcattattgcctttaaagtgaaccattaaaccagtcttatgaagtggttacttaggttaccattggttaaggaacttgaggatcagggaggttaagtagcttctctaaggttacatagtactaagtagcagaatttgaacccacatctatccaaatccaagttcccctcatatgctccctgtattcctctgcctcttacggtaggaactgagcatttcaagaatctggctggactataagaaaactgtagaacctgtctaatatctgtctccagcctaagaagttttccccatcagaaagctcttggtacctaaactcctcaaaacagctttcaaaggtaatttgctgtctctaaggaagtgctgcgttagaagatacaactctcccaagaagaaagacaggcatctcatatgcttagtagtacaataccttactgttatcttcaaagcttaattcttaccttttgataaattaaaataatgaacggaaagcttgagatgcaagaactattctctgtacatgccagttaattgttccctgtgtttaatctggatactaatatataaaacttcctggtaacagctaaaatgttatcagtaaagaaatatggaggaaggtgtggtggctcaagtctgtaatgccagcacgttggaaggccaagatgggaggactccttgagcccaggagtttgaggcctagcctgggcagcatagcaagaccccatctctacaaaaaaataaaaccattagccaggcgtggtggtgtgtacctacagtcccagctactcaggaggctgaggtgggaggatcacttgagcctgggaggttgaggccacagtgagctgtgaatgcaccattgcattccagccagggtgacagagcgagaccctgttttcaggaaaaaaaaaaaattacacttataattaatgtagccaagtgaaatattttaatacttgtatatattaagcactgtgtcactgtgtgtgcactgctgagaactgagccctagtggaggctccgaagagcatcctggaaccccgtaggctccgaggagtcccgaggtcagggagtttgcagagagcagccttgggtcaatgttacagaagccagaggaagtggactcttgacatctccaaattcacttccacccagcttcccaaaaagcactattattcttcattagcttcttctttaggaaaatttaagaatgatcttgcttttcagtacccaatactgaaatttacttcaggaagcaagtggctatcttttcttccctaataaaagcaatggcttcaaagagataatagagctcaaccgaaatagctaagccattctccccatttataaatatcacataaagtctcctcttcaaaagctgaagggtataaagctcctctgctgaaagcagcctctctcttctacccagtgagaacgagtgctggagggaggaaagccatgggggccaagggtcccgctatgccaggcatcatcttccctatccccttctctttctcctctgtatcaacagtgctcccaataatgaccatgatcatggcagagctgggcaggggcagcaagggacacacctagatcttcagttccagaggcatctgttctgttgctgacagcgaggacccttacggaatgcaagagaccaacacacaccaaggctgagaagctaactagtacacaacctaagtttaatggcacgtattttcataaaggctatgaaacgcaaatcaactacatttcctcccttttccttctgccaagacgtattaatggcatcaactccaatctctatcccaggcaggttttcaaaccgggaaaagcatggcttcacagtaaacctgactctgccattctttccatgtctcaatggctttccatcacctttcagggtctcctgaacatctcccttcttctctcgtcacatcctggacgtgatctcacacactcatgggcctaatccatcattctttcattttttttcattcctcaaactatttttgagcatctactgtgctccaggcactattataaaaaaaaaaaatgcaagcatgaacattgcactgcttttgtcttcccaatgtcccagtggagaagggagacttctagattaaaaaaaaaaaaaatcattacaatcctacgtgacagaagtcacaaaacaaggcacacgtccaacttcacagggcagggagtggctatgttagcttggtgcagacagagaagattttacacaggtggtgatgtctaagctgactcttagaagtaaaacgatttcaggtgaaaaagactgagggtgagagaaaacagaattcgtaaaagcaccaagatctgaacaagtaggctccggtccagaaaggacaataaattcagaatggctgaaatgccaactgcatggaagggtaaggtagtgttcagattcggaaaggccttgtgcatcacgcctagaaacctggagcattacagtcggtaacggacaacctggaaaagtgtggagagggtttaaaccaaagccacgtcagcctgaagggcgtccgggtgcagggaggggatggggcagggcaggggactgggaagggtccagccccggtccggccacgcagagagaagcaaccccaagtgcgacgccgcacacactcaccgcagagggcagcccctaagagggtgggcgtgcaaccacaggcttcggcaggacgcactccggctgcgacagatgccctcgttccctgctacacctgcactaaataactaacacgccctgtctcggcacaccgcgcagctgccagctccacgcccgaacctacccatattaagagaacagctcgctaggcgtggctccagggccaggttccgcccttaaaagaatatggaagaggctggccaatcacgtacgttattcggcttcgagaccccgcgccacgctgaggttaatttatcgccgtggcgaacactccgcggtttggaactctgattgggccgagcttggcgcgtgcgcgcgatgtttggcgcgtgttcagttgatgggtcgaagcccagagggctgtgggggaaagcagagaagtttatggcgcgactgcgcaagggagggtaatggctgagggtgggtgttgcgaaagctggaagtaaattgccttcgaatgtttcgcttctgtaactgcggctccactcgccagaagttgctaccctgagtcccacaatgtgcctctgaaggaccttgtggggcacgcagcctctcgccctatgaagagcttctccagacaggaattctggcgtggtctacgtttctccagcgccccgctggaaatcttttttgacaggtttctaaggctggcttttacccctgacccttttgcccttaagcaacaagaaccaccctcagggctggaagctacaagtaaaaccctaccatttaaaggtcatttgaaaacaccactaaagcgatgtctttcccgactatgacttttacatctgtgaaacataacattctggctcccaggaacctcccgctttctcttccaaaagcaaccaaattttaaattctagcaaaactgctgccctctgcctccctctttcctgacccagtctgttacccagcaatatcctgtgcttctctcaccaaaaaccctgtcctgagagacaatttcatactatggaataaagattggcaccaggcacttttctcctattgtcacctaaattgatgatagacggataccacacatgcatttatatattgtagattgtagcggggatcaaagctttaaggagatgtaaaataatgtaattctagccctgaaccaattggattaaaaaaggatctgcactcttaaattcgaaagcagaaacttattgcttaaaaaacattccagatgaaagggttattcctgcattagtcttctttgatctggaaccgttccttggcttttatatttattgaaatgacgttatttaagagtacagaccaggtattgtgtggaatatcctttaaagtgagtttgtctgatgttccctttcaggttatgaatttttggagaaacaccactaagtgatgtgtcttttccagtgcatgttatcaaggtagagataacatcggtttctcccagtattgatgatgttcacttggttaaggtggtgtctgcgaggtttcttcaccataaagttactattttttctttatgattaaaaataatgctggggggaggtgctattggattacgtcccttttctcatctaatttttacctagtagttttagcatccactgatgattttctaacttcataatttcatctgtatgtattagttggtaatctcctaatacatttatttcttgaatcactaactcttctaaagcaaaagaactttcttgaaaaaattagaattgttcttgttccatcagtttctaatagtgaatcttgactgtgtaggctgaagacagtagtacctgtattaatcggctagtgctgtcgttacaatataccacagaccggatggcttaaacgacagaaatttctcacagttctggaagttcaagatcaaggtgccagcagatttgatttatcctgtggactctccccttggcttgtggatgactgtcttctcttggtgtccttccagggtatttttctctgtgcaatcacacccttggtgtctcttcctgttataaggacaccagtcctattggacagccccactcttgtttctctataataacaccctgtttttgtttcataaatgtactctcttctcaagtatcactgaggataatagtttttaaacctctcttctgttcactaaattatgtttcttcaaggctccattcttatgtgtgtttatctagtctttcccctagaaaagaaaaattcttcccctctctggtggtttattctttgttgtccttttgagttcaagtgtgaagatctgaaatggtttttctagatagctggagtggtttctttcctctcgtttgtgtgtattgttttcctcctagatccttgggctgattgttgaatttctttagaggcaagaacccagtgttatgcctgcaggtcatcaccaggctacctttgctggtggagggaaatgatggattgtcagtgccagttaaggcaactccatgactttggttttagctcctcacactgcacctgccagccccacatccagataacacctggaacagagagtcccaaacctcctgcatttctctctcaaagttattttgggctgcatgcctccattcactcctgcttcacaggaatttgttttcactcctgtttgagatagtaaaaaccaaactgtttttgctactcttacacgctcaacacttctgacaccagagattcccccacacatgaaacagttctccagcagacaccagctaagtgtcctacagtttaacttaattctgatactacctcaacttacagtcaaatcccacaagttaagggtgcatttccacaagactgtcccctactttaggttgactgtcacctatacttctgaccacctataaatcagtattcccacacccccttctcgggtttgattaatttgctagggtgatggttagcctgtccagggtcctgattgctagcagtgagacttcatggtgacacaacgtggaatcaggaaacatcccttggccactagatctgggaagttgactcaatgtgtgtttcaccagataagaatattaaggtttttgccttgggactggctcaggaaatcaagcaagatggacctgggaagtgtgctttgtgaagttgggagaaatcagctgatagtcttgtatggctgtctgttctctgctttatcctcagtgcacttagtatatgtcacatagctgatgctcaataaacatttggaaatgagtgaattaaatgtaaagcaaaaccagaggatatatgatgggtcttactaatgagagtagagtcgactcttttctccttcttccagctgaattactcaaaaactgaattgctcaataactacttccctttgctgtacatgaaaatgtcatgcttccaagcctgtcaatcccctaacccactaaaaaatcactgtttatttcctagatggttagcctggaagattttgtaaagcttcattttgtctcttttttctgtatttttaattttaaaattacataataatattgattatgctttcctcaatttcatgtacacccctcccagatattccaatatgcctcctagaaaagcatgcccttctgagtggaaatgataccattactctaatgatgcaatccatgatccaagcatcatttttttgacagctacatcatgttaatcttgctttcagaaaagtactgtgtcatttcatgttattattaaactttccctgtattctgtacctttgcaattcatttattagataaaagaggaagattttatatctatcacatttcatctgttactattggcccatttttctagcttatcaagaccctttggatttgatggtgttactcattgcatttgctgtcctttccaatagaaatgtcatccataaagttgatatatctatccataatacaaaaagggagcaggaattttttttgttgtttgttttcttgagatggagtctcactctgtcacccaggctggagtgcagtggcgtggtgttggctcactgaaacctccacctccctgagttcaagcgattctcctgcctcagcctcccaagtagctgaatttttaaggtgagagtattttctttatgtacctccatactctgtccaggaataatttctctgaaatttgagtattagagtaagatgaagtaatatattccacagcttctttcattcacttggtctcatgttcttaataacccttgattttgcataattaacataaagcaaatttcctttgtaaaggcttctgcttttctagaggcagtgaaaaactttataaaagcattggatgttcttataaaaaggaagctgataactacctcactaagttacatgtctggcagcactggagataaggatgtgctattgaactttctacttgttgttaaatggcaaactatattgtttatttataacttaatatattgtgttaaggaataggcagtggtgctgcttatggaaactttgtactcttgagagtaaatatataatatagtttggatatttatccccgcccaaatctcatgttgagttgtaatacccaatgttggaggtgggcctggtgggaggtgtttagatcatgagggtggatccctcatgaatggcttgggccatccccttggtgataagtgagctctcactctgagttcaaatgagttctggttacttaaaagtgttggcacctgccccctactctcgctgtcttgctcctgctttcaccatgtgacatgctcgtttccccttcaccttcttccatgattataagcttcccaaggcctccccagaagccaagcagatatcagcaccatgtttcctataaagcctacagaactgtgagcagattaaacctcttttccttataaattacccagtctcaggtatttatttatagcaatgcaagaatgatctaatacagaaaattggtaccaggagtggcgttttgttataaagatacctgaaaatgtggaactgactttggaacaaagtaatgggtagagaagttggaagagtttggagggctcagaagacagaaagatgagggaaatttggaacttcttacagactggttaatagttgtgactaaaaatctgatagtgatatggataatgaagtccaggctgccaaggtcttggatggtaatgaggaacttagtgggaactggagcaaaggtgacacatattatgcattagcaaagagcttggctgcattctgtccatgccctagggatctgtggaagtttgaactaaagagtggcaacccggggtatctggtggaaaaaatttctaagcagcgaaatgttcaagatttggcctggctgcttctaaaagcatatgctcagatgtgggagcaaagaaatgacttcaagttggaacatatattaaaaaggaaagtagagagtaaaattttggaaaatttacagccatatgtaaattttgtgtacatggaaaattctctgccatatggcagagaaagaaaaagctttttcaggagagggattcaagcagactgtggagcatcctcttgctagagatagttgtataactaaaagggagtcaagtgctaatatccaagataacggagaaaaggccccaaaggcatttcagaaaactttgctgaaacccctcccatcacaggcccagaggcctaggaggaaagaatgatttcatgggccaggcccagggccctgcttccctgcacagcctcaagacactgctccccacatcctggtcactccagctccagctgtgtctcaaaggggcctaggcacagcttgggctgcaattttggagaatgagagctataagccttggcagcttccacatggttttaaacctacaggcacacagagtacaacagtggtagattcttggcagcctctacctagatttcagaggcagtatgggaaagcctgggtttccaggaagaagccttctgcaggggcagaatccttgcagacaacctctactagggcagtgtagcagggaaatgtggagttggaggccccacactgagttcccactggggcactgcttagtggagctgtatgaagagggccaccattttacaagagagtggagaatactcagagagattaaataaccaggagagcacagggtcctggggataaatggagaaaaggttcagcgtggccaggagaaacagaagtttgaggcaaatgggagggaaatagagaatcagaggttacagcaaatttctccgtagtcaaggcaaggtctttggagaagctcagattgacttaggggcatggcaaaagttaaacataggtgagacttgggcctggctttggagtaggggaaaagcaggtacatcggtatgttagggaggtgagccatactactactaattgacatagaagctagcatttactgattacttaatatgttccaggtattgttctgagtctttacacatgtacataattattgcaaccctgtgggacaggtaaaataatcccctcatacaaatgaagaaactgagcaccgagagattaagtaagcacttaactagtaaagttaaaattcaaactcaggcagcttgtctccagaattgattctctggaagattcatatgtatattaaattcttttccaaaatgtaaaaattaaacttgaaaatttatgccccatagtgaaagacagagttttaatatgtcaaaaattaatgcagcataattgtgtacaattcaataatatttattatccctaattgaacattcacatgaaatttatacttctatattatcattaacttttgttgttgttgtcgtttttgagacagggtctcagtctgttgcccaagctggaataaagtggttcacagggtttcactgcagccttaacgtactgggctcaagtgatcctcctgcttcagcttcctgtgtagctggtaccacaggtccatgccaccatgcccggctaatttttgtatttttggtacaaatgaggtctcactttgggttgcccaggctggtctcgaactcctaggttcaagcaatcctcctgccatggccttccaaaatgctgggattacaggtatgagccactgtccctggctattgttattaactttgaaaaatgtatgtcacatatgccataatcatttccaagtctttcaaagatatttttttaaatttcagctgaaaatattagaatgaaatgcacactcaagactaaagaaggtatattctatgctcaagaaaatgtacaaatattgatttttttttctttttgtgatggagtcttgctctgtcacccaggctggagtgcagtggtgtgatcttggctcactgcaacctccgcctcccaggttcaagcaattctcctggttcatcctctcaagtagcttggattacaggtgcctgccaccacacccagctgatttttgtatttttagtagagacggggtttcgccatgttggccaggctggtctcaaactcctgacctcaggtgatccatccacctcagcctcccagagtggtgagattacaggcatgagccaccatgcccaacctacaaatattgattctatccatggtttggtgaaaaccataaaagtacagcttattctccatggcattggcaggggtcgtgtataaagatgacaaagtcctgtctagcatgctgcagagggaaagtgctgagtgaacatgctgagttacccacttagcagtcccaagttaattgcaatgtggatggatgccatgcataagcagcatgaaattttatgaagacctgatttgaggaagccacgaagggagctatgctggtatcctaaagttgaaaaaaaagtatcaaattatatacttcacatatttgaaactttttctagaaatgttaacctagtaacaaagtaccacataaagaaattttatagaatttacagtgaacctgcatatatttcttgaagtaaccttgcaaagaatgaatgcaaatgctttacaaagaaatatttctgggcatggggagttaagggaaaatggggaaggactgctagtgggtacagggtttcttttggggagtaatgaaagtgtcccaaaattggctgtgctgataatggccacacaactctgtgaatctactaaagaccactgaattgtatactttaaggaggtgaattgcatggtatgtaaattgtatgtatggaaatgtatggtatgtaaattatacctcaataaaactgttatcgaaaaatttgaacttcttattcaagttcttactgcaaatttaatttttcttaaagaaacatatgtaagtgaaatgatcacactaagtaaaatatgctattttcatcctcaatgtttatagcttcctcttgggatttattttcatatacttctgtggaacagtgtgtgtttgtctgtgtgttgaggggaatagatgggtccccgttttctctcactttctgttcattcatttggcaaatattgatcaagtcactgccacactgcaggtattgtttttagtactagggatattaaaaaatgagcaaaacaggcaaaaagccctgctctcatgatgcccacattactgggttttcctgcctcagccccaccccaagtcatcaaaacacagacttatttccaagatactcactaattcaagtgagtatagatttttttctgtaagagatatatcaaggtatatgcaatatttttattcctatgcatgtctactttttacctccactttaatctgcttccaaatttcaacaacttcttttatattgacaaactagtatggacagtcaacagaagttttagaatctcctttgattctccttgtttttcccattattctttcatttgcttgatgttcatattctgtagttgcaagggatagaggatttccctgtgaacaatggtatttaccataacacaaaatatctcccaaatcaggggatggtttgtatttatattagcaaaataaggagccacctctgtatgtaaattgtatgtatataaatgtaagtttacattttacatacatatttacatgcatatttacatacatacaaaagttgaattgtatacttaaggagtatatataaaaaagtatatgacttttgtatgtgaatatgcatgtaaatatgtatgtatgtaaaatgtaaaagttgtatgtatgtaaatattagcaaaatattacaacttacaaaaagttacatacttacaaaaagttgtaagtatgtaaatattagcaaaataagagctacctctctatgtaaattgactattttatacttatgttttacttttttaaatttatgtttaacatttataaagtgttaaatcagtggtacctttaaggaaaaaaacaattacacatgaaattatatctacatttataaaagaaaatgtaaaactgggaaaatactgtaaacaccaacagtttaaaaattgatgtatctcgctatatattacagcttaacgcggcactggattaaatggcaatcacttctctcagtgactcagttttcttttatctgcaaagtccaggatatacttgttctttccaccttacgggattgtcactgtggggatcaaatggggttatatgtttgcaagccactgaaaaccatgcccacaaaaaaaaaaaaacctgtcaatataaagtcatgatattgttaaaattgtctcttttcctcccttttgaaatgtttgtaaatttcaattcaatgtctaagagctggttagcttctaaatctgatgtgtggcacatttactggggtctctgtctgtgggccttctgtgcaaccccgtaatacagtatctgctggtcctgcgatcaccatttctcaccaagtaatgtaactccgtgtataaagatatcactaacaaaaagtttattaagtgttgtctgtagttgcaaaaagttcaagagacctaaatgtccacttagaggggcttcgttaaataaattaggctgcacttatgcaatggaatactctccaaaaactaaatacgatgcaccagtgtttttattaagataagatattaatgatgtattggtaagtggaaaaaacacaacatcaaacagtaaaaaatatgcatgtaaaatatatgcaaagatattcaaagaaaggtgttaagaatatatgagaatgctagggtgttagaaaaattagtctattttctgatacttctgaaaatagcatttatcaattttataaataatatattttaaaaaaccatctagatttccagctgatataattctctgtctagtttgattacaaagcctaagtgattaaagagcagaaaaattagaaacagatacccacttgccagcagccacttttcccttacttactctcttgttttttgagacagagtctggctctgtcgcccaggctggagtgcagtggcgcaatctcgggtcactgcaacctccaccttctgggctcaagcgattctcctgcctcagcctactgagtagctgggattataggcgtgtgccactatgctggctaatttttgtatttttagtagagatggggtttccctatgttggccaggctgatcttaaactcctgacctcaagtgatccaactgcctgggcctcccaaagtgttgggattacaggtgtgagcccatactctctttaagtatctacttgcacataaaatgagaggaccgtaagcacagatgcctgcaatattgaatcaacatcagattctgagttgttgtttgtaaagccctgatatgagctttacaaaaacaaactatcagtcaccatttcttcaaagaattcctgcaattttcagcaagaagtagataaaatagagccaggtgtccaaatgttctatagttttatttatgcagaaataaacatgggtattcaaccctaggcggtgcactgacgtcacagagggagcttttaaaaaacagcatgctgtggctcctccccgggaaatcctgattcaataggtttcagtgggaactggaagtctaatgtaagtaactccacaggtgattctgaagcagagctgattttggtaactattaatagtaatttaatgcaatgcccaccagatggcactcatgctccgagaatagaaaggcaagtcggaaaactgctcaatttgttaaaggctgtgctttgtactctgcatgtgtctgcctttaaaagcctacaccaggccgggcgcagtggctcacgcctgtaatcccagcactttgggaagccaaggtgggcggatcacctgaggtcaggagttcaagaccagcctgggcaacatggcgaaatcccgtctctactaaaagtacaaaaattagccgggcgtggtggcaggcccctgtaatcccagctactcacgaggctgaggcaggagaattgcttgaacctgggaggcggaggttgcagtgagctgaggttgtgcccctgcactccagcctgggtgacaagagcgagactctgtctcaaaaaaaaaaaaaaaagtctacattaagtgactcattgtctaaacataacaaatgggaatataaaatgtttgttctactcacgcctctgcagtatggtccataggatggagagctgacgttgggcccatcgtagagtgtgagatagttctggacacagtctcctggatcgtcaatgctgatgaagtaaaagttgacagtgagaagccttccagcaggagctaccagtgcccactcgcagttcgtgttgtttggataggtgcctggatagccagggctggtgaatgagcctctgtctccataaagagttccaccacatcctgcaaggaaaacaggacaggaagtttgattcaacaatgtataagccatccagtctggcttgttaggcaataagacttcattttcttaaggtgctgagactctgcaagaataatagaggcagaaaccgcttttcctgttcctcttctttgggctacaccctttctcctcacttcccctctcttcccatcgccaccaccacctcttccatcctcaacacacatgcctttgcctgcatatcacgatccaaggacaacttcctccaggactgtactttgaaaatcgggggttgacagcagaatggaaaacaatcaaacaaacaaaaacaaaacaaaacaaacaaacaaaaacttaataaagtaactgtgggagaaaatcaagttgttgcctctgtgctttcgatggtgcggagatctttgcttaccctgagttgatgccaatgatgtgagtgaagtaaaattagaaggaaaattcagcactaaaccaagaggaagtgtgtgattgtaggtggtggcaggaatgacttcattataaaagtaactttaccaccctaataactgacatacttaaggtcgaatacttcaagttttggtgttaatttgttcaatttgttaatctgtatatgaaggctgtcatgatttagactacatatagactacatatctgtggagatccagatcgcctccaggacaggaagaagctggctgtcatagttacggagcacctggctgggcctttgaccaccgaggtctagtcccatctccacctcagtctagcagagcattttgggcaactcattaatcttggtgggtttttttgagatagaatcttgctctgtcacgcaggctggagtgctgtggtgtgatctcaggtcactacggcctccatctcccaggttcaagtgattctccagtctcagcctcccaagtagctgggattataggcatgcactaccatgtccagttaatttttgtatttttagtggagacagggtttcaccatgtggtctaggctggtgtggaactcctgacttcaggtgatccagctgccttggcctcccagggattataggcgtgagacaccacacccagcctaatcttggtgttttatttcctcgtcgataaaatttgagcattggaagtcatctttgtcttcctttgggtgccaaaattccattacccacgattatcttaatagaaccattttcttaaggtatttaaagtgatttctgtttatctttttttatttggaatgtatgttggtatttgaggacatttcataaaggtatttctcctctcttgcattaaatgtattgacatgacttaaattttctttagctgtttgaaaagtggccaaccaaaaatatgagaggatacttactaccctaaaaaagcaatttctctccaggactgccaacaaatgtcagggcctgtgagaagcacaaccattcatatatatgccagaatgtgttcataagttggatttttggtaaatatttttccttaaattgtcaatgaacttccttgatggtcaaaccaacagtcaaaaagtctaacaaaattgaatttacaaaggaatttttaaatcttcataccttatatgtgcttcatatatgaatatatattattttataaacagaaataatgaataaatgtagaatttaaagtaatctggccaggtgcagtggctcatgcctgtaatcccagcactttgggaggccgacacgggtagatcacctgaggtcaggagctcaagaccagcctggccaacatggcagaaccccgtctctactaaaaatacaaaattagctgggcatggtggcatgcaactgtaatctcagctactagggaggctgaggtgggagaatcacttgaacccaggaggcagaggttgcagtgagctgagatcgtgccactgcactccagcctgggcgacagagcaagactccatctcaacaacaacaacaacaaaataatttgtaccttcattgttaaaaatctctattcttaacatgaattaatcagttacacaggtagctaaaaaatataaggttactttgcctttttctattagacaccttatgttttactcacctacactgctttcccgtacaaagtacaaatgtcttaccagagggtgatgaggtccagatgatttcatatccacgatccgaaattacactattactcttaaatcataggtatagttcattattttgagagaagacagggtttggcagcagagtacttgccaagtaatggtgaattgctgttacttccatttctcacctttaggaaggagtcattcattattaaacttacactttcttctccaatgtatatacattacactgtgagacaatttgaatgatgacactttttggaaaagctttgtctttttatatacataagaatgaagggttttctgaaaatacatgcagaagtcatcttcacttgcaaaggggaaaaatgttccatgtgtagatcaaaaaacatttgtatttggattcagaaatatctgttaacctgtagcaattaaaacatcaggctgcttttttatataatagtttttgctatgatcctgcagcctttgcttttggggaaacatttggaagaatgtaggtaaagtgaatttttaaagggtggggatgggtgggggcaatgttgcctgccctgtttccagtcaactattatacatttttcatagtgtgtgtgtgtgtgtgtatgagtgcgcgcgcacacgggtttcccattgaaaattacttggctgtaaaggggctacgaagaaaatacaatgcaaagtataataaagttcagaacaaaaggaatttctgtatgggtgaaggacagaattataaatctatacaacttctgactgttgttaaacgtgttttaaaaacacattccgaggccttgttgcttttttgtttcaactcctcatttttgaatagacacatataaaaacaggaaatgagttggtgttttgagggaagagagaaccacactgtgaattcaaccattttctgtcccccagcctggctcctaccctgcattcacaactagacctgcttccaggagggctctcgacgcttctaaaggaaacgttacacaggcaatgtatgttggaaccagcctgacatgtagaaatgctgattttactgatccatgtattcaaaacactggaagttcctctcttccctttgtaattccatgatttaaaatttggttaattgctggtatcttaagtcacagagttaagacagtctaatcttgctgggctgtgttgatcaggtgagattccttttaggtctatgtagtagcccatgggagagactaatgcctttctagtgcttcagggattattctgctaagtgtttaaataaagtagacttgccatgacagagtagccagttatccactagtagataggagggctgccatatttaagaccttccagcaccatacccttgagtttgggtgttttcacccaggggtcctcttttaaaatggcgttgctctgagaggagcagtgagatactaattttcacggacactgccaacaacttgtcttattcactttcgtctcctaggaggaatggggccaccgagagcagcgggcatccctgcgacatcagaggatcctggaaggggaggtgaaggcatgaaaacaatcgcagattccaggcatggtctagagctcggccctcacttggtagtaacacagaatcctcagtcagacatttctgttcctacggcagttcacaagaatggaatgctgaggcttcctggtccagctgccaataaactatgcccacagtcttcccaccgagagccagacggagctacattttacaggcctaagctgtggtttcctttctttgcttatgggacaggaagtttcagatccattctacggagtaatgaaggacagcgaggaggaagagttcttactgtccatggctggaaagcaaggctttgcttcccagcatctatcaggcaaatggcaaatgttgactctgatcaataatggtccattcaagctggagtgagttaagagttagttgcactgtgactccaacctaacgggattattccatctttcatccagatcccactctcctcattctttctgctttacacttcatataaatatatggatctccgtggtgggggaggtacgtaggtccaagttgagtaacctgaccggcacaaagaatactgtatttgtctcttcgtttcctccctgctacatacatcttttggtttcctgtcatgggaatattcctttagaaaaggcatgagcttcctctgagtgttatttatgaaactacatgttaaggctattgattaataaaggatttagatgaattccaaaggggagagctttccaggatgataaaactgcatcaagaatcatgttgaagctaaacccataggcaaagaccatgtgccagaacacccttcctcaccaggccgggcagaaggtgacagcagccctagaagccaaatcagatgaggtgggttgcaggtgagaaaagatgttttgttgggaacaaaggctgcagctaccaagaaactagcagctgaacagaagcccactggaaagaatcctcccacagaaggaaagaagcctgctgcatacaccagtacatttgtttatgctacaaagatcaaatcatcttgggaagcttattttgaatgaagacctgatcaaagaggcagtgagaaaaaaaaataaaacaaaaaatacgactccagatcaggtgtagaggaacaagcaaactttttggaaaccttactgaagcctcttgtatggtgaaacaaagccagtttagagagcatcgggatgaggtttagatttaaattccactctcagaggaattcagcatccttatccttttgagtctcaggttccacctgagtttatttcctaaggatgaatgcattttcaacagagcttgcaaaggtcacaaccgcatgagctctggggggttttctggcaaaacacaggtgctgagttccacacactgggtccgcatcagatgagtcttattcagaccgtttcctgcctatgagcaatgatattcatgttccatctcacatgctcaatgcaggtgatgtggcagaaagagcacagagggagctcaccaggggctctggaagaccccaaaggttcaggcccacaaggggcatggctctgcctgctccaggtgcaaggggggcttctctctcagtgtgtcctggggtgggagttgggggtgaatgggtggagaatgggcaaacagcaaagtcacttctgtgtccaaatgagagctctggagttgtggtggaaaaaggacagaccacacttcctgcaacaagggagcactttttcaaggcaacacttgtctttagaggatgttgacgatgccccaaacttactgtagctgtcagggaaattaggtgagctatttagtatcattcagtttcattttacagaatcagcttgttgttcttagactttcctctgatccttttaggtctcaacttacatattgccctcttaaagaagctttctagttcccagactgagttaggaacccctacccctgctggactcagttagtcctttccacattgtgctgtaattggctataccccatctgtcctttccaccagactaggagtcttccgagggccctgaggttcccaatttccggtgtttggactggtgctctgtaaatgtttagggaatgaaagggtaatgaataaattaatgaaacaagtaagaatcatagagcattagaagcactaaagaaaaggtgtaaaatccatcatcatttaaatgatattcaaatgcatattacctccaagaaatcgtttctgcattcaattgagttctcaatgccaaacaaatgaaaaaagagggtgtggttgtggggggctgtgagagtaatggtgcaatccatgtcactgtcgtagttatctggccatccagtactcctcaggttgccaaatgccttgtgatagtctctgttgcaatcttaggagaaaaatatgcataattaatgtatgcattccagcgttcagtgctctttcaacttcgcaggaataattcaaaaagatcattatatgtgaacaaactttagaaaaaggtaatccagcttcttcgtttacctttgagataattgagaccctgagcagtgaagtgaatttcaagcagcacacacacatgcaatgcagcagctcattcacacaaacacccctacaggaagcatgacacaggagccttctcctttaaagacgaatactcgaggatcctttgaacttttctgatcacattgaggtgaagtggctagcattcagactctcttttagacaaggacactacctccaagacagagttttgcgcaaggattttaaatccatttgtgagttatttgtgggaaatcgttctttacctttttttttgtaaaaaaaatctaaagtacttttgtttgtttaaccaaaggcagctttcatttgaatcaattcaaaataaatatcaaataaagtgttctgtgaaaataaacttctcagtgatagtaatcaggtaactcttttaaggctttttgatttttacaaaaataattttctaagattttcaaccttgtgaaaatactaaaaacctctgaaatataaacattaaatgggtaaattgtatgacatgaggattatattttgataaagctcttgtaaatatatatatatttctcataaataaatatgtatattcagtgtggttaagtgcgtaaattaacaaaataactggtatatttttaaaatcaactacatagacgttgaagaaaatgctagcattctaagcatcttggttagtattgtattctctttacctctttagaaaccaactttagtaatttgctaaattgggcctgggttctagttaagagatgggtgtggtttttgttaacaaatcttaatttactaacgggagtcaattctagaaataattgtaattattctaggaataattgtaatgatggcagcttttcttaataaaagatgaagttctggggctcacctgctatctgataggtgaaattcattctagaatttctgtttaaaactccagatttgaaaatgacaattgcagtactcatagaagaataaaacaccggcatagccaaagcatttctgccacagaactgaattcttgaatttccatgactctgaaatgaaatggaagccaagtcatgttagatttattttagaagagaacagcataacagaaattaaactgcctataaaagtatggcttaaatatttaaccatggaaactagctctgttgttggaagtgctctgcaagaagactcactttggccttggaactgatacaagtcgcaccttcccagaggggagggaggaggggaggcaaagtttctgctgaaaccacagacacttccctgctgaaaacaagacccctcccctctgatgtgacttcctagtcgaggcctgtgccattgctctgagcaccactgggctgtttgagagttcactggatttctcctcctggggcttttgccagtcctgagctccatgagactaacaaccatcattgccctgatccagcccttgctaccccttagcaaatctaatcagagcctttggttccactgtacatccccaagccagccagggcctgtaatgaggtgctggttcccctttgtaacacttgggcagccctcattacctctcaaaagcctggagtaaatgcagttgaatgcccatcagttcttgcataaaaacaagttgtaccaaagtcagggtatttgcagcctccctgtcacaagtatgtctctaatatctgcagtccttaggaacctactgaaagacccaacccacctctgcttgcaaactcctcttactgctcaggacttccactcctcctcccaaccgtctcctgctcttggtccttgtctaactttgctgtatcctgtgaactttaactgcacggtcaatcattctctatatacatcccccgcctttccactttgtagccttagcaaaacctgtttctccaccagcctcctggtagaggccactcttttcccatgctccacagtttattgagtaggaagggtggggggtcagcctaggaggaagggagggatgctccacgttcctcactgcagcttccatccttgcctcaaagctggttcacctttgagggtctctacgtctggtcaaatatattctcaccattgtcatcactctcacttacttttctcctggttacttcccagcatttatgaaagacttgaggtgtctcagctcatagtaatctcctgcccccaatttcctttctgaacccttagaggtttcagtgtttatacagacaagccattaaacaccctcactttatatttcttaacaccagtgacttccatctctgtgtctccgttcattcccaatgccaggtagctactgtacatcctctataacagccctacacatcattccttcatgatcttccaattagaccttctctgtctattcttggataccctgagaatcccagtttctcccagctcatccgtcaatgtttgtctttcctccctacctacccagtctgaaacccttgattgtttcctgtattcattcagttgaaaacattattcagtcatgacaaacactgggtcttactcacagccactccagctgctattatgttccagctggtgcctagtgttctgtaagtggcacgctgagtggtccaccatgatcctcattgtcttagcttcatgaagcagggggaaaaggcttcacccaaaggaccttgttccacttggctctaagtccttccagtaagggtaccactgggtaatagggattttgtcctgaaaaccattaccaacagaatgatgatagtctagcatcttgtccatcttgagagcttgggagctcatctcagcatctaagctttgcacaaaactgagcaagtccagggcctattcagctgccagcacctctcacacctctccacattggagtcagacaaacgggacttttctctccccagcaagaccaggtgagaagcaggggaccccagatttataatgaagaggaccctgaaaactcagaagacaacaaatgggactctactattccagcacatggggcttgaacatgacattcttggaatgaactggggagggttagttgctcccccgactgcagaaagagaatccaggtattctcaaatgttctccctggtatccatcctcagttcacggcctctccctttacatatttttccctggataatcttattcttctcattatttcaattacttatcatgataatgatgatgcacaaaaatctctgggccttaggtcaacatcccactttgtgtccaactgtctcctcaacatcttattccagaggaaattcagactcagcattttgtaaagctcaaaatggctttctttctttctttctttttttttttttgagatggagtctggctctgtcacccaggctggagtgcagtggcgcgattgggttcatgccattctcctgcctcagcctcccgagtagctgggactacaggcgcctgccaccgtgcccggctaattttttttttgtatttttagtagagacggggtttcatcgcgttagccaggatggtctcaatctcttgaccttatgatccacctgcctcggcctcccaaagtgctgggattacaggtgtgagccaccgtgcccagcctctttgtttttgtttttgttgttgttgttgttgttgttgagacaaagtcttgctctgtcgcccagtctggagtgcagtggcgcaatcttggctcactgcaacgtctgcatcccaggttcaagcgattctcctgcctcagcctcccgagtagctggggttataggcacacaccactgaacccggctaattttttgtatttttagtggagatagggtttcgccacattggccaggctggtcttgaactcctgacctcaggtcacctgcctcagcctcccaaagtgctaggattacaggcatgagccactgcgcccggcccttttctttttatctctcttatattaccatgaatatagacctctgaaactggtgccaaacagcctcttcactgattctcttgtgttctgtattgaccctttcaattcagcctatacataaatcctactaactatacatatttctccaagcatggtccatggagctctggtattggcaccaaaacaccagagatgtttgtcaaaaagtcagataaatgggtgttataactcagtctctgagggtgggccagggaggatgcacttttaagatgcttcttaatgcattcttaggcacacaaagctttgagagctctggacctacaggaccaagttcaagtttctcgacacacctgattggagggctttgtgtacagatgaataacacattaagctggaagtaacttagaaaattatttaatcatggcctcattatttcaagtgttttgcaaaagctagtgaaaagatgcgactgtcattcatcctataattgttacctgtggtgagtcctgaagctgtaagtaattctgcatgcagtcttatgagctcagctgttaacacccacacagttatcttgacctgctgatgtggaggggtgtcaatgacccaagtacagatggaaaatgggacatctgggtctgatgaattgggtgatgaaatattttgtggggtccaagttgcattgtatgttccaccacaaggcactgggaagaaaaagcaacacaggagacaatttattcatgtctcatctcaggcaatctttaaaattctgtcttcctcatctcccaccccagaggagctatattttcatcattccattaagaattgggggtttatatccttgactaaaaattgtatcaaattttgtaccacagattaaacatagagtaattaacatggtgtttagtaattgacattgagtttagatagtaattgacattgagtttagtaattaacattgaaatttcaatataataagcagggcattcttttcagtgcctaaatacatgtgtatttcataacatataaaaatgcttctatctactcactgtccatgatggtgtatgtagcattaaatccttccctttctaatgttaagtcactgatgaattgaaccataaggaagttaccagaagagataaaaggagcaggtacagtggaaccacaaaacgttccagccaagttggcactttcactaaccccatggtataactgaaaagaaaaacaattcattacttctccattatttacaaaaaagttgcatctttcacactaaattggatgtgaagtcacaataggtcatgattaaacatttttacatggatgttcttagaggtggtcttaatttaggaacagaattataattggattgatgatattatgactttcagtaaaaacctggtatgatgcctaacatttttttcctctttgggaaagtaacctatgattttaaaaagaatgtgtcatgagagtctgctcacccactgctaccttaaccactgcacccactaacactctggccctagttgctctgatctcttgccttgatgatcactggagactcccacaaagcccctgattctgctcttgttcctcttagtctattctcaaaatgtcatcgagaggatactgttaaaatgtaagtcagaccaggtcatcgctctgctgaaaccctcctaactgcccatccactcaatagaacaagcaaagccatcacaatggccttctctcctcctctcccacccctgacctttctgatctcatttcttattgtctccactttgttcattttgcttcttgagccaaaccagtcatgctcctgcttcttgggtatggcatttgctgttccctttgcctggaatgctcttccctgtatatccacatcgtttgtcttcctacatttcttcaggtctttactcagacatccccaaattggctggcgtgatggtacatgcctgtaatcccagctactcaggagactgaggcaggataatcgcttgaatctaggaggtggaggttacagtgagctgagatcgtttcactgcactccagcctgagtgatggagcaagactgtctccaaaaaaaaaaaaaaaagatagccccaactcaatacggccttccttgtgtaaactctcccaacattcccatctcctttcctgcttgacttttctccacagcaagtattaccttcttctacatactacatatttaactttttttttttttggagacaaggtctcactctgttgtccaggctggagtgcagggctacaatcatagttcactgcagccttgaacttctgggctcaagtgatcctcccacctcagcctcctaagtactgggactacaggtgcatgccactatgcatagctaataaaaaaaattttagagatgtggtcttgttatgttgcccaggctaacttgtttatttcattgtctttcccgctgaagagaatacaagttccatgaatgcacagatttctgttctgctcactgccatgttcccagtttttaggtgtctgcacatgagaggcactcaataaatatctaataaataaataaacaagtgctttgattcctctcttccacaagccctcccaaaactgttctccctgagacttctttacctcagtgtttcaagcctacaacttcagtcatctctgattcctctctcttcactccacatccactccattctaccttcaaaacatatctcagagggctccatctccaggtgaccaccattgttcttcacctgttcccactgaaacatcttcttaatagaactaattccggagcagccatagtgttctccactgaattgcctgcatgtctgcaaactccaatgagatgctgctcctgctctgactaaaatgctccggcagatccctgttgcacctaaagtaaaattccagctccttctcacggtctgcaagccccagctgctctggcctgtgcctccttcccaggccgcccgcacctcactgctggttgcacttccttcatcccaggaggactcctgcccatggccctgctcctgcagctcttcctgccaggagacttctttcctcagctgaagctgaacccgcacagctaaggactccctgtcatgggccctcacctcacatgtcacctcctcagagaagcccgtgctatcgaatgttgccctcccccagcatcatcctgttttattttcctattataatcaaaaccgatcttatttattgtttatttgctttgtccggtctctttcccaacaaggatgtaagtcccacgggtggggagacggagactctgtctgacttcttcactgtggtgtcgccagcacccagaacaattcgcagccatggcagccttctagaaacatcctttgaaatagtgggtgcttggatttctctcaaacacataactagaaaacatttgttttcttctgagtaatcttcattatatttctttttctttttcttttttttttttttttgaaacggagtctccctctttctccaggccggactgcagtggcgctatctcggctcactgcaagctccgcctcccgggttcacgccattctcctgcctcagcctcccgagagtagctgggactgcaggagcccgccaccgcgcccggctaattttttttgtatttttactagagacggggtttcaccgtgttagccaggatggtctcgatctgctgacctcgtgatccgcagtgccccttttctgtttctttttttttttcttttttctttttctttcttttttttttttttttttttttttttttttttttttttttgagacggagtttcgctcttgtcacccaggctggagtgcaatggcgtgatattggctcactgcaacctctgcctctgggattacaggcgtgagccaccgcgccccgccctattgtatttctaaatgagtatctgtgtgtatctaactccaaatattaaattcatagcagagctatgatgtgctcaaggccacagaacagccatgaccatgaccactgacattatcctaaagtgctagaattatataaggcaggaatggctaaaaccagtaatttcaaaagaaaaagaaatgcaccactagatggcactgtctttccaacttaaatatgatttcagttaattcagaatccgaagaagctcgagttttctaatcttcacccccttgtttcacggaacagcacatttgccaagttttagatcatgcactttttctggtaagcaagttaaaatttcatgataatcattgctgtctttatgatcacgtttatattagcaagcatttttttttttttgacatggagtctcgccctgttgcccaagcaacaggcgtgatgcgatggcgtgatcttgccttagctcactgcaacctccgcctcctgagttcaaatgattctctagcctcagcctcccaagggattacaggtgcccgccaccacaccaagcagctcccccaggcttgctgccaccttgcagtttgatctcagactgctgtgctagcaatcagcgagaccccgtgggcattggaccctctgagccatgtgtgggatataatctcctggtgcgccattttttaagcccatcggaaaagtgcagtattagggtgggagtgacccaattttccaggtgccatctgtcacctctttctttggctaggaaagggaactccctgaccccttgcacttcctgagtgaggcaatgtcttgcctttcttcggctcgcacatggtgcactgcacccactatcctgcgcccactgtctggcactccctagtgagatgaacccggtacctcagatggaaatgcagaaatcacccatcttctgcattgctcatgctgggagctgtagacaggagctgttcctgttcagccatcttggctgcagcccactctatgtcttttaatgggagagtttagtctatttactttcaatgtaattataagtaaggacttacttctgcaattttgttatttgtttctggttattttgtggtcttctctttcttctttccttccttcttgtcttgcttttaatgaagataattttctctggtagtagatttaacttcttgcctttcattttttgtgtatctgttttgttttttatttgagtttaccctgaggtttgcaaataatataacccattatttatgctgatcacaacttaacactaattacagaaacaaactaacaatgaagcaaaaagagaaccaatacaaatgttacactttattttgtgcccccaactttttgaggtgctcccacctcaagaacccagacaaagaagagaaaaataaattcaaagcaagcaaaaacaagaaaataatagttataagagcagaaatcaataaaattaaaaacagaaaaacaaaagagataatcaattaaaaagagctggttctttgaaaaaatcaataaatttgaaaaactctatcaagactgccaatgaaaaaagagagaagactcaaatcatcagtaccagtaatgaaacaggagacattaatagagaccctacaaacattaaaaagataataagggaatgctaaaaacactacagacataaatttgacaactttaaggagatgaaccaataccacaactcacttaatatgaaataaattatttgaataatcctataccaaataagaaaattgaattcaaaatttcaaaactcccaaaaagaaatctccatatgttttaggaaaaattgggttgtggctgagcatggtggctcatgcctgtaatcccagcactttggaaagctgaggcaggcagatcatgaggtcaggagatcaagaccatcctggcccacatggagaaaccctgtctctactaaaaatacaaaaattaggtggtgggtacctgtaatctcagctacttgggaggctgaggcaggagaatcacttgaacctagaagacagaggttgcagtgagccaagatcacaccactgcactctagcctggtgacaaagtgagactccatctcaaaaaaaaaaaaaaaaaaattagcacctattttatgaaatatcttacaaagaaatagaagagacacaaaagctttacaattcattttataaagctattattactctatttcaaaaatagacagtgatagtacaaaaagaaaactagaggccaatgtctctcataaacatagatacaaaattctcaataaaaattagcaaatagaatacagtgatatgtacaaataactatatactatgacaaagtggggtttattccaagtatgcatggctggtttaatattcagaaatcaatgtaatctaccatattaagaagctaaaaaagaaaattcacatgatcctattattggctacagaaaagcatttgtcaaatttttacttatattaaaactctcagaaaaataggaatataagggaatatcgtcaacttgctacaaaaaacccacagctaacatcatacttaagagtgaaatactgaatgatttcccctgaggatcaggaacaaggtaagaatgcccactccctactttcatccaacatagcactggaagtctagccagtgctatgagacataaaaaagaaacaaaagacacacagatcaaaaggaaaaataaaactgttactatttgcagatgacatgattgcctatttagaaaattccaatgaatttatatacacaaaaagtttacaaacatcaacaaccaatgagtgcgttcagcaaggctgcaggatacaagatcaacatacaaaaattaattatatttctgtatactaacaatgaaagtgtggacattgaaactaaaacattaccatttacaatcaccaaataaaatgaaatactccaattgaatctaaacaaacatgtacagaacatgtatgccaaaactataaaatgccaatgaaagaaatcaaagaagaaagagtggagcaagaaggccaaatagaagcctacaccattcattcctcctgcaggaacaccaaattttcacagctaactacacacataaagcaccatcacgagaaccccagatcaggtcagcaatcacaatatctggctttaacttcatattgctgaaagagacattgaagatggtagaaaagaccatcttgtattgctgatgccaccctctcccctatcccccagcagcagcacacagcacagagaatctgtgtgctttggagagggagagcacagcagttgtgaggctttgcattgaactcagtgctaccttgtcacagtggaaagcagaaccgggctgtactgagctgacatctacccacggaaggagaattttgactggtcctggccagaggggaatttcccacctcaggagttagagcttgagttccaacaagccttgctaaagtaccctggggccctaagtgaacttgaggggctgttttggccataaggtttgcaattcccaggcacatcccagtgctgaggtgggctcagagccagtggactggtggagcatgcaacttactaaacacaagctggggcagctaagggaatgtttgagccatcccttccccagctcccagtagagccatgcaatgtagagaaatctgttcacttgggaggagagcacagtgattggaggaatgaactcagtgctgctatgtcacacagagacctgtcagggttcatcacctgctgactaaagagcccctgggttcttgagttgggagcttaggttattaatgcttttccttttttaatatatgtacttaggatgtgccacacaagtgttatatttttatttcattcagttcaatttcttttttatttcctctgagacttcctccttgaccctttgactagttagaagtatgttatttagtttccaagcatttggagatgttttcctgttatctttctactattgatttctgttaatttcctgttatctttttcttaatgattgaatactggtcgtataacacattctgtatgatttcaattatttaaaatttattggaatttattttgtggcccagaatgtaattagtgtatgttatttgtagtgtagtgtgtgtggttggtgtatgtttgatgggcacatgaaaagaatgtgaattctactatcattgggtagagtgttttattttgttggataggctttattggtgattggtggtattgagttaccctgtatttttgtctagttgttctatcagttattgagagaagaatagtgaagtctaaaactgtaactgtggattaatttttttctccattcaattctaccactttgtttcaaatcttttgcagttccattgtttgggatacgcattctacacgtatagagaatatatatagaatgtgtagaatacatatattacataaatattggatcatttgttatagtcctacaggcccatgaggctctattatttccttttttttttttttttcagtatatattctttttttttttctttttttttttgagacagagttttgctctgtcacccaggctggagcgcaatggcacaatctcggctcactgcaacctctgcttcccaggctcaagcgattctcctgcctcagcctctctagcagctgagactacaggcatgcaccaccgtgcttagctaagtttttgtatttttgatagaaatgggtttttcaccatgttgcccaggctggtctggaactcctgagctcaggaaattcacccactttggcctcccaaagtgctaggattacaggcatgagccaccacacctggcctcagtatatgttctttctgttgcccaaattgagtaaattctattgttttatctatcagttaattgattttccctttgtcctctccattctgctgttgaatcattccactgttttaaaattttaatttactctatttttcagttccaaaatttttatttggttcttctttatgttttctctatcttggctgaaactttctattttttgctgagactttatttttaaaatgtatttcaagcatatttgtaattgcttattgaagcatttttgtgatggctgctttaaactctttgtcatatagttctaatatctctgtcattttaatgttagtatctattgattttctttttaaatttaagttgagatcttcctagttcctggcataacaagtggttttcagataacacctggacattgtgggttttatgttatgaggcactggccttatttaaaccttacattttatctggctttctttgacactgctctggccgagtaaaggggacatccacctcattactgccaggtgaagctctaagttcctcacttgacctttcaaccccatcttagtagcaaaatgcaatatggaactttataaacttggggaattatatgtactccatttttaaagattttcatggaggacactttcagacattttcatatgacaatatttggacacataatgaaagagtaactatgatgcttgtataataaatttctatttccaacagtgcccaattagcagccaccagggatcctagagggacattggtctctagatggctttgttctcctaataatgtctggtgtgtctggagtctgcccgttggtcctggtggatcctgactggtatcaagagacagtccaatgttaagcatatggtaagggaaattcatatcacttttatttctgctttcaatagtgtggttattcttcccagtctggagaggtcagggagtggcaaactcagtgtgcttgcatgcactttggagagatattatttatgtatgagacaccagtttaagtgaggatgttgttgtctcccaccctgccctggagtatttgcccaccaattactgtctcctgctggtgttggcagacacaggaggaggatggtggtctgggggaacctagggcctacaaagagagtgtgaaagctttttggaattccaagtgatctcactcccaggttcctgcaggatgttgggaaagtatgctctttgctttctttcccaggatttcatcaagcaaggtggccatgaagctatcactttcacttatctcagtttaggaaagctctgaattcattgatgaattatgcttagcaggcatgatgcacatgttgaacttttctccgggacaaattagggacatctgagatggaagtgtgtattttcttacacatccaatggcctggaacagcatcttggttttttggaaagcaggggctagagctctggttgctgtaaactgcttggggtgagtacatgaccttagtgtgactggaaaatctttccactcattttctgtgaacccaaacagactctgttcctcttcaatctgatctcacacactaaaaaagagtaggagtattgggctgggctaaattagacagtgagttcagagatctgagatgaacattagttgaccagagtgacaaaagctcacctaagagaagtttataaatttaaaggatgaaaaataatatttattttgcctaggtggataatagcaaggagcatgaatcagaaaataattgctgcgttgaagtcatacaacccttctttatatattgtggttgtcattccttaaatatatttgcacacataatgaaagggtagctatgatacttgtataataaatttctatttccaacagtgcccaattagcagccaccagggatcctagagggacattggtctctagatggctttgttcatctcctaatgatgtctggcgtgtctggagtctgcccgttggtcctggtggatcctgactggtgtcaagagacagtccaatgttaaacacatgaaaaataatatttattctacttaggtggacaacagcaaggagcaggaatcagaaaataattgctgtggtcaagtcatacaacccttcttttttttttttttttttttttttttgagacggagtctcactctgttgctcagttgctcaggctggagtacagtggcacagtctcacctcactgcaacttccacctcctgggttcaagtgattctcctgcctcagcctgctgagtagctgggattacaggcatgtgccaccatgcccagctaatttttgtgtttctagtagagacggggtttcaccatgttggtcaggctggtcttgaacttctgacctcgtgatctgcctgcttggcctcccaaagtgctgggattacaggcatgagccaccgtgcccagccataacccttctttttatattttggttgtcattccttaaatatatttgcacacataattaaagtgtaactatgatgcttgtgtaataaatttgtatttccaacaggcccaattagcagccaccagggatcctagagggacattggtttctaggtggctttgttctagatgaaagtgtaactagtgaactggaagggtcagaatatattcctccctggactgaccacttagcatggcatgaagggaaaaacaaattcagcaaaggtcagaatggcccagatggagtttgtctgtgactcttttagtctaactcacttcggagggctgcagttggggccacagtatttttcctatatatggtattatgattcccccaagatggaaacaaaccctaagacatgatgaagaaatactttttgtgggatgacagacttaaatgacctcaagttttttttaagttacacatttatttttgcaatattcatcttgtgactgcatgtcatgagtggtatcttctcagcaatgtgttacatgatcagatacgtaagtaaaagaagggatttttttcctgcttggcaataaactgtataggaaaatgactaatacttttaaaattacattatcctttatgaagactaatagctacatgcacagttattttgggctgcatgtaatataagtatattcatagataaaaatcataatgtttacataacaaaaattacataaaatataatgtttgaaaataaacaagtccaattgccacacggatactgttttacatgtttaataaaataaagttctccattctttaatcatgacactgtaaaatagctcactgaaaattgattgaagaaatggaaaaccaatgatgggagaagcaaggaacaggacagtagtccaggaatttatcctggagggatttcctgctgtccagcatctggggaatgtccttttcctggtgcacctgctggcatacctggcctccatcatggcaaacatgctcataatcaccatcacctgggctgaccatcacctccagacacctatgtatttcttcctcagcagtttttccttctgtgaatgctgttttatcaccacagttattcctaaacttctggtcatctttctttcaggcaggcaaataatcccctttactacttgtctcatgcagtccttttcatttttatttcttgggtcaacagttttcttccttatggctgtgatgtccttggattgatacctggccatttgcaagcctctgcattactccaccatcatgagcctgaggactagcttccacctggtcactgcctgctttgtcgtgggcttcactctcatcactggtctcatggtgaaggtttcccagttatctttctgtggaccccatgtcatccctcacttcttccgtgacctcggccctctgatccaactctcctgttctgacaccagatctactgaaacgttggcctttgtccttgtttcattcgttctttttacatccctcattataaccatcattgcatatggcaacatagtagtcacaattgtacgactcccatcagccaaggagcggcagaaagctttctccacctgctcctctcacctcattgtcctctctctggtgtatggcagctgtgtcttcatatatgtgaagccgaagcaaatggacaggctggactccaacagaaaggctgctcttgtgaacacagtggtgaccccactgctgaacccgatcatttacactctgcggaacaagcaggtccaccaggctctgagggatgctcagtccagaatgaaattgtaaaaacagaatcacaacctcccagtgaaggaatgcaccttctccttgatctaatccaatctttctcctgtttctggaatcctttataaaaaatttgcaaatatgttttttttaggttctgtttgttttttcttagaataagggctaattgtccctctccctctccctctccctctccctctccctctccctctctttccacggtctccctctccctctctttccacggtctccctctcatgccgagcggaagctggactgtgctgctgccgtctcggctcactgcaacctccctgcctgattctcctgcctcagcctgccgagtgcctgcgattgcaggcgcgcgccgccacgcctgacaggttttcgtatttttttggtggagacggggtttcgctgtgttggccgggctggtctccagctcctaaccgcgagtgatccaccagcctcggcctcccgaggtgctgggattgcagacggagtctcgttaactcagggctcaatggtgcccaggctggagtgcagtggcgtgatctcggctacaacctccacctcccagccgcctgccttggccccccaaagtgccgagattgcagcctctgcccggccgctaccccgtctgggatgtgaggagcccctctgcctggctgcccagtctggaaagtgaggagcctctctgcccggccgccatcccacctaggaagtgaggagcgcctcttcccggccaccatcccatctaggaagtgaggagcgtctctgcctggccgcccatcgtctgagatgtggggagcacctctgccccgccgccctgtctgggatgagaggagcgcctcggcccggccgagaccccgtctgggaggtgaggagcgtctctgcccagccgcccagtctgagaagtgaggagaccctccgcctggcaaccgccccatctgagaagtgaggagcccctccgcccggctgccaccccgtccggaagggaggtgggggtcagcccccgccaggccagccgccccgtccgggagggaggtggggggtcagccccccacccggccagccaccctgtccgggaggtgaggggcgcctctgcccggccgcccctactgggaagtgaggagcccctctgcccggccagccaccctgtccgggagggaggtgggggggtcagcccccggcccagccagccgccccatccgtgagggaggtcggggggtcagccccccaccaggcgagacgccccgtccgggagggaggtggggagtcagccccctgcccggccagccgccccgtccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaagggggaaaggtgggggaaagattgagaaatcagatggttgctgtgtctgtgtagaaagaagtagacatgggagacttttcattttgttctgtactaagaaaaattcttctgccttgggatcctgttgatctatgaccttatccccagccctgtgctctctgaaacatgtgctgtgtccactcagggttaaatggattaagggcggcgcaagatgtgctttgttaaacagatgcttgaaggcagcatgctcgttaacagtcatcaccactccctaatctcaagtacccagggacacacacactctgcctaggaaaaccagagacctttgttcacttgtttatctgctgaccttccctccactattgtcctatgaccctgccaaatccccctctgtgagaaacacccaagaatgatcaataaaaaaaaaaaaagaataagggctaatttatctaataattcaacctgaaagctcctatattacctttattttgagatgaaagtatcttcctgaatctttttactagttttaaataaataggattcaacaaattttagtgaagaacctcatatacatgagtctgtttgatgcatgtggaatttcaaagctgaaatgatgtagttttaagtatttacttgtggtaagtgcaaagggatgaagaacaaacttcataagtattaagagtatcaagttagttcaagggtagatataacatggtcattgtataaagttttgaaggaaacatatatacacagctgtcaggatatcaatataattacttaagatgactcagtgcaattgctttcaatgttgaatattctgtatataaatctttacactttttgttcccactatgataaaaacatataactgtctctagatgaagttgcaagtccttgttggtttcaatggtttgcaagattgatttcagtgccgacaaacctgaaaatgaagcagcacagggggagaaacattacaatttttggaacaaggaattaaatagttaatatttgtttccctactacagaaagtttaaaggaattgggagaaatataatcagagatgggaagaagtctgtgactgtgaaatctctgcaaatgaatgtataaacaagtctcttcatttgtggaatgagaggtttggttgtgtcacctcgggatgttcattttagtactaatgtgaagtggcgctattgatactgaatgtgacacagaaacatgctgtaacagaaatataatttgagaatggcagagagaagatgatgagatgttttaatggaagaacttatgctacaactgaaatttagttattcaagattttgataggaaatgaattagagacaaaaccctggagctaggatttgttttgcgtacttggttaatggcaatgatcatgttttgttttgaccacatatttctgtgattgtggtggaacaggaatcaaaagaaattaaagaatgtgtaagcagaaactcagttgtatgtaagaaagcccaattccccctgagaaagagaaagagctggagtcctttaaaaattaactgcctgttttactgtggctagtaagccttatctctcctcctttcccaggcattgtgaagaccctgtttctctagctgtacagctgcaaggtcactagacagataagccataaaacatgtttttccttggaaagtaagaaatgttgtaatgcatgtctcaattaattaaataactctctttgtttcttgcttccgtaatatatttcccctgcacaggtctccccccacctcacgaaatgcttaaaaggtaacttaactgtttgttcagggctcagtcccttggatgttaatctgactgggccggcgcacctaaataataaatatcctcctcaatcccatcggtctctctgattccttatcaatcccactagaggggggataataaaagattacgatgggaaagtttgagggacataattatgtaagaattagaaaaacacacttcattgaactagcagaacccaaatttttgttcaccctatgtgtatataaggattttcatacaactttgtgtagacttgtttctttttctcacatttgcagtgttcaaactgctaaagggactgacaaagcaataccaatgaactgagtggtcattgcattttttttgcctttaaaatttttaaacattactagtctgacatagtgaatcatatttatctactttgaaataaatggaaaatatatacaatgttttcatttactttcatctatacatataaagttacatagcttaaaaataattgcattgtttgtgattaacacaatttgtttacaatttagtatactaaagatattccacaatttttaatacacttatttgttgatacacatttgagctatttctgccttttggctattgtgaatagtactgttatgaacatgtgtgtacatttacttgtttgagtacttgttttcaagtctttaggggtatatacctcggagataaattgtgagggtaggggaacaggcagcaatagcttaatgggtatggggtttcctttggagatgatattataaaaatgttttggaactagatagaggtggtggttgtataacattttgaacgtactgcatgccgctgaattgttcacttttaaatgattaattttatatgtacatttaccttaataaaaaattccatagttctgaaagttttacatattgttgaaagttttataatgaaaaataatagtccctctttaccaacatggcagagtaacaggtatcaccctacagccctcacctcccccaaaaaaacaaatatagacttgtatccacaaatcaaaatggccctgagaggactcaggggcccatttaataatctacagcaataccatggagtgaaaagagaatattcacgcagaaaggaccactggtgagactggcatacctgagataccaggagatggctaggaacaaagaagaaaggtgagatctattggtatcagctatgtggtgggaaccaccatggctcccagtggcctgctctgcagaggacactgacattcctgccaggaacccctagattggaagatggggctgtacatacctgtctccccaaaagcagctgctgttatgccactctgggaccagagctgccatctcaaccaactctgtgtatggccctgacttctgagcctcagctgctccatgagtgcccacacttcagaccccagctctgtggctgaaccgtacctgactatgcctcagacactggttcacatcctgaaccctggagccaaggtctctctgcatgtgcccacagtttagataccagctcagctgccattgtgagctagcttatgctctgaatctgtttctgaagcaaggctgcctagactcatgcttcatacacaagagccaccactatggtgagctagcttgtaccctggtccttgggaccaagatctctctgtttgtgcctgtgcttagggcaccagctcagctgccatagagaactaggattaacctgactccagaggcactgtagctctgtgcatgtccatgttctcatccccagagccctggctgctctacaagcatctgacatggcataccattaccaatttgtccatggtggtttctgtgccctgggcactggtaccattaccacctcataccccagatgtgtatttcctccacatatgttcatgctataggattaggctttgtggttgctccacaggtaccactaatcagacaccagtgccactgctactgcaagtaggcatgcaaaccagattcaatgtcaacaggatcccctaagccccaactttcccagtgggagaaaaagagactcagaggaccttaacagtcattaccactggagaaccttttagccctcactgccactgaagacatccacagtgttggttgctttggatccttgcaatctttgtcaacaccaaactcatttgacagagctgcatggggactacattgccgcaccatcatcaatgctagaactgctgtgccccacccagagagtgcccttgaaccccatgtctctgcatagtaaagatctttcttcactgaaactagcctataaggtctggaaagggttacagacatcaaagtaaggcaacaagaaacatgggaaactaaggagaaatattaccaccaaaagaacacaataatttcctactagctgacaccaaagaaatggaaatctacatactgcctgacaaaaaattcaaagtacttgttttaatgatgctcagttaacttcaaaaaatacagagaaacaattcaattagataaggaaaacattaaataactcaaataataaatttaacagagatattgaaataataataaaacaaagaaattctggaccagaagaatgaaatgaatgaaatggagaatgcaacacagagagaacatcaacagcataattaatgaagcaaaagaaagaatctttgaatgcaaagataggttatttgaaaacattcagttagaggaaaaaaagataaaaaattggtaaaaaaaaaaaaataaacaagatttatgggacagtatcaaaggacctaatattcaaattatactaggtagagaagaaaaagagaaagcaatagggatagagagcttatttaaagaaataatagctgaaaattcccaaaatatgaggaaagatataaatatccaggcacaggaaagtcaaaagactccaatcagattcaacccaaacaagactatgtcaaaatatattgtaatcaaaccatcaaaaatttaagacaaagaaagaattctgaaagtagcaagagaaaagaagtatattatatatgaaggaatcccaataagaatagtagcaattttctcaatggaagccttacagacaaggagggagtggaatgctctatactaactgttaaaggaaaaaaaactcaaccaagaatactttacctggtaaagctgtccttcagaaatgaaggggagaaaaagctgaggtgtttccttataggaaatgttaaagggacttctttgagtagaaagtaaaaggacactaattagtaacataaaaaaatatgaacatgaaaaacttgggggtaaaagtaaaaacacagtcaaattcagaacgctgtaatactgtgatggtggtatatatcacatatgtttactatgaaggtgaaaagacaaaactattcaaataatgacagctccaataatttgttaagggatacacaatataaaaagatcaggaggttgcttccaagatggccaaataggaacagttccagtctgcagctcccagtgagatcaatgcagaagacaggtgatttctgcatttccaactgaggtacctgattcatctcattgggacttgttggacagtgggtgcagcccacagagaataagctgaagcagggcagggtgtcacctcacccaggaagtccaacgggtgggggatttctctttcctagccaagggaagccatgatggactgcacctggagaaatggtacacacctgacaaaatactgcacttttcccacagtcttagcaaccggcagaccaggagttacccgcctgtgcctggcttggcagggcaaatgcgcatggagccttgctcactgctagtgcagcagtctgagatcaacctgagatgctgcagattggcgggcagaggggagtcagccattgctgaggcttaagtacctcacagtgtaaacaaaggggccaggagaggccaggaagcatgaactgggtggggtccacctcagctcagcaaagcctactgcttctatagattccacctctgggggcagggcatagtagaacaaaaggcagcagacagcttctgcagacttaaacgtccctgtctgatggctctgaagagagcagtggttctctcagcatggcgtttgagctccaaaaacagacagactgactactcaagtgggtccctgacccccgtgtagcctgactggaaaacacctcccagtggtggccaacagacaactcaaacaggtgggtacccttctgggatgaagcttccagaggaaggatcatgcagcaatatttgctgttctgcagcctccaatcatagtacccatgcaaacagggtctggagtggacctccagcaaactccaatagacctgcagctgagaggtctgactgtcagaaggaaaactaacaaacagaaaggaataacatcaacatcaacaaaaaggacatccacaccaaaaccccatctgtaggtcaccaacatcaaagaccaaaggtagataaaaccacaaagatggggagaaactagagcagaaaagctgaaaattcccaaaaacagagtgcctcttctccccaaaaggatcacagctcctcaccagcaaggaaacaaaactggatgaagaatgagtttgatgaattgacagaaataggcttcagaaggtcagtaataagaaacttctccaagctaaaggagcatgttctaacccaatgcaaggaagctaaaaaccttaaaaaaggttagatgaatggctaaccagaataaacagtgtagagaagaccttaaatgacctgatggagctgaaaactatggcaggagaatttcatgatgcatgcacaagcttcaatagttgattccatcaagtggaagagaggacatcagtgatggaagatcaaattaataaaataaagctagaagacaagcttagagaaaaaagagtgaaaagaaatgatcaaagcctccaagaaatatgggactatgtgaaaagaccaaacatatgtttgattggtgtacctgaaagtgacggggagaatggaaccaagttagaaaacactcttcagaatattatccaggagaacttccacaacatagcaaggcaggccaacattcaaattcaggaaatacagagaactcctctaagatattcctcgagaacagcaaccccaagacatgtaattgtcagattcaccaaggttgaaatgaaggaaaaaatgttaagggcagccagagagaaaggtcgggttacccacaaagggaagcccctcagactaacagtggatctctcagcagaaaccctacaagcaggaagagagtggtgggcaatattcaacattcttaagggaaagaaatttcaacccagaatctcatatccagccaaactaagcttcgtaagtgaaggagaaataaaatcctttacagacaagcaaatgctgagagattttgtcgctaccaggcctgccttacaagagctcctgaaggaagcactaaacatggaaaggaacaaccggtaccagccactgcaaaaacatgccaaatggtaaagaccatcaatgctatgaagaaactgcatcaattaatgggcaaaatcaccagctaacatcataataacaggatcaaattcaaacataacaatactaaccataaatgtaaatgggccaaatgccccaattaaaagacacagactggcaaattggataaagagtcaagacccatcagtgtgctgtattcattagacacatctcaagtgcaaagatgcacatagtctcgaaataaagggatggggggagatctaccaagcaaatggaaagtgaaaaaaagcagggtttgcaatcttagtctctgataaaacagactttaaaccaacaaagatcaaaagagacaaagaaggccactacataatggtaaagggatcaattcaacaagaagagctaactatcctaaatatatatgcacccaatacaggagcatccagattcataaagcaagtccttagagacctacaaagagacttagactcccaaacaataataatgggagactttaacaccccactgtcaatattagacagatcaatgaaacagaaggttaacaaggatatccaggacttgaactcaactctgaaccaagcagaccgaacagaaatctacagaactctacaccctagatcaacagaatatacatttttctcagcagcacatcacacttattctaaaattgaccacataattgctagtaaaacaatcatcagcgaatgtaaaagaacagaaatcacagcaaactgtctcccagaccacagtgcaatcaaattagaactcaagattaataaactcactcagaaccacacaactacatggaaactgaacaacctgctcctgaatgactactgggtaagtaaggaaatgaaggaggaaattaaaatgttctttgaaaccaatgagaacaaggacacaatgcaccagaatctctgggacacatttaaagcactgtgtagagggaaatttatagcactaaatacccacaagagaaagtaggaaagatctaaaatcaacaccctagcatcacaattaaaagaactagagaagaaagagcaaacaacctcaaaagctagcagaaggcaagaaataactaagatcagagaagaactgaaggatacacaaaaaaaccttcaaaaaatgaacaaatccaggagctgttctttgaaaagaccaacaaagttgatagaccactagcaagactaataaagaagaaaagaaagacgaatcaaatagatgcaataaaaaatgataaaggggatatcaccacagatcccacagaaatacaaactaccattacagaatactataaacatctctatgcaaataaactagaaaatctagaagaaatggataaattcctggacacacacatcctcccaggactaaatcagagataagttgaatctcacaataaaccaataacaggttctgaaattgaggcaatcattaatagcctacaaaccaaaaaaagtctaggaccagatggattcacagctgaattctaccagaggtacaaagaggagctgctaccattacttctgaaactatttcaatcaatagaaaaagaagatatcctccctaactcattttatgaggctagtatcatcctaataccaaagcctagtagagacacaacaaaaaaagaaaattttaggccaatatgttgatgaacatcaatgcaaaaatcctcaataaaatactggcaaaccaaatccagcagcacatcaaaaagcttgttcaccatgatcaagtcagcttcatccctgggatgcaaggctggttcaacatatgcaaatcaataaacataatccatcacataaacagaacaatgacaaaaaccacatgattttctcaatagatgcagaaaagggctttgacaaaattcaacagccattcatgctaaaaactctcaataaactaggtattgatggaacatatctcaaaataataagagctatttatcacaaacccacagccaatatcatacagaatgggcaaaaactggaagcattccctttgaaaactagcacaagacaaagatgccctctctcaccactcctattcaacatagtgttggaagttctggccagggcaatcaggcaacagaaagaaataaagggtattcaactaggaaaagaggaagtcaaattgtccatttgcagatgacatgattgtatatttagaaaaccccatcatctcagcccaaaatctccttaagctgataagcaacttcagcaaagtctcaggatacaaaatcaatgtgcacaaatcacaagcattcctatacaccaataatagacaaacagagagcgaaatcatgagtgaactcccattcacatttactacaaagagaataaaatacctaggattccaacttacaagggatgtgaaggacctcttcaaggagaactacaaatcactgctcaatgaaataaaagaggacacaaacaaatggaagaacactccatgctcatgggtaggaagaatcaatatcataaaaatggccatactgcccaaggtaatttatagattcagtgctatccccatcaagctaccacagactttcttcacagaattggaaaaaaaaaaaacacttaaaagttcatatggaaccaaaaaagaacccacatagccaagacaatcctaatcaaaaagaacaaagctggaggcatcacgctacctgacttcaaactatactacaaggctacagtaaccaaaacagcatggtaccggtagaaaaacagatatatagaccaatggaacagaacagaggcctcagaaataacaccacacatctacaaccatctgatctttgacaaacctgacaaaaacaagaaatggggaaaggatttcctatttagtaaatggtgctgggaaaactggctagccatatgtagaaagctggaactcaatgctttctttacaccatatacaaaaattaactcaagatagattaaagacttaactttaagacttaacactgtaaaaaccctagaagaaaacctaggcaataccattcaggacataggcatgggcaaagacttcatgactaaaacaccaaaagcaatgggaacaaaagccaaaatagatgaatgggatctaaccaaactaaagagcttctgcacagcaaaagaaactaccatcagagtgaacaggcaacttacagaatgggagaaaatctttgcaatctactcatctgacaaagggctaatatccagaatctacagagaacttaaatttacaagaaaaaaacaaccccatcaaaaagtgggcaaagaatatgaacagacacttctcaggagaagatatttatgcagccagcagacgtatgaaaaaagtgcttatcatcactggtcatcagagaaatgcaaatcaaaaccacaatgagataccatctcaggccaattagaatggcaatcattaaaaagtgagcaaacaacagatgctggacaggatgtggagaaataggaatgcctttacaatgttggtgggtgtgtaaactagttcaaccattgtggaagacagtgtggtgattcctcaaggatctagaactagaaataccatttgacctagcaatcccattactgggtatatacccaaaggattataaatcatgcaactataaagacacatgcacatgtatgtttattgtggcactatacacaatagcaaagacttggaaccaacccaaatgccaatcaatgatagagtggataaagcaaatgtggcacatatacactatggaatagtatgcagccatagaaaaggatgagttcatgtcctttgcagggacatggatgaagctggaaactatcattctaagcatattgtcacaaggacagaaaaccaaacaccacatgtactcactcataggtgggagttgaacaatgagaacacatggacacagggcagggaaaatcacacactggggccagtcaaggggtggtgggctgggggagggatagcattaggagaaatacctaatgtaaatgacgagttgatgggtgcagcaaaccaacatggcacatgtatacctatgtaacaaacctgcacgttgtgcacatgtatcctagaacttaaagtataataaaataaataaataaataaatataaaaaagagaagcccaggacctgatggcttcacagtcgaattctaccaaacatttaaagaagaacaaataccaatcctattcaaactatttcaaaaaatatagaggaggaaggaatacttccacactcattctaccaggccagtattaccttgatatgaaaccagacaaaaatgcatcaaaaaaagagagaaaagtacagccaatatgtctgatgaatattgatgcaaaaatcctcaacaaaatactagcaaactgaattcaacagcacattaaaaagatcttttctcatgatgaagtagtatttatctcagggatacaaggatggttcaaaatatgcaaatcaattaatgtgacacatcatattaacagaatggaggacaaaaacatatgatcatgtcaattgatgctgaaaaggatttgataaaattttaacatccttcatgataaaaaccctttaaaaaactgtctatataaggaatataccttaacataataaaagccataaataacagacacccacagggtagtatcatactaaatgaggaaaaactgaaaatttgtcttctaagatgcagaccaagacaaggctgcccactgtcacaaccgttattcaacatattactgaaagtcctagctagagcaatcagacaagagaaagatataaagggcatccaaattggtgctagagcaattgtacttttataggcacactcacacacacacataaacacacacacacacatacacacatacatacacaaaaaagaacttcacctgtctcatattttatacaaaagctaactcaaaaatagtttatgttcttaaatgtacaacataaaattgtaaaacttttagaaaaaaagaaaaaacttcaagatttagggtcaggtaaagtgttcttacaaaacagcatgatacataaaaggaaaaactcataaattggacttcatcaaaatgtaaaactttttctctgtgagaattaaaagaaaagctacagactaagaggaaatatatggaaactacatttctaacaaaggactcatatctaggatatattagaattctcaaagccaaacagtaaaaataaataaatgatataattagaaaatgagaaaaaaacatgaagagacattccatgggagaagctatacagatgtcagataagcacaagaaaaggtgtgcaacatctctagccgttaagaaatgaaagttaagattacaatcagatataaaataaaaaactgtgacaatatcaactgctggtaaggatgcagagaaaatggatctctcatacattttggggtaggaatgtaaaatattacagttactccagaaacagtttggcagcttctttaaaaaccagacttgcaactaccatagactccagcaattgtcttcctatttatcccagaaaaatgaaaatatatgttccctcaaaaacttgaacacaaatgtttatagaagctttatttgtaataatgaaaaactagaaacaacccagctatccttccatgaatgaatggttattgtggtacatccatacaatagaatgacactgaacaacacaaaacagtgaactattaatacacaacttgtataagtctccagaaaattatgatgatttttaaaaatcccaaaatgttatatattgtttgactctatttatataaccttcttgaaatgataaaataatacaaatggagagcagatttgtggatgctaagggttaaggagatgatggggtgaaagaaaagtagttgtagctatagaaggacaacatgaagagtctttgtgggaatgttctgtatcttcactgtattaatgtgaatatcctggttgtgatattgtaatgcagattttcaagatgctactatttggggaaattaaatgaagggtatatgagattactctgtattatttcttacaattgcatatgaatctacaaatataaattttacctcaaaatacaattttaattttaaaaattgtagtgataactaaatatccgtaacatatttcactgcatattcctccttccttttcttttatcctgaaataaaagtaaattcattcctcatagtccacatttttaaagtctagaaatcctcctcccataatgtatcagttagcttctttggcctctgacaaaccaacacaaactataatgacataaaacaaaaaacaatgttatattacttttgtgaaaggaaaataaatcttggggccccaaaatcactaagctaaagggaaaattcaaactggaaactgcttagagccaactgcctcccactcgattcaaagtcactcctctgctcactgagataaatatctcattgcctcctttggaaaggctaatcagaaactcaaaagaatgcaaccatttttgtttcacctatctgtgacctggaagctccctccctgcttgaagtcttcctgcctttgcttcaatttatcctacctttccagactgaacaaatgtacttcttacatatattgattgatgtctcatgtctccctaaaatgtataaaaccaagctgtgtcctgactgtaagagttaaagaaagaggaacaaacatgaaaagcagctcaacagtcaaagacaggtttattttggagaataaacctgagaggggcttctggacaatctctctggctggaggggagattatctcagggctgacatgtctctggttgggaaagggtttggaatctttctggtcagagatgtcatttgtggtttatggtcatgtggaccttagccattacactgatgccctttggatttaggcggtttttgatcaaggggaactttagaatggtggtgcttgttcaagatgacaatgcggctgctctgtcagtccagaccctatagttataaaaaggcaaggggcagtgtgttctttctggctacttcctgctgatgaggggacagaattttctggtcttgaattcattgcaggagtaacaccatctgtaggtgtttttgggtagttgtctgtgaaatggccatgatcatctcagttaaaaatctttgaaaaaggttaattaggcagggtaagaacattagtcctaggcatattattaggagagggcccaggaatgggatgacccatgttatgattttgttcccaaactaagaatctatttggtcgttttggtattccttagctttttagccctttctttaagtttttcagtagcagctcttactaggcctgattggttgatatagaaacaacattccttacctgatgagagccagaggtgcatgtttggaaaggcccatatgttattttctgttagtaaccattgttcctgctatgtggataataattaagcaaaatgatacagtaattgagattttctattagatattctaccctgagggtgctacagcagagtaaggcaattcccacaagggtggcatagtaaataatgtccattaaaaagttttaatattttgcttagaaggagaggtaggaatgacaaaaagtatttggtgaggtaggggtgagactgagtaaaatgagtagttctcgctcacttattttttatgattttctgctaaagatgtcctatttctttatttccacttgtgaggatcagagggcttagaggcagtgcctactgaaacatctagctttgagtttatagggctttaagaaagcacagtttaggccaggcacggtggctcacacctgtaatcccagcactttgggaagccgagatgggcagatcacaaggtcaggagatcgagaccatcctgactaacagggcaaaaccccatctctactgaaaatacaaaaaattagccaggcgtgatggcatgtgcctgtagtcccagctacttgggaggctgaggcaggagaatctcttgagcccgggaggtggaggttgcagtgagccgaagtctcaccactgcactccagcctgggcaacagagcaagactctgtctcaaaaaaaaaggcacaccttattttggaaacttgtagcgagaaaaatcagaatttaaactgtataaaataataaaaattgaaaaatattaggcaaattagaatttaacaagaagtgtgctatagtttttgaaacataattttctctctccagtttcccatttttattaaaagacaagtcatggtaagactgatttactttattatacttggcttaattatttgcatacagcacagcaagaataattatttgttacataggccttttaaattggctttgatggaactttgttccatagaaggaatctgagataagaactttttaaagccaagcccagccatggatttgtactatcaaatacctatgagttgggtgaatttctctcctcttgaggatccaagataacttggggttcccagcctgtgagaaagtgacattctttacttaccacaggtcagaaaccctgtacagggattgtgtacacaaaccatgaggccagttttccaagggttttattggctccataagtcaagtttgattccttaaaggaaagtacaccattccagtcaaagccttggtaaaataaccagtttttccaattgtgttctgttacaaaaaaaaaaaaaaaatcttattgcacttatgcaaataactatatttccataacttaagaatactcacagatagtttccaaattctggagaaaatcaggtagagagaaacaagtatgctccaaattttgtttatgggagtatactaaattgctaaaagctgtcaataccagcaatcccattactgggtatataccgaaaggattataaatcatgctgctataaagacacatgcacacgtatgtttattgcggcactattcacaataacaaagacttggaaccaacccaaatgtccaacaatgatagactggattaaggaaatgtggcacatatacaccatggaatactacacagccataaaaaattatgagtttatgtcctttgtagggacatggatgatgctggaaaccatcattctcagcaaactatcacaaggacaaaaaaccaaacactacatgttctcactcataggtgggaattgaacaatgagaacacatggacacaggaagtggaacatcacacaccgggacctgttgtggggtggggggaggggagaggagatatacatttggagatatacctaatgttaaatgacaagttactgggtgcagcacaccaacatggcacatgtatacatatgtaactaacctgcacattgtgcacatgtaccctaaaacttaaagtataataataaaaaagtgaacaaatatatagtaacaatctgaactaacagaaaaaataatacttattaaaaattcttccaaaaaaaagctgtcaatagctcaaaagaaaagtttctttgactttgaaaagcaaaacaaaggattagcactattttaagcaaaacatcaaaaagatcactccagtctcttattagttcagttcatgcagttaattcctgtcctgcttgatattaatgaacattttagctcttcaagagtcctgaacatttttcctctattttgatgtcacaatctccaaagttatcagaaacctgcatttaaaaacacctgttagagctttatagctgattataaaaccaccttctaaagaggaccaaaacaagacaacaattgtttattgatggccaaaagttttagagtagccgtagttaaagatgcagttgacaggcaatctgctacctctgtggcacacaataattttaacataacaattataatcactactaataatgtacactaagatatatcaaattataggagtctcccataactttggaacacacaccttatatgtgtccatataagtccatataactttggaacaacatatttatacaaatatagcccaaagaaagccaaaccctattttctatttgacaatgctttctgtatgattttataccaaataagccaaattttacctttatattagtgtgctattaatgttaaatgcaatttttagtaaaactttgtagacacatttacccaattttaacacttgaccataggtaagatttttatacaccctttttaactatctacagtttctgttaaaagcaggtagtgctgtaagaaaaacctgttgtgcttttattttagtgtttgatttacagaaaaactggatgataccctttcaactttagccaatatatttacacacagaatttcctttacaattaatcttttgaaacttgcttaaaccttcatttttattttattcaatttaaaacaattcttttaccttttaatccagttaaaaatcccacattcttatgcctccttataatctttttaccaaaagtatatttagattatttttaatagtcttaaatacatgttacactgttaacttttagcaacctttacttttgttggtaagtttgggattttaattccatactaggggtagagcctaggacctagacagatgtgcaaataaggtctgatttattccagcatttaactccatgtgtcctaggtcttacctagctgcaaagccagcaagttgtacagctaagagttatactggcattttataaagcattcaagaggcctaattacttttaaattgtacaacatttcttgcataaattcccttttataaaatttttcacaactttcacagataatctctgacatgcctcaactttctgacttgttgtaaacatccctccttttaaacaaccagttaatttactttaggacaagaatttatcacataagattttttatataaattctattttctttagtatcaaagatgataacagtcctttcccaaaacaaacttccttcatgtctgtgaactagactgcctaaggccacaagattagaagttaaggtatttcactaaatagttcaagatgtagctatcttcttaaaaaaatttatgtttcattcatttaaaaattacacaagcaaagattattctgtttgggttgagttatagttctgtagcctctatgccaaattttgagtttgtgggcaaactcgtatctgcaccttccaccagaaggtatgctgagggcaatccctccctggcaccatgctccttgaggttatctgctggaacatctggagcctgctgttctaagaaagcagtcatacaggcctgcactaaatcaagcagctgaccaacaaccactcccttcttcctatctcctttattcaataaatgcaaagggctctagaagctcagggcccttgttcactagaagcaaggagcccccgaccccttcttccaaacatactgttttgtctttgtctttgttcccacattcgtcctcctttgttcagtccaccagggtgtgcggcaaagtggcatcacgaacagggacttcaaggatgtgaacaaagaaggtctgctggagcacaggaagtaaaattgaccagaccagtggggaccccgggatgaatttgctggcagggaatataaagtcagtactctaaagaagtactgggaatgagaactttctgaatcagggtaacatggagcagaatttgtctgttgaagaaaagcattatgtgcagttgcttaaagttctgttgaaacagtctggagctcaagttaattcacagacattaactaagcttccacaggaggtttttacgcataacccatggtttctgcaggcagacagtctctatgtaggaaattgggacagagtaggagagggattgaaacaggctcatcaaaaaggtttcaaagtagacccttctgttttatctgcttggggtttagttcacatggtcctactgccattgtctccttcttattctgtcagacagcaggagtcaggttctgagtctcaagaattaaaaaaatcatttgttcctctgacagtgcctattgaaaataatgagcaggaggaaggggaggagaattggctgcttgctaagcaggaaaaatgataggagaattggcctctgccactccctccaataacagaagtagaaactctcatacaaaaaattttgcacactgctgctatggctggggaacctttagacccttgcacttttcctattactataagacctgatccgaatgatccacaacatcttttacatgaacacactcctgtagaatttaaattactaaaaaaattaaacgctagtgtggttaataatggagtgcaaagcccatttactatagggctgttagaattggtgtttggagccatgcacctcccaccctttgatataagacatttggctcacacttgcttgtccgccagtgcatatctgacaaggagtttaaattggcaagaaatgagtgcagaccaggcaaggcagaattgtgacgctggtcaaggaaacattacagaggaaatgctgataggcagtggccccttttcagatctggtacaacaattaacactcccagaggctgcttatcaccagtctgccttagccaccaagcatgcttagagcacaattcctgaagaaggagttccagtgctgtcttttctacatgtcaggcagggatcatggggaccttatgcacaatttattgcacagctgcaagacacagtatggcatcagctccctcatgcctctgctaaagaaatacttaccataactctagcctataaaaatgcaaatgcagattgcaagcatgcaatggctcctgtgagagccacaaagagcttggggaattaccttaaatcctatcaggatataggaactgaatttcattgttctacgatattagctcaaggaatggctagtttagtacttgacaaatcttaaaggagccaagggtcaaaccctaaagtgggaaaatgttataaatgtggaaaaactggacactttaaaaaggaatcaattattcagagaagtaaagcgagcttttgttaaatggaatctcaaaattactccagagaaagtgcaaataacttcccgacaccattacttaggaactattgttacagagaagagtgcagatctcagaacagaaaggaccttacaatgtgaagcccccctccgaccctgcccccagtggaaaaaatgtcaggactctgtccttgctgtaacaaaggaaatcattgggctaatcaatgccactcaaaacttcatcagaatggcacccctgtgtcgggaaacgagaaggaggcctggacccaggcccttcaaatgaggcattcccagttcagaccagaaccccacttcaggggtgggtcccaggaggaacattgattccctctccccaggaacaccaggatgcacaggattagatctccccaccagagaaagaagtacactagttggaggagacaaatctaccaaaattcccactggcatttggggacctttaccagcaggatacatgagactaattttaggcaaaagccaaccttaacttgcaagacatcatggtagtccccagagtaactgactccgattatgaaggagaaattcaagtagttttaatgtcacaagacctttagatttttgaaccaggggaatatatagtgtaattattgcttatcccctgcaaattacacccttctccatgaaaggagaaaagaggatacaaatggtttgggagcacaactacatgagaaatctatctatcacaacccatagcctctaccagacccacctgtgtagtacaaattaaaggaaggaaattctatgggcttgtggacacaggagctgatgtgtcagtaatatccggtaaggatttgtccccatccgggcccctcagactaactccacatccctagtgagagtaggagcagctcaaagtgttcaacagagtgctgagattttaccttgtcttggtccagatggacaatcatgtactttccagccttatgttgcaaatatagctttcaatttatggactccagaattacttacagcatgggatatgagacttacaaatgaaaactttgataacacaggatttaaaatgttgaaggacatgggatatcagagtgggaaaggtttaggaaaattccaacaaggaaaccctaacccgatatcaataactggaaagacagaaaggactgggacatcaggatttatgattgggttcattgatacatctcctccacccattgccttacctttagaatggctcagtgacaaacctgtgtgggtggatcagtggcccctaacacagcagaagctaggtcaacttcatctgttggtgaaaaaacaattggatgcaggacatatagagaagtcagttagtccctggaattaaccaatctttgttatcccaaaaaagtccagatgatggtgactgctgcgtgatttgagagctattaatgcacacattaagttgatgggtgcattacagcagggcttggcatccccagcagcaattcctagagactggcctcttgtagcaatggatcttaaagattgtttcttttctataccattacatgaggaggataagcctcgattcgccttctctgtgccttctattaatcaaacagaacctgtttctcgctatcagtggagagttttacctcaaggcaagcttaacagtcctgcattatgtcagcattttgtgggaagagcattaaaagagtctcaaaatatgtttccctctgcatatactgttcattacatggatgatattcttttggccactcctacagatcaaatattgtatcaattattcatagaagtaaagcaagcttttgttaaatggaatctcaaaattgctccagagaaagtgtgaacaacttccccataccattacttaggaactattgttacagagaaaagtgtatggcctcagacagtagttctctgtaaagacaggttacagactttaaatgatttccaacagttattaggggacattaattggctatgcccaatgctagctattgctacttataaacttgcacatctttatcaaaccctgcaaggagattcttctttaaattccctgtggcagcttatgaaagaggcagaagctgagttacaacttgtagaacagatgcttcagcagagacaggaatccggctacagccacaaaaacttttgcttttgtttattcttcctacaccccattctccaacaggactcctgggccaatgtttagacaaatctgtaacagtgatagaaaggctctttttacctaatcaaacagtaaaaactttgcaagtctatctttccttaattacacaaattgtgactttgggcaggcatatttcaaaaatgcttacaggatataaccttgataaaattattgttccgttagactcccagcaacaggctgcagcatgggaaatgttgactgcatggcaaattgctttcactgattttgtaggtgcaatagataatcattatccctcagacaaaattttgcagttttataaagtccattctttcattcttcatgtgattactcatcacaagcctattccaggtggccagacctattttactgacagcttttccaaaggttgcacagctatttatggacctaaacatactcagaaaataaggacctctggggtttcagctcaactcttagagttaattgcagtcattctagttttagagctcacagcttcaactcctattaatattgtctgtgattcagcttatgttgtaaatgttgccagtccatagaaactgctacaattaaaagtacactagagccagaactgcttaacttgtttctaagacttcaagctctttgatcttgtatagctcctttttatatttctcatatccattttcacactcaattccctgaaccattatctttaggcagacaaacttatcggttctgtatttcaacaagctcaagcttctaatgcattactgcatcaaaacacctctgcccttactcgtatgtttcatctgccttgcagccagtcttgagctattgtacaagcctatccctcttgtcagcgtgtccctggtgttgcacctgtagaaggctgtaacccacgaggtttgctccaaatgaaatctggcaaaatggatgttacacatatagcagactttggcaagcttagctatgttcatgtgaccatagacacttattctcatatgctgcatgctacatgccaaacaggtgagacagctggtcatgtacagtgacattgtctgttgttattggctcatatgggggtccctaaacaattaaagactgacaatggtcctgcttatactagtcatgctttcaaaatttcctacagctttgggctattactcacaaaacaggagttccttacaaccctagaggacaaggaattatacagcaggcacatcaaacattacaatgaacgttgaaaaaacagaaagggggaataggccacctcaaacaaaactacatttagcccaatttactttaaattgtttgacttctggtatggatggtaagactccagcagaaagacattggcaagtgttagaggaaaaaaggaaagtttgtctgaaagtgttgtggaaatccctggaagaaggaaaatggaaaggtccagtggatttattaatgtggggatgaggatatgcttgtgtttttacaggagatggacaaaccatgtgggtgccctcaaggtgcatgcgaccatggaacaggagactggagggacccatggtgaccaaccatgggcctggtccctccagtacaggccatgagccagctgagcctgagtgcaaagactgagagaaggccagctggagtcatgacgacatcaagccccataacctgggggcaactcaagaaaaccatgcaggaaggtgagacactcctggattgtcacgatgaggcaaaaacccctgattccatgttcttggccatattagccataatgccctgtgtggtatattttccctgttcagaggcaaaaacattgggcatatgtccctaatcccctagtagtatgacctgtattttggagtgacactcctcctgagttctatcatgatcagggagcatgggatccaggacccctaactccccctgacatagaacagttagactctcagaacaatgtcatcaattataccaccccactggaaggactccccttgtgtatcactacaaagatgtcactcaaccatagttgtcttacaattcaagctcaagcatggttgagtcggcatggaaaagtcaggtacttattaggtcttagttctattaatgtaactagtgtgctaacctggcccactggctagaaaacaatctatgttaactggagacattgtggattagagacctaaagttcaactagatggaaaagaggaaaatctgacatcatggcacaaactttgttggcattggtggcaggcttttaatgcttcttctttatgccacacggggatccaatcccaatctgccacccagattgcttggcatggagctggctttagcctgcctcttcctcagtaacaatatctagggaggaaaggtccaattcaagaaacaatatggaacgctgcactcctgttcacaaatggtagtatctgggtaggggtactctctaatactaatactgctactcgacatagttttgatgttacatttgtaaagagtatcacctctcaatttacggtttgtgtttttaatccttatgtctttttggcagccaggaaggaccagctcaggtaaatgatatccaattcacccataaaccttgtcagttatatcattgcattaatcatagcatattgcaaacacataatatctctactttgataattttgggtcacatccctgggctatggattcccattaatctctctgagccttgggccaccacccctgctttgcactttgtgaaacttcttttaactcaacttactcatggtgcccatagagccttaggcacgataatttttgctattgtttccttggtcacactaataacttctgttgtaatgtcctctgtagctttgcatagttctgttcaaacaactcagtatgtggagaactggatgcatacagccaaccaagcatggctacttcagaatgaaattaacactgagttacaaattgaagtggcaatgttgaaatccacagttctatcattaggggaacaagtagaaagcttacaattgcaacagcaattgtgctgtcatttaaatcacactcatatttgtgtaaccaacttagaatacaaccaaagtgagtatccatgagaccttgtgaaagctcttttgcagggagctttcacatccaacatcacctttgatattggtgaattacaaaacaaaattcttgatttaaataagcaaactcaagagtttcagccttctttagaagcctggaccaaatttcagcaaggtctggagagcctcaatcctcgggcctatctaaagcaccacattaacatctcatatatagttctgggaataatgctgttatgtctcttgttttctgttcacagtctgtaaaattagatggtccacaagttggaaaatgagagctgtccagcctggtgttacattcattcaattaatgcaaaaacagaaagggagagatgttgggagccaagagcctgagggtcatgaccaactcagcattccactggaggctatatgatcaaacagcaaactgtttatcatgaatgcaggatgtgggcaaactcacatctgcacctgctgccagaaggtatgctgagggcaatcactccctggtgctgtgctcctgggtgccatgccccttaaagttatctactggaacatctagagcctactgttctaagaaggcagtcatgcaggcctgcactaaatcaagcagctgaccaacaactgccccctgctccatatctcttttactcaataaatatgaagggctctagaagcccagggcacttattcactagaagcaaggagccccctgaccccttcatccaaacatactcttttgtctttgtctttattcctgcattcatcctcctttgttcagtccaccagggtctgcagcacctgagggctttgagggctcactgcagggtagccccagcctgagccttgaagtccccttcagattaattgtcctccccacacaaattgctcaaaaattgctcaaaaaaaggagacaagatggggtgggtgcagtgggatgagcagctgctgtccactgcttcctgggttgcaacacagcctctacccccaacacccatcccaggtttcagcaccaaatgtaagagttaaagaaagaggaaagaaacacaaaaagtggctcaacagtcaaagacaggtttattttggagaataaacctgagagggccttctgaccgatttcagtcaggaacactctctcttacagactaagagtatttattggttttagggtgaggagaagtctattgtgggattggaatatctctggttggagaggaggttatctcagggctgacatctctccagccagaggggaggttatctcagggctggcatgtctctggtctgggaggagtttaccttatggttggaatgtttctggtcagagatgtcatttgtggtttatggtcatgctgaccttagccattaggctgatgctttttggatttaggcagtttttaatcaaggtgaactttaaaatggtggtgcttgtccaagatggtgatgctcctgctctgttatccatcacaactgtttcagtactgactgagtggttaagttaaatataaaaagctaaaaaagccagtgcccttatacaaaggctggaatgtagcaaaagtccatcaagagttttgcctaggcctttcctgggccttaaagcatgataaagtaacaaagaaattcttagcaggacccccttaggattaaacaagttttattaggggtctgaagaaactccacaggcttccacaatcaagtttattggaggtctgaagtaacttcccaaacccccgtgatttagcaagagacaagataagggtaatcacccgagcacctagacccatttagattaagtaaacttaatgaggctgtagaagaaggtcttcaggatgaccttcagccatgaaaagaacatgccacaggtagcctcagatctaagcatgaaaagacacatggaacacttacatgtagacatatagcttggaaggtatatagctctgaaaaactttgtaattttgagttggtctggtgaaaatttctgggccttctccctgtaactggttgcaaaaaataaaactctcttcctcccgagttcatctgcatctcattattggcagcaggaaatagcagcccaaccctcagtttggtccaggaacactcctgccttagcgtcccgagtagctgggattaaaggcatgtgcccagctcactgctacactcccactagtgccatgacagtttacaatgtagggatgtaaactgtcatggcactagtgggagtgtagcagtgaggacaaccagaggtcactatcatcgccatcttggttttggtgggatttagccagcttctttactgcaagttttattagcaagctcattatgagctgtatctttgtgctagcctcctatcttatcctgtgtcttagaatgcctaattatctgggaatgcagcctataggttttagccttattttacccagctgctactcaagatggagttgctctggttcaaatgcttctaacaaactcaagcatttttttatgctgaattcaattcttaaagcagagcttaactctttcaaccaactgcctgtcagagaatctttgaatccacttatgaccatgaatctccaccctctttgcttcaagatgtctcacctttctgggccaaaccaacatataccttatgtatattgatttatgtctttgcctgtaacttctctctccctaaaatgtataaaaccaagctgtaacccaactactttaggcacatgtttttaggacttcctgaggctgtgcatgggtcaaggtctttaatcttggccaaataaacctctaaattgattgagtcctatctcagatactttttggtttacaagggttattgtggcagattagactattgctcccaattctttgctccttccctgtaacaattacacagccatgatacaagtacaggtttaaataggtttgcttggtttggtttgtctctcccactacatccatcagccatgaaaagaacatgccacaggtagccacagatcccagcatgaaaagacacatggaacatacgtgaagccaaccttcaatgagagcctcaccaatccaatcccagtggaacctagtggagcccagccaatccaccaacttgtgaatgagaaaaagatatgtttgtctttgcaaactgctgagtacagcttgaggataagctttactcacctccaagtacagggggtaagcacacagcattatcacaaaaaaaaattactgaaaaccatgataattgtggggctttaactccactaaatgcaaaagaggatacaagcatttggatttaacttagcaattttttcctctgtttgtgggtaaaggtttaacaaaaccctgcctttctgcaagaggtactgaccttctatttactttctagcttgattcctctggaaatctgataactatggaaagccttgtgttactaggtagcaatgcttaggtaaaagagacccctgagtggctgattgcttgtggatgtgacaccagataagtcataatttgagacttctcttccactagaagccacctacattagtttcctagaactgtcattaaaaattataacactggtgacttaaaacaatagaaatttattctgccatagttctggatattagaagtgtaaaatccaggcgtgagcagggccatgctctctctgaaggctctagggaactgtcctctcttgcctcttctggctagtggtggtttctggcaatccttgttgtttcatggcttatgaaggcatcgctccaatctcttcctctgtcttcacatggatttctgctttgtgtgtctctatgtctggccagtttgtggtgcatatgtttgaattgcatcagtgggaaattgagttgagtgggaacttaagtcacttagataaaccaaaatctatttacatatcggtaaaaatcaactcaaatggtatgcttttctcatgagaggccgcatgttcaaatgtaagaaaaagatgcaattacaaattggcctgattttatttcacttcttgggttgtgttaggatataatgtatcctcatgggaaaaagaaattacagacttaatttgcatagtagactgatttacacacacacacacacacacacacacacacgaagggagagagatgtcatcagttctgagagtattatttgttcatctacatttgagaggtccaagagtctccaccatgtaaaagccccaagagatcatcagtaagagactgggctctattgacatcaagagaaattaatatgattaattaatgaggccccttttgttgctgagaaattgtaggtataagcatttttaattgtttttagggatatgaggtttttcaattgagtaagtgaagaaaataggtagaatatatccctcccaatacccattggataaaactgttggtgatggtcgtttttccaccattttagtccagattgaccgctcttgatttctttcaactgggtgtatgagccacactcactcttgccagacactcttgccaggagcctataatactctctccctccccacttcaacactaagttatcctgtctgtcttccacttatccttaggagcacagcctaaatgacacttgtcacaggaggcctactttaacccccacaagcaggggcatttcccttgttatggggattttattgttgttgtttactaaattgtcttcaaaactaagagctcaggcaatgtttaccaatcttgctcactgctgtatcctcagaaagtattacagggcttgatgagggcagaataaggatttattataagaggaaggaaataatgaaagtctacaatgacatagttagaactgagattattatgtgattgatcttcaccaaacaacccaaccagcaggaaaagaatattttcaggagtaaatctaggctttatgacatatattgatccaattagtagcctcttgctctcacttggtttatgcatactgtattgtaatcttgagttctctaaaaggtaaagttaaccttgagcaatatgaaaactatagttctcatcctttgaccacatgactgaccaaggcaactgtcatggtgactggaccccaaggtccagccaagggcgctgctctgcacacccaccatagcaactccatgatatacaggaagggttggaaatgagtgaatgtcatagggaggatgtctggatgggagtatgaaggagaatgtaaagcaatggttaggcttccagacaccaaaataatcacatttatgtctaaaggagagataaaatctgcaccccctgcatccccagtggtagtgttacaggaaaggggttccaatccagaccccaagaaagggttcttggatcttgcacaagaaagaattcagggcaagtccacagagtaaagtgaaagcaagtttattaggaaagtaaaggaataagagaaaggctactccatagacagagcagccctgagggctgctggttgtccatttttatggttatttcttgtttatatgctaaacaatgggtagattattcatgcctcccatttttagaccatatagggtaacttcctgatgtttccatcacatttgtaaactgtcatggtgctgctgggagtatagcagtgaggaagaccagaggccattctcatcaccattttggtttccatgggtttcagctggctcctttactactacctgttttatcagcaaggtctttatgacctatattttatgctgacctcctttctcaacctgtgacttagaatgccttaaccatctgggaatgcagcccagtaggtttcagcctcatttttcccagctcctatttaagatggagttgctctggttcacatgcctctgacagtaggtgcctcaggaaagcaaggacattcatcttgggatgagagaatagggttacaaacaccattctgaaaccaagaatcaggtcaggagagaaagcaatctagagcattcaaagagattcctctctagcccagccccatgatgagaagcatgttgacttctttgaagaggttccaggaaatctggaagaggaagtctaaaagaacttttaacttttataggagataccatccaagggcatgagaagtgttaacaaactcaggatgagctctcctcactcctgggactgaatgagctcagccctttatgggcacagattcagcccattgttgtgttcaaagcagaaatagctggagcaggacctggatctgtcagagcctgaagaactcacaccagagaccacagggagcagcacaggagcatggagcctacaggccccagaagggaggcctgcatcagttggcatctgggtgagaaaacagaaaccacactaccaatttaacagagaggacctaatatagggaactggccagagacatttgggaggactgcagagcacaagagaaactgccgtgctgcaaaaacagcaaccacagaaagcagctttatatcctgggactggaggagcaaagagagtttgaggccatggtcagtgagaaagccagtgaagggactgcactgagctggaccagagaccctgaggagagtggctttcctgggtggccttggtcttcctgtggcataaagagatcccacagggcttcagcctgaggatgcatgctactcagtgcatgctgcttcctcagcagctcggaggagagccaccctcgacagggattgaaaccccagagtaggcaacactggtgactatgtgccagcatctctgaggggccaaatgaggctgctcctgcaagtgtaaaagctgagagcagctgctgtccttggaccaaatcactgctgcaaagctaaggaatcatcctcaggatgatgctgacagaagctggaagcaaatgggacagagcaggtccctgctctctcccagccttccaggatccctctagggcccactctgggcagagactaacagaaatccagctgcaaaggaaaaataaggtttgcagcatcccaggctcagagttgcagagatgggtttggaactgaaagacaataggttaagagtgagcacagttgctgcccaaggaactcaggaccctcaggtctggaccggctcaggcagctacctgagcacagagggaagcaggaggatgtggtttgttctctgacatgcagacccacataacggtcctggtgggcagccaaagtagcatcccagggaagctgagtggaggttggatcatcatttgggctctgaatttttccacttatgatatagctaacataggtgacaattccatcttagaaatcacacatttgcagtgctatctaatcacaactgttgattctaattcagaaaaatgaagcattctgatgggcctaatactcctgatttttctattatatgctgaggacaactgtttaagagggaaaagacagcatataggagcatacaaatgcagatcaattcagcataaaactaccaacaagttccgactcagatgtatggtctgccaaagacatgaggctcactcaccctaaaacaggacaaaagcaagaccccatcacaagttggctctcgaatgtgacatggagcaagcataaggagatgttgtcttcaagaccccagtccccttccttatgccgtgtttgtatagagagtgccaggggctctgtctatctgggctgctgagatgccaggatgcagctgtggtgcctgtcttatgggtagagctctcattcaaagagggaactgggctcacctaagttggtggtgaaggatgaaatcctaaccctgcctctgggctatgtcccctcccaaatggggtgtgccaaatgccattcttgcttgcctttgataaaaataactcctcctccaccagcatcattttccaagagaaagagggtccttagattaaatttaaaagttcagtcaggaagactaaaaatataagggcttgtggttggaaaattactgaaagaaagaacgcattttccttgactaatatacattatgaaagacaaaaagcagagaaatgggtaaaatggaaattctgtcacttctccatggctcttgaagccatgatactgtgaagtcatagccactcattgaaggtactgcctgcaggatgcctatggggtcataacattgtcttgtttaatcacaggactaatattaagtgatagcataatggggaagcaagagctgcttcccagtctcagctaaaggaggcaaactggctccagttcctgcaaaagcatccaagaaaagaacaaaatcctagttgttaggtcggttggagaaaaaggatgcatttgttcctgagaaggcaaaccaccaagcaagatagcatcctagcaaggagagatgctctgcctgcaccaagacagctacagagtgaaggacctgctgcttatgtagggctcaaaggacaagataagccaagaccaaggtagggggctcaactgaactaggaagagcaagagatccaaagactgaaatggacctgtttaagtttggaggacaggaaaaaaaaaggtgttgaccctgaatgaaggtgggttttgggatcagggagataaatcagatctgaggaaaggatgatggtccagctctgtcaggtaattctcccaatttgcctttcttgggtagaagtggtgtcattcatcagcctgaacattcctaagaaacaaggttcacttttgtattggagaccactgaaatggtttctcttttacccacccgaattgcttcacctcaatgagtcatttttatacagccaagaccacagctgctcacagcccttacctgtgtggtcccacaccacccagccccacttacacttcccagccagccacggcaaccatcactccaagccaggcagaggtgaggggctgtgacatccaggcttcctcagtgatcacacaccaacagtgagatcttaaacttatataacacttgatatcattttcttcacttctgttgatcaatcttggcaccatctctagtttgatttattgccctcgttatagttagaaggaaatggaggctccaatgggttgagtgtctgagtctgcacttgaacccagatcttccccctctcagttcagggctctttccacactcacacttcttctctaagcatctacaacaccatcaccccacacatgaaatgcaacactcattttttttttttaagttctgggatacatatgtggaacgtgcaggtgtgttacataggtatacatgtgccacggtggtttgctgcacctatcaacccatcatctaggttttaagccccacatgcattaggtatttgtcctaatgctctccctccccttgcccaccaccctccgacagcccctagtgtgtcatgttcccctccctgtgtccacgtgttctcattgttcaactcccccttatgagaaagaacatgcagtgtttggttttctgttcctgtgttagtttgctgagaatgatcgtttccagtttcattcatgtcccttcaaaggaaatgaactcattctttttatggctgcataatactccatggtgtataagtgccacttttgctttatccagtctatcaatgaagggcatttggattggttccaagtctttgctattgtaaatagtgctgcagtaaacgtgcgtgtgcatgtgtctttatagtagaatgatttataatcctttgggtatatatgcagtaatgggattgctgggtcaaatggtatttctggttctagatcctagaggaatcaccacactgcatgccacaatgagtgaactactttacactccctccaacagtgtgaaagtgttcctatttctccacatctttgccagcatctgttgtttcctgattttttaatgatcaccattctaactggcatgagatggtatctaattatggttttgatttgcatttttctaatgaccagtgatgatgagctttttttcatatgtttgttggccacatagatgtctccttttgagacatgtctgttcatatccttcacccactttttgatgggttctttttttcttgtaaatttgtttaagttccttgtagattctggatattagacctttgtcatatggatagattgcaaaaatcttcccccattctgtaggttgcctgttcattctgatgatagtttattttgttgtgcagaagttctttagtttaattagatcccatttgtcaattttagcttttgttgccattgcttttggtattttagtcgtgaagtctttgcccatgcctatgtcctgaatggtattgcctaggttttcttctatggtttttatggttttaggttttatgtttaagtctttaatctatatttagttaatttttgtataaggtacaaggaaggggtccagtttctgttttctgcatatggctagccagctttcccagcactatttattaactagggaatcctttccccattgcttgtttttctcaggtttgtcaaagattcgatggttgtagatgtgttgtgtaatttctttttctttttcttttcttttcttttttttttttttttgagacagagtctcgctctgtcacccaggctggaatgcagtggtgtgatcttggctcactgcaacctctacctcataggcacaagcaattctcctgcctcagcctcccgagtagctgggactacaggtgcccaccaccatgcctcgctaactttttgtatttttgttagagaattggtttcacaatattggcaaggctggtctcaaactcctgactttgtgatctgcctgcctcagtctcccaaagcactgggattacaggcatgagccaccacacctggccacatgtggttttatttctgaggcctctgttctattccattggtctatatatctgttttgttaccaataccatgctgttttgtttactgtagccttgtagtatagtttgaagtcaggcaacattatgcctccagctttgttcttttggcttaggattttcttggctatatgggctcttttttggttccatatgaaatttaaagtagttttatccaattctgtgaagaaagtcaatcatagcttgatgggaatagcttgaatctataaataaccttgggcaatatggccattttcatgaaattgattcttcctagccatgtgcatgggatatttgtttgtgtcctctcttatttccttgagcagtgatttgtagttctccttgaagaggtccttcacatcccttgtaagttgcattcctaggtattttattctctttgtagcaattttgaatgggagttcactcatgatttggctctctgcttgtctattattagtgtataggaatgcttgtgatttgtgcacattgattttgtatctgagactttgcttatcagcttaaggagattttgggctgagatgatggggttttctaaatatacagtcatgtcatctgcaaacagagacaatttgacttcctcttttcctaactgaataccctttatttctttctgttgcctgattgccctggccagaacttccaacactatgtagaataggagtggtgagagaggacatccttgtcttgtgccagttttcaaagggcatgcttccagtttttgcccattcagtatgatattggctgtgggtttgtgataaattgctcttaatattttgagatatgttccatcaatacctagtttattgagaggctttagcatgaagcggtgtcaaattttatcaaaggccttttctgcatctattgagataatcatgtggttgttgtcattggttctgtttatgtgatggattatattcattgatttgcgtgtgttaaaccagccttgcatcccagggatgatgctgacttgatcctggtggataagctttttgatgtgctgctggattcggtttgccagtattttactgagaatttttgcatcaatgttcatcagggatattggcctgaaattttctttttttgttgtgtcactgccagattttggtatcaggatgatactggcttcataaaatgagttagggaggagtctctctttttctattatttggaatagtttcagaaggaatggtaccagtaccattttgtacctctggtagaatttgcctgtgaatttgtcctgtcctgggcttttttggttggtaggttattaattcctgcctcaatttcagaacttgttattggtctattcagggattcaacttcttcctggtttagtcttgggagggtgtatgtgtccaggaatttatccatttcttctagattttctagtttatttgcatagagatgtttataatattctctgatgatagttcgtatttctgtgggatcagtggtgatatcccctttatcatttttattatgtctatttgactcttctctcttttcttctttattagtctggctagcagtctatctagtttgttaatcttttcaaaaaaccagctccgggattcaccaatttttttaaagggtttttatgtgtgtctctttctcttttgctttcacttctctagttcttttaattgtgatgttagggtgttgattttagatctttcccactctgatatgggcatttagtgctaaaatttccctcttaacactgctttatctgtgttccagagattctagtacattgtctctttgttctcattggtttcaaagaagttctttatttctgccttaatttctgccgttatttacccagtaggcattccagagcagattgttcagtttccatgtgctgtgtggttttgagtcagtttcttaatccgcagttctaatttgattccactgtggtctgagaggctgtttgttattatttccattgttttgcatttgctgaggagtgttttacttccaattatttggttgattttagaataagtgctatgtgttgctgagaagaatgtatattctgttgatttggagtggagagttctgtagatgcctattaggtctttttggtccagagctgagttcctcaatacccttgttaattttctgtcttgttgatctgcctaatattgttagtaaggtgttaaagtctcccactattattgtgtgggagtctaagtctctttgtagtctctaagaacttgttttatgaatctgggtgcttctatattgggtgcatatatatttaggatagttagctcttcttgttgcattgatccctttaccattatgtaatgtccttctttgtctcttttgatctttgttggcttaaagtctgttttaccagagactaggattgcaaccatgctttttttctttctatttgtttggtaaatattcctccatccctttattttgagcctctatccctttattttgagcctatgtgtgtctttgcacatgagatgggtctcctgaatacacaacactgatgggtctggactctttatccaatttgccagcatgtgtcttttaattagggcatttagcctatatatatattaatgttatgtttgaatttgatcctgtcattatgatgctagctggttattttgcacattagttgatgtagtttcttcatagagtcattggtctttatattttgctgtgtttttgcagtggctggtagcggtttttcctttccatatttagtgcttccttcaggagcttttgtaaggcctgccttatggtgtcgcctcatggtgacaaaaatctctcagcatttgcttgtctgtaaaggattttatttctccttcttttatgaagcttagtttggctggtgatgaaattctgacttgaaaattcttttctttgagaatgtcgaatattggccccactcttttctggcttgtagggtttctacagagagatctgctgttagtctgatggacttccctttgtgaataacctgacttttttctctctgacatttaacatcttttccttcatttcaaccttggagaatgtgatgattatatgtcttggggttgctcttctcaaggagtatcttagtggtgttctctgtattttctgaatttgaatgttgggttgtcttgctaggttggggaagttctcccggataatatcctgaagtgtgttttccaacttgattccattctccccatcactttcagttaccccaatcaatcttaggtttggtcttttcacatagtctcatatttcatggaaggtttgttcattccttttcattctcttttctccaatcttgtcttcataccttatctcagtaagttgatcttcaatctctgatatcctttcttctgcttgattgattcagctattgacacttgtgtatacttcactaagttatcatgctgtgtttttcagctccatcaggtcatttgtgttcttctctacactggttattttagttagcagttcctgtaaccttttatcaaggttcttagcttccttgcattgggttagaacatgctcctttagctcagaggagtttgttattacccaccttttgaagcctacttctgacaattcatcacatttattctccaaccagttttgtgccctttctggagaggagttgcgatcatttggaagagaagaggcattctggtttttggaattttcagcatatttgcgctgatttttcctcatctttgtgggtttatctgcctttgatctttgaggctgatgatcttcggatgggggttttgcgtgggggttgctttagttgatattaatgttaatgctgtctgtttgttagtttttcttccaacagtcaggcccctcttctgcaggtctgctgaagtttgctgggggtccactccagaccatttgcctgggtatcaccagtggaggctgcagaacagcaaagattgctccctgttccttcctctggaagcttcctcccagaggggcaccagcctgatgccagccagagttctcctgtatgaggtgtctgtcaacccctgttggaaggtctttcccagtcaggaggcatgggggtcaagtacccatttgagtagtcagtctgtcccttagtagagctcaagcactgtgctgggtgaatcctccttgtgaatctgggtgaatctgctctcttcagagccagcaggcaggaacatttaagtcggctggagctgcacccacagctgctccttcccccgatgctctgtcccagggaaatgggagttttatctataagcccgtgactggagctgctgcctttctttcagagatgccctgcccagtgaggaggaatctagagaggcagtctggccacagcctctttgctgggctgtggggagttccacccactcccaacttcccagcctccttagcactgtcaggggaaaatcacctgctcaagcttcagtaatggcagacacccctccccataccaagctcggtcatcccaggttgacttcagactgctgcgctagcagcaagaattgcaagccagtggttcttagcttgctggacttcatgacagtgggacccactgagcgagaccacttggctccctggcttcagttccctttccaggggagtgaacggttctgtcttgctggcattccaggtgccactggagtataaaaataaaataaaactcctgcagctagcttagtgtctgcccaaagagctgcccagttttgtgcttgaaacccaaagccctggcgctataggcacatgatggaatctcctggtctgtggattgcaaaccccatgcaaaaagtgtagtatctgggctggataacacagtccctcagcttcccttggctgcaggagggaggcccctggctccttgcgcttcccgggtgaggctatgcctcactctgcttctttctgctagccctctgtgggctgcacccactgcctaaccagccccatgagatgaagagggtacctcagttggaaatgcagaaatcacccaccttctatgttggtctgctggaagctgcagaccggagctcttcctatttggccatcttgccagatcctccaaaatgcaacactctttatgtctttctttttatattcatcatcataagtgcaagtctgtttaattagattaccagctttgtaagaatgtcaatcaagtcttatatttctattttgctgaattactaatgctctcttaaactctcaatgcatgtctaagtcttttttacttttcaaatccattgtaaaatatagaaaatgtaaaaaatgataagaaattaagatgagtaacactataaactctcttcattacatgttgaaaacctctgagtaatcatacagggtcattggtgctggttttcaaagccatgtttattggaaagtgagaccactgagggtttcaacatgttatttgggactcagaattcacttagaagagattaaactgtctgtaagaatctacgtgccaaagctacagtcagctacaattcatcaaatacttgagtcaatgagcttctgatgaatgataatgagaatactggatgaagaaccatcccatctaaatcaaatatcaaactctactctcagcttcacacacatatcgaatgatatgtttctattcaattccaagatacaactaaacattcacatcttagttctgtcatctttaatggatcatgataaagataatggattttccagtgcagttttgtaatagcatggagcacaagcacaagacctgtctttattagacacagaggattcgttcacccagttttatctgaaacaatggaaggatagcaatgccttactacaatgccgtttaacttattagagctgactcatggcagctgtcctcgctccaggccaattaggtaggtcagatactcagaatctgaagtgttagtaagaagaaaagacaaaagcagaaacaacagtttgcattaaaatcaaactatttttgaagtccaagtggctccagaggaaacagttgaggtaagataatgggggtagaaggtttcctagaggccagtggtcaccttaaaacaaagcttcagtctgacaacccttcaggggctgtggggtccacaattctgcctaactttttagacccacacagctgaattctaggtgtgattttagaatttacaccctgagtgttgtacatacaaaaggaaaatgtttgatgtggctatgagttgaaaacacaaggaacacttttctcctcctaggccctgtgtttctctgccaactcagcactgacaccaccttggagtcagaccaagagatctggtgtctcagaggctggtgggtcacacctaccgcaatccccccatcaccaagtctcagggaaccagcactcccagctcatccatgcacaggttctgctgggttagaaaaaacaagtctatttacctcccagtccagaaacttgctcatcagactccactaaaactgcagtctccaaggacaaaaacttcagaagacacaagttaatttctgaagaaagggaaaagcttcctgagggctgctttgacctccttgtttctcaaagtatagatgagggggttgagggtaggactcagcacagtgtacagcaggccagccaacttgctcttccctgcgctgtagccagagaccgggcttatgtaggcgtagaagacagcggtgtaatacatgcacaccacggtgaggtgggaagagcaggtggagaaggctttctgcctcccccaggcagtcttcaccttcaggatgctggagacgatgaagccataggacgcgatggtcatcaggaagttcactatgccgtagaaagcatccgccaggacaatcatgacaccgttgacgtaggtggagctgcaggagagaagcagcaggggagggacctcgcagaagaaatggataatgacattggggccacagaaatccaagcgcagcatcagccccgtgtggatggccgtgttgacggcgcagagcagccacacggctgtggccagcccgctgcagaacaccttgctcatcatgctgctgtaatgcagcgggtggcagatggctgcgtaccggtcataggccatgaccgtgaggagcagcagctctgaggatgcagcccacgtgaggaaatagagctgggccatgcagcccccgtaggagatggagctctcttccgacaccagactggccagcgccttgggcatgatggaagaggtgcagataatgtccatagtagccaagttgagtaagaaaaagtacataggagcgtggagcccagggttgaacgtgatggccaaggtgatgaggacattacctgtgagggccccagagtagaggaagaggaaacagctgaataagaacacccggtattctgggtgctccgaaaagccctgcaggatgaactcggttaccaacgtctggttactcatcatccttgggctgggacgggtttctgggactatcaggtgactctccatccacagcttcatgtgatttcagagctagagagataaacaagaggtgtcctgaggaaggctgctcccgtgtttcttccacacctcacatcactgcatgaaagatagagatgcattagggcatattgattaagataaacaccccaatattacagtagaaaaaaggcgtgaacactcagtttataaaaaataaatacagttggccagttaaactcatgaagcatcattcaacctcaaacaaatgcaaattaaatccatgatctagtcttcatcatccatgatctggcaaagttagaaaagcatgatattaactagcattagaatggctgcaaagatgcaggccttttaaaatatgtattccatttgagccggaacttcctcttccagaaatgtatcctaaggaataataaaaagcatcctgaaggtgtcagagcagcactatttataatagtggaaatttaaaacaatctatacccttaaacgtgagtatattatggtaaattgatataaatgctgtctaattatcaaagtaatgctttggaagtgttttactgatgcttttaaaaggagaatgacactttgggaggccgaggcaggcagatcacttgaagccaggaattcaagaccagcctgtccaaaatggtgaaaccccattctctactaaaaatacaaaaattaacctgacacggtggtggtggatgtctgtaatcccagctacttggaaggctgaggcaggagaatcgcttgaacctgggaggcaaggtttcggtgagctgagaccacgatgctgcactctagcctgggcgacagagtgagactgtctcaaaaaaaattgttttaattttaaaaaaaggaaagaatgaaaaaaaatttaaaataatgtgtacaataggatctcatttttaaaaaaaaaattaaaaaagcagatttgtttccactgatattgaggatagtgaaaaatttaaaataaaaataaaatgtaaaagcatgtttgtatatgcacctgtaggaaaaacactggtgagtgctagaccagagcttgaacagtgattgttttcactttttaaatttttgctggtctgtattttctactttttctataaaatgacctctctaaaaggcagatgtatcacacagaatcctccttacaacagttcttccatggcttcccattgccaaaagaataaatgctcccagcaacttttcctggatccacctcctctccagcctttcttcccactcatcttaaagccagaactccagccatgccctgcactcacagactggctgatgcaccaagccattccaggatttcttggttttgttcttcccactccctgagccaggaatgccctttttctcatgaaccagggacataatcagccccctctttctgagcatcccttccctggggagaaagtaccactctttcctttgtgtttcctctgatactgacttctatcctagtacacaatacacgtcactccttgatcaggttactggactgtgccctaaaagattaacacatatgcccgtttatctctggacatcccttcttggcacccagccccctgcctagcaggcagtgtgtagacactcaaatatgtgtgtttaaataatgctaaagaataggctagtatgaataacagcagaatgacttatattcttaagttactgcacattctgtacagctcaagataaaatcagcatagtgcacatttggtttttccctttcaactctttattcattaaaagttaaggaagaggctgggcgtggtgactcacgcctgtaatcccagcactttgggaggccgtggagggtggatcagaaggtcaggagatcgagaccttcctggctaacacggtgaaaccccgtctctactaaaaatacaaaaattagccgggcgtggtggcgggcgcctgtagtcctagctactctggaggctgaggcaggagaatggcgtgaacccgggaggcggagcttgcagtgagccgagatcgcgccactgcactccagcctgggtgacagagcgagactccgtctcaaaaaaaaaaaaaaaagttaacgaagatattcattttaaaaatgaacatttggaagatgtttgttttaaaaatgaacatttggaagatgtccattttaaatatgttcattttaattatgtttttgtcaagattcaagaaatgtatttaccactaaaatattaaaaggtttacacaaaatgaccaaacatcatctccagctcaggtcatatcaccttttaataaggtaaaaactgttttttgaataggcaagcataaaatccctatgactcagagcaataaggctatattagcgtggggtatgatcagaatcaatggaaatgatggtgttccatctgtgtatcttcccagcaacaaggtgtcagaacagctcaataacttgagtggaagtaataaatacaatatgctttagctgatttcattattgtttgggacaaaaagagtgaataattactttcgctgagtttgagttgtggatctgaagaaataactgtaactttatttgctcttatgatggcccagtgagtgactcctctttaactccagggacagaattggattttctccatcaatgtcccagtgtgaggtttctgcacttccgactcatgtcctcctccctagaattctagccaccagatttctccagccatcatgaaatcatggtgcactccacagtgcatattacaaacgcaccagagtcagcacagctgcagctgtacctgggagatggaaaacgcatccatcactgaacacctaccaagcagcagtgtgcagagtctgtcacgcatccttcctggagcaagaaaacctattacgaaggaaaccttaaacacaatctctctcttagctccacaatgagattagaaaaacaatagctctgcaatacaaatggatgttttgaacaggtgctgagcacaaggaaatttccacaaatgtattcacattcaaggagcaaattagccctcaggtaattacccacttattgtgattgggtggggacaggaggacagtcttctcaatcaactggtcaataatgagatcaaagaatcggggctccaatcctctttccatgagaatgaccacaagatttctttacagcctcagccagtcatttcttctgaaaaataacaaagaccttgctcccttgagtttcatagggcatttgcttcaattctcagccagcattacaagagtattactaagggtatgaggcaaaataacacaatttcaggtaataaatggcaagtttaaacacatactgcattcagacaacacgatgacatctcaccagcaggccaacaggatattcgaacagcggttattttccacatttatcaaacccttgggcactcaagcttctgaagggggaaaaaaggcatcttggattacatttatcactttaaagaaataacaataatagtcctcaaaatctctgaaattaaaaaggtaatttcattgagtattttctaaagacaaattatattttacataaaatacaatttacttgtagtgagattatatctttgttccaatttattgttcatagtttcataaacagaaaatttaaaagatttaattaataatggagaacttgactcatttcattatttttatctctaaagctgttcaatgattttcacagacaccatattaatctaatgtccttttattgtatatgaaggtaggcatttctattgtagacatgcttcaagaacagaaaactaaaaatcagaacatgccagaatcgcatatgttcagggtcaaatctgaaagacattttgaagataactttgtccaacctattgatttggaaagtcataaatgtatctaaataacttaccctggtcacacagagtattagtgacacagctagtatctaggctcaaggctgtgggactacagtccagaattcattgctgtgtaatttgttggttgcctccataaatccagccccatcaaatgtcaaagaaaagccatgaaaaagaaaaatcaaccaataatttatacaaacgtatttaaggctggggtgtggaatgtaaaccctaaactctcagccacatttggcatcccacttaccctgttgttttgttactgatcaaatggtaataacacatattcaaatgttactgactctggatcaactcaacaaaaaccattaagtcttttatataagcaaattaagcagacagagttatgagtagaacttttcccattttttaaatgtcactcaatcaccatcctcagaacaatcataattaccttaaaaaaaatgatttcacctttgtagagtgaacagactttatgtatagctgtcctctctctgccaagcacaactgagggtagaaacatggtgacattgaggcagtgtgcaacctgtgataagatcagtctgaacaggactgttcaggactgaacaaggtttccttcccatatttaagatggccttgccaagaatttgtgacttatctttagcaacatttgtcactgcctgtgggagacactagggagagctgttcacaactattactctaagtggaccctgaaggagcaattaaattaagtgcttctttactggggacttgcctgtcattggggttcacagaaaggccaattcagatttctaatccaaatgtgtagaaaagggtgtgggcccaagtgggggaggagggacagcaggacacattctctgtcccagctcacagaatctgggtcagggcagacccaggctcaggtgctcagaacgtgtccacacctggggactggagaaagactgtcaggcaggcaagtagcatttctggactgctatccatggaaggcgaggcatggagcaaatgtttccatgcttctctgtataaaccactctttctaacagagctggcctctccctgtccctcataaacagcttggatcttatttatccctgcttgatctcatttcatccaaatcccacccagatctaactctatctcccctaccaaaccttccctgactccctggaaggaaaggaccactctgtctgctgagtctctgtcccattcaggggttctccaccaggctctggaggcaataacatgggcttcagagtctttccagacctggggtaaaatctctgaaagttactggtcatgtgactttgggtgactgcgcttaacctctccaggactcatttataataatgaaaagccttatcgccttatcacagtacctaatacaggaaaggggattggcaatattttatttcccttctcccaattcaggatgtacgtagatgtatgttttttcttccatattagttagcaagcagagagctgactaaatatcgatgggtttactattaaaacgcacttcaaacagttctaattttactaagcagcactaaactaaacagttcattaatggctttgagactttactctgtttcttaaatagctgcagaaacttgtataagtccgtagtctctctgaatcccaatttttcaatatatagaatgggaataattatacctaccttcagaatttttgcggggactaaataagatgacgtacatgaatccattttagaaaccatgttagttgtcattatgaatgggtcatctatagaaataattattccaaaaaattctgccttggcagtattaagcccaagcagattacctttatttcaacaaaataaaagatccatgaacaaggaattcccttcctgtgatgttaataatatgctaccattcaggaataaatgtgtgttaggttaaaagctaaactgttaacatgaagagacctaaatatatagtggcttcattttttctcttttgctcaacaatctgaagatatacataagttgtggggtagcttccagactgatggggcagtcttgctccactaagtcattaaaggatttaggttcctctcaaatcaatgattcttgatctcctacgtgatgattctctttaccataaaagttgccataacctctacattttagttgtaaaaagggacaatatagaaagctcaaataatacaatttattttaagcaagtgaggcagatattgtgcacataacttctgctcatattttacaggcaaaagtttagttacattgcttcacctagctgccagggaagctgggaaatgtggtcaagctggaaagatacatgtacaggaaaaagggagaatggatttttggaaaaaaactaataattgccacaaatatgcaagagaactagagataaggaacttaggaataaaagactggaagtaagaatgaattgtatatgttactcccgagaactgagattcgaggaagaaaaaaaggatgattatatacttacacaagaaagagggcggaagtgaaaagaagagggtgaaagaggtaaacaggcaatgaacagtattaaaagttaaaagagaaaatcaaggacatgaattaaagagttataatatccttacaaggtatccagaaagagtcaaaagtggtggaaccctgaaaaattatgcagaaccccaaaagttcccatttgatggagaaaaatgctttgtagagttgtggaatgactgactgaaagagagtaggatctgtgctgcgagatgacttgctggccaaggaaatgcttggaaacttggaaaaacttagggatctggagaatgtcatgaggagtcctgcctgggcaataccactgctcaatttttccaggcctatcccctaacctcagcaaggaccagctataaaacaatccttttaaaactttttagttatttctatcacccagccatagccttgggtgcatttcatatttctcaagacattcgccttcaactttcccaacatattatcttgggcttgcatcttacatgattaaaaagagaaataccattgtatcagagctcctcaacttaattacttcccatctcaatctttctacatctttaacttcagtcttggttgagctccaccctctgtgcttgttcttgagaaacaagcaaaagagctaagaaaggcttagagcaaactggtaaacattgttattttcttttaggtatccatattgcgacagggtcttgatataatatccatactaggtataatttgcataccagatattcaaagaagtaggagaatatggccatagtgagaaaaataaaatcaactcagaaatgacaaaaataagagaactagtagagacattaaaatagtagtgatacaaagagaggaacaataaacactggggcctacttgaagttggagggtaggagaagggagaggaacagaaaaacaactattgggtactaggcttagtacctgagtgatgaaataataaacaaactcctgtgacacgagtttacctacataacaaacctgcacatgtacctctgaacctaaggtaaaagttgtaataaaataaaatagttgtcataactatatttcatatgctcaagaagctagagaaaagacttagcatatcaaatagagacaaagaagatataaaaagatgaacaatttctagagatgaaaactacaatgtctgaaattaataatacattggatgagattaacagtggattagacattgcaaaaaaattagcaaattagggaaaagtataataaacctgcccaaatgaaatagaagtggaaaaataaacataagaactgtaagtgagctgtaagacaacctcaaatagcctaatatacatataattagaccccataagggcatgagaaatgggagaagaacagaaaaaaatttgaatgaataatggctacaatttttctaaatgtaatgaaaaatataaacctacagacttaataagctcaatgaaccccaagcacaataaatatgaagaaactcacaccaagccacatgatcaaaatcaataataaaaataaaatcttaaaaacaggcagagtaaaaaggcacattaagtacaaagacacaaagataagaattacagcagagtttctatacaatcagtacaagcaagaagacagtagagaaacactaaacagtactgaaagaaaaaaactgtcaatgtagaattttacactcactaaaaataccttctgaaaatgaagaaaaaacatttcacaaatataaaagttaaaggaattcatcatcagaagatatgaacaaaaaaaaaatgttaaagaaaacccagagactcacagtgagacacactataatcaaactctcaaaagtcaaagacaaagagacaatcttgaaagcagcaaaagaaagtaacttgtcatgtaaaaggaagcctttataaaattatcagtggatttatcaacagaaaccttgcaggccagaaggcagggggataatatattcaaagagctgaaagaaaagaaaatttcaaccaaaaatattatatccagcaaaaccatccttcaaacataaaggaaaaatcagcctttccaggatgaacaaaaactggggagttcattaccactggacctgctgtagtatcttgcaagttgaaacaaaaggatgctaaatagtaacatgaagtcttatgaaaatataaagctctccagtaaagataaatatatggacatatatagagactgtactatgcagttttggtacataaatgcacttttaattcttgtatagaatttacaagacaaaagcttaaaaataactataaaactgtgttaatgaatacattacatatgaagatgtaacttgtgacataagtaacctaaggtgagggtaggagctttgaagaaatagtttttgtacacagtcgaagttattctcttaacagtttaaaatagcttgttaacactttaagatgttttttataattcttatggtaaccataaaaaaatctatagaatacacacaaaaggaaacaggaagggaatcaaaatgtcaccacaaaaaaaaatcgacaaaacccaaaagaggtcagtaagagaaggaataaaaaacaaaatttacaaaacatacaggaaacaacaaaatggcaagtgtaggtccttccctatcagtaattactttaaatgtaaatggattaaactcctgaatcaaaagatatagactggaaaatggatttgtaaaaaggatccaactttatcctgtcatttaggtctaagaaacaaatatgcttaaaatgaaaaaaaggaaaagtaaatgccatgcaaatggtaaataaaagcaagcagaagtgactatactactatccaacaaaatagacttaaagtcaaaaatagtcacaagacaaaaaaatggatattatataacaaaaagtcaattcagcagaaagatataacaattacaaatatatatacctctaataccagagctcctaaatatctgaagcaaacattgacagatcagagaggaaacataaacagcataataatggtaggcgacttcaattcctcacttacaataatggctagaacaacaagacagaaaatcgataaggaaatacagtacttgaacaacactataaatagtgctaacaaacatgtgcagaacattccacccaataaaatcagaatagtatttttctcaagtttacatggaatattcccaaagataaatcacatgttataccacaaaaaaacttgtaacaaattttaaaagattgaaattatacaaaatatctattttgatgaaaatgacataaaactagacatcagtagcagaaggaaaacaaaaaattcacaaatatgtgaaaattaaacaacacagttttcaacaagcaatgggtcaaaaaagaaatcacaagggaagttagaaaatatcttgagataaaggaaaataaaaatacaatgtaccaaaatgtgtaagatgcagcagaagcagtgctaacagagaattttatagctataaatatgtgcattataaaaggaagaaagtggctaggcatggtgggtcatgcctgcaatcccagcactttgacaggctgagggaggagaacttctggaggccaggaatttgagaccagcctgggcaacaaagcaagaccccatctccacaacttaagaaaaaaaaaaaaagaagtagaagaaagtttgcaaatcaacaacctaactttatacctcaggaaactaggagagaaaaaaaactacacccaaagctagcagaaggaggaaaatcctaaagattagattaaatcagagataaatgaaatatagaatataaaaacaatagaaaaaaatcaacaaaactaagaggtggtttttgaaaacaccaacaaaattaacaaatgcttagctagattaactaaggaaaaaagattcaactaataaatcagaaataaaaaagagaacattagaacccatgccatagaaatcaaaaggattataagaaaataccatcaacagttaattatatgtcaacaaattggataatttagaagtgcataaatttctagaaatatacaacctaataagagtgaatcatgaagaagtagaaaaaacgaacagacttataactacgaaggagattaaactggttcaaaaacctccaaacaaacaacagcccagaaccggatgactaccaaacatttaaggaagaattagaaccaatgtttctcaaagtcatttacaaaaatgaatataaaaaacacttcaaagctcattatatgaggccagtattaccctgatttcaaagtcaaacaaagacattacatgaaaagaaaactacagaccaatatttgtgatgatcaggttggctttattcctggaatgcaagaatgatagaacatgtggcagggtgtgctggctcatgcctgtaatcccagcactttgggaggctgagacaggagaatcccttgaacccaggaggcaaatgttgcagtgagctgaggtcatgccactgcactccagccagaatgacagaatgagatttcatctcaaaaaaaaagaataatacaacatgcaaaaatcaatgtaatacactatagtaatagaataaaggacaaaacagcatgatcatttatattgatgtagaaaaaatgtttaacaaaatttaacaccttttatcacgaaaacactcagcaaactaggaatagaaggaaaataacataataaaggccatatatgaaaaatccacaggtaaacttacactcaatggtaaaagattcaaacttttcttctggattaggaacaagacaagtatactctgtctcttcgcttctattcaatatagtatttgaatttccaagcagaccaattaggaaaaaaaaattaagcaagaaaagacatccaaagaataaaagaaaaaagtaaaattatctctgctcacagatgacttgatcctatatgcataaaatcctagactcctgcataaaatctagaaaactgttagatgcatatatgcataaaatccagaaaactgttggaactattaaacaaattctggaaagttgcaggatccaaaatcgacacacaaaaatcagttgcctttctataaattaactataaacaatccaaaggtaattaagaaaataatttaattacaataccatcaaaaatagtaaaatacttaggaataaacttagccagggaaataaaaggcttgtacactgaaaactacaaaacagtactgaaagaagtcacaaataaatgtaaagacattggtattcatggattggaagatttaatgttaagatctccaaaatatcagatgtattccccaaatctgtacaacattatgtattaatttgaaaagtcaatagaacccaaagcagtctacaaattatatgtaatccctatcaaaatctaagctgcattttttgaaaaaagagaaaaatttatctaaatattcatatatactctgactagacaatcttgaaaactaactgagttgaaggtctcatgctccgtgatctcaaaacatgttacaagactacagtaattaaaacagcatgacactggcttaaagagagacatatagaccaatggaatagaataaagaacccattaaaagaaaactccacatatatggtcaaataatatttacagcattccagatccgctcaatgagggaagaacattctcttcaacaaacagtgttgggaaacttggatatccacacatgaaagagtgaagttgaaactttgtcttatgccatatacaagaattaactcaaaatggatttaaaacttaaatggaagatctaaaactataaaactcttagaataaggggatatggcaattattttttaatatgacaccaaaagtacagacaacaaaagaaaaaatagacaattgggactacatcaaactttttaaaacttttatgcattaaaggacataacaatgttaaaaaaaacttgtggatggaagaaaatattagtaaattatatatctgataaagagttaatatccagaatatataaataatttctacaacacaatatttaaaaataatatgattttaaaatggcaaaaggatttgaatagacatttcttttaaaattatatatgaatgggcaaaaaacataagaaaaaatgctcagcatccaaactggaaaggaaatcattagagaaatgtaaatcaaaaccacaatgtaatatctcctcacaaaaattgagtggtttactattaagaaaaagaaatattagataggatgcagttgatagcaaacagcttaaaagcaacgtgaccccagatactaactcaaagccacacaaaaaacaaaaagctctggcaaagacatttatttatatttttatttatgtatttattgagggttttgctgttttgttgttgttgttgtttactgttttatttttgctttttcaacttttattttagattcagagggcacttgtgcaagtttgtaacctgggtatattgtgtgatgttgaggtttggggtatgaatggtcccattacccagatactgagaatagtactcaacagtttttcaacactttctcccttccctccttcaccaccccaatagtccccagtgtctattgttgctatctttatgtccatcagtacccagtgtttacctcccccttatgagtgagaatatgtggtatttgattttctgtttctgtatttgtttgcctaggataaagtcctctagccaaatccatgttgctgcaaatgacatgattttcttcattttcttttattttttatttttatttatttttttttattattatactttaagttttagggtacatgtgcacaacgtgcaggtcagttacatatgtatacatgtgccatgttggtgtgctgcacccattaactcgtcatttagcattaggtatatctcctaatgctatccctcccccagccccccaccccacaacagtgcccagtgtgtgatgttccccttcctgtgtccatgtgttctcattgttcaattcccacctatgagtgagaacatgaggtgtttggttttttgtccttgcaatagtttgctgagaatgatagtttccagcttcatccatgtccctacaaaggacatgaactcatcattttttatggctgcatagtattccatggtgtatatgtgccacattttcttaatccagtctatcattgttggaaatttgggttggttccaagtctttgctcttgggaatagtgccacaataaacctacgtgtgcatgtgtctttatagcagcatgatttatagtcctttgggtatatacccagtaatgggattgctgggtcaaatggtatttctagttctagatccttgaggaattgccacactgacttccacaatggttgaactagtttacagtcccaccaacagtgtaaaagtgttcctatttctccacatcctctccagcacctgttgtttcctgactttttaatgatcgccattctaactggtgtgagatggcatctcactgtggttttgatttgcatttctctgatggccagtgatgatgagcattttttcatgtgttttttggctgcataaatgtcttcttttgagaagtgtctgttcatatcctttgcctactttttgatggggttgtttgttttttgcttgtaaatttgtttgagttcattgtagattctggatattagccctttgtcagatgagtaggtgcaaaaattttctcccattctgtgggttgcctgttcactctgatggtagtttcttttgctgtgcagaagctctttagtttaattagatcccatttgtctattttggcttttgttcccattgcttttggtgtttcagacatgaagtccttgcccatgcctatgtcctgaatggtattgcctaggttttcttctaaggattttatggttttaggtctgacatgtaagtctttaatccaacttgaattaatttttgtataaggtgtaaggaagggatccagtttcagctttctacatatggctagccagttttcccagcaccatttattaaatagggaatcctttccccatttcttgtttttgccaggtttgtcaaagatcagatagttgtagataagtggcattaattctgagggctctgttctgttccatcggtctatatctctgttttggtaccagtaccatgctgttttggttactgtagccttgtagtatagtttgaagtcaggtagcgtgatgcctccagctgtgttcttttggcttaggattgacttggcaatgcgggctcttttttggttccacgtgaactttaaagtagttttttccaattctgtgaagaatgtcattggtagcttgatggggatggcactgaagattttcttcatttttatgactgcatagcattccatggagtatatgtaccacattttctttatccaattcactgttggtgggcacctaggtcaattccatgactttgctgttgtgaatagtactgcaatgaacatgtgagtgcatgtgtctttttggaggaataatttgttctcttttggatatatacccagtaatggggttgctgggccaaatggtagttctgttttaagttctttgagaaatctccaaactgctttccacagaggctgaactaattgacattcccactgccatgcatgagcattcccttttctcctcagctccaccaacatctgttgctttctgactttttgataatagccattctgatgtgtgagatggtagcccattggggtttctttttttttttttaagacagagtctcactctgtcacctaggctgtggcacaatgttggctcgctgcaacctctgcctcctgggttcaagtgattctcctacctcagcctactgagaagctagggttacaggcacctgccaccacacccagctaattttggtatttttggtagagacagggtttagccatattggcaaggctggtctctaactcctgacctcaggtgacccacctgcctcggcttcccaaagtgctgggattgcatgcgttagctaccatgggtggtttttgacttgcatttctctgatgattagtaatgatgatccttttttcatacatttgttggccacttgtatgtcttcttttgagaagtgtctgttcatatcttttgcccatttttcaatggggttgttttttccttgtccagttgtttaagttatttatagattctggatattagtcctttgttgggtgcataatttgcaaatattttatctcattctgtaggttatctatttaatctgttgatagtgtcttttcttgtacagaagttgttcagtttaattaggtctcacttgtcaatttctgtttttgttgtaattgcttttgaggacttaatcataaattctttcccaaggcccatgtccagaatggtgtttctgagattttcttctaggattcttttacttcaaggtcttatatttaaatctttaatccatctggagttaatttttgtatgtggcaaaagttaggtgtcttgttttatttttctgcatatggctagtcagctatcccaggaccattcattcactagggagtcctttccccattgtttacttttggcaactttgtcaaagattagatggctgtaagtgtgcagatttatttctcagctctctattctgttcaactggtgtaggtatctgttttcgtactagcaccatgctgttttggttactgtagtcttattagtatagtttgaagccaggtaatgtgatgcctctggctttgttctttttgcttaggattgctttttgggctctctgttgttgttgttccatatgaattttaggacacttttttccaattctataaaaaaatgacattggtagtttggtaataatagcattgaatctgtagatagattgctttgggcagtatggccattttaatgatattgattcttccaatccctgagcatggaatgtttttccatttatttgtgtcctctctgatttcttttagcagcgttttatagttctccttgtagagatctttcacctccttggttagctgtattcctaggtattttaattttttgtggctattgtaagtgggattgcagtcttgatttggttcttagcctgaatgttattggtttatagaaatactactaatttttgcacattcattttgtatcctgaaacgtcgctgaagtcatttgtttattccaggaggctttgttggagtctttagggttttctatgtatagaatcatatcatccacaaagagagatacttttctctcttcttttcctatctggacgccttttatttatttctcttgcctgattgctttggatagcacttccagtactatgttgaagaggaatggggagagagggcacccttgtcttattcctgttctgaaaaggaatgcttccagtttttgcgtgttcagtatgatgtaattatttttctataatagacagtagaaatgcatttttcttttttcttaactcattttaaaaacaattatataaaataacatgtatacaatatactattggccctataatatatacaattctataatacatatatgcaatatatacaattttaatatgtgggtgttatgtatgctaataatagcaccaataataatttaaacaatgtatatctttgtaacattaattgatataatataaataaaataaccacaaaagagcaagagaattaagttctacatgagtaacatttctacatattactggaattaagctagtgtgaatctgaaactcatactgataagatatatacagaaaatcctagagaaaccactaaaaataaaaatacagtgataaaattattaataaaacttaaatactatattagaaaatattaattcaatgaaatagaaagaagtaaagacaaaacaggaacaacaaagacatgatacatataaaaaacaaaaaatccgggcgtgcggtggctcatgcctgtaatcccaacactttgggaggccgaggtgggcagatcacgaggtcaggagatcgagaccatcttggctaacacggtgaaacccagtctccactaaaaatacaaaaaattagccacgagtggtggtgggcacctgtagtcccagctacttgggaggctgaggcaagagaatggcctgaacccgggagttggagcttgcagtgagccgagatcacgccactgcactccggcctgggtgacagagcaagattctgtctcaaaacaaaaacaaaaaagaactaaaatgacagacataaatcccactaaataataatatgcagtgtgaatggaataaacaatgcaatcaaaaggcaaaggtgttatattggataagaaaacatgaagtatatattgtctggagaaaacacaattttgattcgaagacacagaatgaaagtaaaagaacaggaaaaatatattatgcaaacagcaaccacaaaaacactggagtcagtacactgatatcagacaaatagactttaaaacaaaaattgttactagagatagagtggccttttgtaattacaaaggaatccatccattaggaagatataactgttatcaacatatatgcacctatatatatgaagcaccaaaataaatgaaacaaaaacagacctgagaaaagaaagaaatagacaagtcaaccgagtcaacagaaatagtcaaggacttcaatactacacgttcaaaaatggatagaacaactggacggatcaacaaggaaaaagaggacttgagcaatactacaaaccaaatagacctcaaggactatggaacattctacttaacaacaacaacaaagtatacattcatgtcaagtgagcatggaacattctagaagatagaccacatattaggccataaaacacacctcaataaatttgaaggatagaaataatgcaaagtatgttattaaccacaatggaataaaattagaaatcaacaacaggggaaatttgggaaattcacaaatatttggaaatttaaaatgaaatttccactctaaaacaattcatgagtcaaagaagaaatcaagacagaaattagataatatttttagacgaataataatgaagacaacataccaaaacaattgtgatgcagctaaagaagtaattagagtaatatcaacagctgtaaacacttgtattaagaaagttcttaaatcaataacttaaaattctaccttaagacacttacaaaaaatatgaaactaaatttaagtaagcagaaggaaggaaataatgataacagcacaaattaatgaaataatttgatcgtttgaaaaaaatcaataaaatggaaaaaacttcagtttcatcagggaaagaggagagaaaactcaaactatagaatcagaaataaaagaagagacattactactgacattaaagaaataaaaaggattataaaggaataccaaaaataattgtacactgacaaataagataatttaagtgaaatgaaaaaatttcaagaaagacacaactaccaagactgactcaagaagaaacagacaatctgaatagacctaaaacaaattaagagaatgaatcagtaatcaaaaactacccaaaaagaaaagcaaatggcttcactggtgaattctactaaacatttgataataccaatttttcacactcttccaacaaaaagatgaggagggtacacttcttgaacattttatgaagccactatttccctgacacaaaaaccaaataaagacatcacaggaaaagaaaaccatagatcaatacctcttatcttatgggcacaaaagttcccaacaaaatactagcaaaccaaatccagcaatacatagaaagaattatacaccatgattacatgggatttatcccaaggacacaaggttggtttcacatccaaaaatcagctaccataatacaccatttcaatagaaaaaaaatggccaaactctcaacagacacagaaaaaagtatttgataaaattaaatgccctttcataattttaaaaaatcagcaaactaaaataaaagggaactttcttagcatgataaagggcatataggaaaatctcacaactaaaatcatactcaggggtagaaaaactgtaagctttactcctaaaatcaggaacaacacaaggatgcccattttcaacactgacactggacattgtactagaagttctagccagagaaaagaacatagccaagaaaaagacataagaggcatacatatttaaaaagaagcagctaaattacttacatttgcagaaggcatgattctgttaatagaaaatcccaaaggatgcaccaaaaaactactagatttagtaaattcagtaaggttgcagggtacaatatcagcacataaaaatcagttgtctttctaaacgctagcaatgatgggtatggtaatcattatttggctgtagtaatcacttcattgtgtatatttatgtcaaaagaagtatatcaaacatcatgtggataccttaacatacacaattttaaaaattgtaaaccctaagttatagtaaattgcagctatttagagatgactcaaaatgaagaagctgtggtttaaaaaaaaaaatactggctgggtgtcgtggctcacacctgtaatcacagcactttgggaggccaaggtgggcagatcatgaggtcaagagatcgagaccatactggccaacaaggtgaaactccatctctactaaaaatacaaaaattagctgggcgtggtggtgcacacctgtagtcctagctactcgggaggctgaggcaggagaatcacttgaacctgggaggtggaggttgcagtgagctgagatcatggcactgcactccagcctggcaacagaacaagactccatctcaaaagaaaaaacaatactgagagtaagcattccatttaaatatagaaccatcactaggcagctgtggaatttatggttacaggacagaataaatacagtaatataagacaaatgtctagaactgaaattactgtggcaagggattttaatagatattggctaactgtcaaccaaggaagtatgttccacacctatacccatctgttttggtatttcatctctgctaagtgaaaaattatatgttttgttttatattttacttctttaattaatgggaaaggctgaacagcttctcacatgtattaaatttgtatgattattctttttcttaatcatttgcctgggttcttgctatgttaagaaattatttcttcatctaccacaagttgtaaatagcttttcgttagtgcgtgtgtgtctgtgtgttcagaaattttgaatattttatgtgataacattaacaaggcttttctattgagggtttcagcttttctgtcttgctaagaaacaccttctttactctagaatgttaaaaatacttagtgtttttacataatacatttaaggtctaatattttatacgtaaaagtatgaatcagcagctcctcaaaaatttaacagagaattaccatacttattcagcaatttcacttctgggtattacccaaagagttgaatacaggaactcaacatgttgatggcagcaatattcatgatagctaaaatatggaagcaacccaagtttctattgatggataaatggataaataaaaggtaatatatctatacaatgcaatattattcagctttaaaaaggaaggaaattctgacacatgccacaacatgaatgaaacttaaagacattaggcttagtgaaataagtcagtcacatatttttcttccctcccacctcctctaaaccattgaacaagtatagacagtactatactgctcacaaaggtggcttaacaattaaatttctaaaagacagtatttcctatgaattttagcaaaaagatatttacaaagtggtattttattacctctacatttaacgtacatcaggcacttctaaacatctagataaactaggtgtttcaagtaaggagttaatttgtccactatatacacagcagtctcgaataaactgcatacatgtaaccatagttataatttgaaagagtcttccaaataagaacatcctagcttagaatccctcccatctccatcaactcagtgcgcaagaatgctcaaagataggaagacaatctttcctaggaattttaaaacaaaatatacaaaatatattagtttactaactctacttttgttatacactggcaacctctttaacatctaaaaagactagatgttgtaaattaggactcgtttgtcctttatatacactacataaacagataagtaaaacaaaatgcacagacataagagataatggttaatcttgcctcactgtaaacacagcggcatagagctctctgcactttcccctccttcctcctcccctgaaccaggacacaaacacgatgagtattactcaacaggtagtttggccattcccctccaaaaacaacatttcatatgaattttagcaaaaagatatttacaaaatattattttactaccgctaattttgacatatattaggcattcggaacacatagaaagaatacacaaaaaagtttagcattgtcaactatatatacaatagtgaggaataaaatgcacacaaaacaatggatagaatatgaaaatgtctaaatatcacaagtctggtatagaaccttctttttcttctcaggctttccagatccatgtcccctaacccactgaacagatatagacatatcccttacagaggtgatctaacgactctattttaaaaagtcatctccaaaaaacatctaatttgtatgatttctttttaaacaaatgagaatttacaagatgtgtgattttctaattctatcatatgtcagcaacctctttccatctagaaagactgaatgtggcaaatgttctcttttatttttttaatctcttttaacttatttatttttatttttcttattatactttaaattctggggtacatgtgcagaatgtgcaggtttgttacatagatatacatgtgccatggtggtttgttgcacccatcaacctgtcatctacattaggtatttcccctaatgctatccctccccagccccccatagcccaacaggccccagtgtgtgatacccccccaacccgtgtccatgtgttctcattgttcaactcccacttatgagtgagaacatgtggtgtttggttttctgttcttgtgttagtttgctgagaatgatggtttccaccttcatccatgtctctgcaaaggacatgagctcatcatttttcatggctgcatagtattctgtggtgtatatgtgccagattttctttatccagtctatcattgatgggcatttgggttggttccaagtctttgctattgtggtatttctagttctagattcttgaggaatcaccacactgtcttccacaatggttgaactaatttccactcccaccaacagtgtaaaagtggtcctatttctccacatgctctctagtatctgttgtttcttgactttttaatgatggccattctaactggcatgaaatggtatctcattgtgtttttgatttgcacttctctaatgaccagtgatgatgagctttttttcctatgcttgttgactgcataaatgtcttcttttgagaagagtcttttcttatccttcacccactttttgatggaattgtttgttttttcttgtaaatttgtttaagttctttgtagattctggatattagccctttgttagatggatagattgcaaaaatgttctcccattctgttggttgcctgttcactctgatggtagttactttcgctgtgcagaagctccttagtttaattagatcccatttgtcaattttggcttttgttgccattgctttttgtgttttagtcatgaagtctttgcccatgcctatgtcctgaatggtattacctatgttttcttttagggtttttatggttttaggtcttacatttaagtctttagcccatcttgagttaatttttgtatacagtggaaggaagggatctagtttcagctttctgcatatggctaaccagttttcccaatgccatttattaagtagagaatcctttccccattgcttgtttttgtcaggtttgtcaaagatcagatagttgtagatgtgtggtgttatttctgaggcctctgttctgttccattggtctatatatctgttttggtactagtaccatgctgttttggttactgcagccatgtagtatagtttaaagtcaggtagtgtgatgcctccagctttgttatttttgcttaagattggcttggctatgcaggctcttttttggttctatatgaaatttaaagtagttttttccaattctgtgaagaaagtcagtggtagcttgatggggatagcattcaatctataaattactttggatattatggccattttcacgatattgattcttcctatccatgagcatggaatgtttttccatttgtttgtgtcctctctgatgtcattgagcagtgatttgtagttctccttgaagaggtccttcacatcccttgtaagttggattcctaagtattttattctctttgcagcaactgtgaatgggagttcactcgtgatttggctctcggtttgtctgttattggtgtataggaatgcttgtgatttttgcacattgattttgtatcccaagactttgctgaagttgcttatcagcttaaggagattttgggctgagatgatggggttttctaaatatacagtcatgtcatctgcaaacagagacaatttgacttcctcttttcctaattgaatatccttcatttctttctgttgcctgattgccctggccagaactcccaatactatgttgaataggagtggtgagagagggcatccttgtcttatgccagttttcaaagggaatgcttccagtttttgcccattcagtatgatattggctgctgtgggtttctcataaatagctctgattgttttgagacatgttccatgaatatctagtttattgagagtttttagcgtgaagggctgttgaattttgtcgaaggtcttttctgcatctattgagataatcacatggtttttgtcattggttctgtttatgtgatgcattacgttcattaatttgcatatgttgaaccagccttgcatcccagggatgaagccaacttgatcatggtggataagctttttgatgtgctgctggattcggtttgccagaattttactgaggatttttgcatcaatattcattagggatttcggcctgaaattttctttttttgttgtgtctctgccaggctttggtatcaggatgatgctggcctcgtaaaatgagttagggagattctctctttttctattgtttggaatagtttcagaaggaatggtaccagctccttttgtacctctggtagaattcagctgtgaatccgtctggtcctggactttttttggttggtaggctattaattaccacctcaatttcagagtttgttattggcttattcagggatttgacttcttcctggtttagtcttgggagggtgtatgtgtccaggaatttatccatttcttctagattttctggtttatttgcatagaggtgtttataatattctctgatggtaggttgtatttctgtgggatcagtggtgatatctcctttatcattttttattatgtctatttgactcttctctcttttcctctttattagtctggctagtggtctatctattttgttgatctttaaaaaaaaaccagctcctggattaattgattttttttttttaatgagagataaattgtttaattttaggttcagcagttgaacaagctttttgtggtttggtggcagttttctgccttggcattacaaggttacctcttgctaacaatcatagcttttgatagacttagataaatgtgttcaaacagcttttctctgtttgaagatgcctggctctcttttttttttttttttttttaagacatttccaaagcctacagttagtgtctccatctgggcaagagaaaacatgtgaaagtctcatttatgctggaagatagggtagggttgagagtgatggttacaagaattttaactttacatctacaagaatgtggtacagattaagtccttgataatcatgttgtatatttaaaaacatctatagatgattttatgtagaatgggaattttaacattttatttgtgtttatttctttttttattttattttattttatttttatttttatttatttatttttttattgatcattcttgggtgtttctcgcagagggggatttggcagggtcataggacaataatggagggagggtcagcagataaacaagtgaacaaaggtctctggttttcccaagcagaggaccctgctgccttccgcagtgtttgtgtccctgggtacttgagattagggagtggtgatgactcttaaggagcatgctgccttcaagcatctgtttaacaaagcacatcttgcaccacccttaatccatttaaccatgagtggacacagcacatgtttcagagagcacagggttgggggtaaggtcacagatccacaggatcccacggcagaagaatttttcttagtacagaacaaaatgaaaagtctcccatgtctacttctttctacacagacacggcaaccatccgatttctcaatcttttccccacctttcccccctttctattccacaaaaccgccattgtcatcatggccccttctcaatgagctgttgggtacacctcccagacggggtggtggctgggcagaggggctcctcacttcccagtaggggcggccgggcagaggcacccctcacctcccggatggggcggctggccgggcggggggctgacctcctacctccctcccggacggggcggctggccgggcagagaaaaccagtcaggcgtggcggcgcgcacctgcaatcgcaggcactcggcaggctgaggcaggagaatcaggcagggaggttgcagtgagccgagatggcagcagtacagtccagcttcggctcggcatcagagggagaccgtggaaagagagggagagggagaccgtggggagagggagacggagagggagacggagagggagagggagagggagagggagagcgattaattgatttttaagggtttttcatgtctctatctctttcagttctgccctgatcttagttatctcttgttttctgctagcttttgaatttgtttgctcttgcttctctagttcttttaattgtgatgttagggtgtcgattttagatctttcctgtgttcttttgtaggcaattactgctataaattttcctctacacactgctttaaatatgtcccagagtttctggtacattattcttattgttttcaaacaacatctttatccttcttcatttcattatttatccagcagtcattcaggagcaggttgttcagtttccatgtaagtgtgaggttttgagtgagtttcttaattctgaattctaatttaattgcgctgtggtgtgagagactgtttgttatgatttccattcttctgcatttgctgaggagtgttttacttccaattatgtggtcaattttagaataagtgcgatgtggtgctgagaagaatgtatattctgttgatttggggtggagagttctatagatgtctattaggtctgcttagtctggagctgagttcaattcctagatatccttgttaattttctgtctcattgacctgtctgatattgacagtggggtattaaaatctcccactattattgtgtgggagtctaagtctccttgtaggtgtttaagaacttgccttatgaatctgggtgctcctgtattgggtgcatgtatatttaggatagttagctcttcttagccactatgtaatggctttctttttctcttttgatctttgttggtttaaagtctgttttatcagagactatgattgcaacccctgtttgtttgtttgtttgtttgtttgtttgttttttgctttccatttgcttggtaaatattcctccatccctttattttgggcctatgtgtgtttttgcatgtgagatgggtctcctgaatactgcacactgatgggtcttgactctttatccatgttgccagtctgtgtcttttaattggggcatttagcccatttacatttaaggttaatatgttatgtgtaaatttgatcctatcattatgatgctagctggttattttgcccattacttgatgcagtttcttcatagcgttgatggtctttaccatttggcatgtttttgcagtggctggcaccattttttcctttccatgcttattgctcccttcaggagctcttgtaatgcaggcgtggtgacgacaaaatgtctcacatttgcttgtctgtaaagaattttatttctccttcacttatgaagcttagtttggctggatatgaaattcagcattgaaaattcttttctttaagaatgttgaatattggcccctagtctcttctggcttatagggtttctgcaagttgatcttcaatctctgatatcctttcttccacttgatcgattcagctattgatatgtgtgtatgcttcactaagttcttgtgctgtgtttttcagctccatcaggtcatttatgttcttctctaaactcgttattctagttagcaattcatctaatcttttttcaagtttctttgcttccttgcgttgggttagaacattctcctttagctcagaggagtttgttattatccacctttgaagcctacttctgccaattcatcaaattcattctccatccagttttgttcccttgatggtgagaagttgtgattttttggagaagaagaggcattctggtttttggaattttcagcctttttgtgctggtttctccccatcttcatggatttacctaccttttgtgtttgatgttggtgacctttggatggggtttctgagtggatgtcctttttgttgatgttgatgctattcctttctgtttgttagtttttcttctaacagtcaggcctctctgctgcaggtctgctggagtgtgctggacatctacttcagaccttgtttgcctgggtatcaccagtggaggctgcagaacagcaaagattgctgcctgttccttcctctgaaagctttgtcccagaggggcacctgccagatgccagctggagctctcttgtgtgaggtgtctgttggcttcttctggaaggtatctcccggtcaggaggccagggggtcagggacccacttgaggtggcagtctgctcaaacactgtgctgggagatccactgctctcttcagagctggcaggcagggatgttaaaatctgctgaagctgcacccacagctgccccttcccccaggtgctctgtcccagagagatgggagttttatctataagtccctgactggggcttctgcctttttttcagagatgccctgcccagacaggaggaatctagagaggcagtcttgctacagcagcctggcagcgctgtggtgtgttccacccagttggaacttccttgcagttttgtttacactgtgagaggaacactgcctactcaagcctcagtaatggcagacgcccctccccataccaagctccagcatcccaggtcaacttcagactactgtgctggcagcaagaatttcaagccagtggatcttagcttgctgggctccatgggggtgggatccactgagctagaccacctggttccctggcttcggccccctttccaggggagtgaatggttctgtctcgctgacattccaggcatccctggggtatgaaaaaagactcctgcagctaccttggtgtctacccaaatggccacccagttttgtgcttgaaacccaagaccctggtggcataagcactggagggaatctcctggtctgtgggttgcaaagaccatgggaaaagcatagtatctgggctggaatgcaccactcctcatggcacagctccttacagcttcccttggctaacaggggagttttctgaccccttgcacttcccaggtgaggcaacaccccaccctgcctcagttcaccctccatgggctgcacccactgtctaaccagtccaaatgagatgagccgggtacctcagttggaaatgcagaaatcacccaccttctgcattgatctcactgtgagctgcacacctgagctgtttctattcagccatcttgtcagcctccccacagatgttatctattaaaaggttgggggtgagttgagaatagctttttcataatatacacacagccttctagaagcagatagtaaatcttcccaaagtgtggcgggcatttcccataggccaaatgtgaggtccttccaggtctggtagaaggaagaccaacagcccaatgcctgctaactgttccacactgtcctcctctgtgcctccactcaccttccaggcctattaaggccattgtctgttgtcctcaggactaggtaagtctcacccagctgggacagagtggtcaccaggacccggatctggcagcgccatggcctaaagaggtggctgagcccgtgtcctgcatcccaagagcaccttcccaatcctcacacccggatagtcaccaagctgcccctgccactcccaccaccacccaaaggcactgcatccaggctcagtggggacttcgtctatacccggcagggtgcggcctgggaaaggccaccaccaccctcagtcactgaggtgtagggggaagggaggcttgctgcatcttcaaggcccaggcacccaccccaagggtcctggtggcagccaccacaagggtcctggtgtcacggggcagaggctacagcctatcctggctcagctcccccactggccagggcaaaggctcagaagtcccagggagctggtcccgcaccatctcaccacactctctgctggattggaactctttattttgttttactttattttattttatttttttgagacagagtcttgctctgttgccccggctggagtgctctgttgcccaggctggagtgcagtggtgtgacctcggcttactgcaaacttcgcctcccgggtttaagtgattctcccacctcagcctcctgagtagctgggattacaggcacgcaccaccatgcccggctaatttttgtatgttcagtagagacagggtttcaccatgttggccaagctggtcttaagctcctgacctcaggtgatccacccgctttggcctcccaaagtgctgggattgcaggcatgagccactgtgcccagcatggaccagaggtcttaattgtatttttgtacccatataccaacctctcttcatccacctctcccagctgtccttctcagactgtggaaagcatccttctactcactgtttccacagatatttcatggacagcaaataatcacatgaaaagatgttcaaaattattaggttttagggaaatgcaaattgaaacaacaataagctatcactactcatctatcagaatggctaaaattaaaaatcatgacaccaccaaatgctggtaaggatgtgtagaaaccggatcactgatacattactgatagaaacataaaatacttcatccactctgggaaattttgggagtttctcaaagaaaaacacacaactatcatatgacccagcaattgcactcccaggcatttatcccagaaaaataaaaacttcacacaaaaaactgtcaaacaaatgtttatagcatctttgtttataatattaatagctaagaactagattcagccaagatgtttttcaacaggtgaatgggtaaacaaactgttgtaaatacatagcatggaatactacttagcaatgtaaaggaatggatgattgatgcatgcaacaacttggatggattgccaggaaattatgctgagcaaaaaacatcaatccaaaaaggttacataaatgtgattctacttttataacattttgttaaataacaaaattttagaagtagaggacagatgactatccactgtgtgaatacttggtgttcctgaaaagggaaccaagaagtggaatcagacaaatttaaagagagtattaaagaaaacttccaaagaccaaagaacacccaagtctttagcctaaaacattcatcatgtccaaagctggttgtacgtatcacttcagtaactgtagatactaggagataatgaagcaaaaccacaaagttttaaagcaatagagatttgacccagaaatgtactacatagcctagttatggatcaaatataaaggcaacataaaaaaagtctccattacccaaaaattaaaaatggcattcaattacccatccccaaatgcagacttgtatatattggctaaatttaacaaataaacttttaaatgtcatgagtgaggaaatcatgatgtaaaatctgactatggacaagaatctatttagaaattgacctatatttaaataataacaattcaaaatgcaattgtaacaattcttgaatattatttaaaacattataataagctggctcagatccaataatatgtccatagaaaccaagccatgggtagtggattgtgtgaggaaacagtgtgataactatgctaacatccgcatcttttatatggtggtattagtagataatgcttctgtgatggttaatactgagtgtcaacttgattggattgaaggatgcaaagtattgatcctaggtgtgtctgtgaaggtgttgccaaaggagattaacatttgagtcagtgggctgggaaaggcagacccacgcttaacctgggtgggcaccatctaatcagctgccagtgcagctagaatatgaaaagttggcagaaaaacatgaaaagactaaactggcctagcttcccagcctacatctttctctggtactggatgctccctgcccttgaacatcagactcgaagttcttcagtttaggacttggactggctctccttgttcctcagcttgcagatatcctattgtgggaccttgtgatcatgtgagttaatacttaataaactttccttcttatatatctctatcctattagttctgcccctctagagaaccctaacacagatttttgtaccaggagtggttctagaggaacagaacattaaggatgcagttctttcattggttttagggtttctggagtggctgtttaatatgattagactcaaaaatgctaaggactctacttctgatagtatggagaacactgattcagtgttcctttctatgaactgtttagagagttaagcaaaataaatgcatttgacattcctgattcagcgctcatgagaggcaaggagtttagtgactctataaataatacctttgaccatatgtggaaacataatgaagttggttggtttctcctaagttcaatggacaaagtgatgaaagaaaatgaacttagggattctaactcctggcttcagaagcagatactgagcctcaaatctgctaagattgccctgagtgaaagtattatctcctgcagagaaagagctgaaattgtgggaaaatggatatgagctcttattgtgcaagtggctgacttccaatgaagggtgcatgcacagcctcaccaggtatgtactattaaagtgagggcatcgtttggaaaagaatgggaccctgcaacttggaaaggggacatgtgggaggaccctgatgaagctggggacactgagtttgtaaagtctcaggaaaccttttttgccagaaaaaaaacagcttccccatccccagtagtggtgacatcctctccctgacccatgctgccatcagcctttccatatttgtctggggagataaacactgtgctgcctaaggcaacagtgatggccccccctgagcagttgccaggcaaaataatgttgattctcctcaggagccacccccaacacccctgtctgcttctagacctataaccagactaaagtccttatgggccccaagaggtgaggttgagagtgaaacccatgaggaggttcactatacttgaaaagaactacttgagttttctaatttatataaacagaaatctggagaacaggcatgagaatggatattaagggtgtgggataatggtggaaggaacatagagttggatcaggctgaatttgttgatttgggcccactaagtagagactctgcatttaatattgcagctcagggagttaaaaaaaggttctaataatttatttgcttagttagctgaaatatggattgaaagatggccactgtgagggagctggaaatgtctgatcactcttggtttaatgtagaggaagggatccaaaggcttagagagattgagatggtggagtggattagtcactttagacctactcatcccagatggaagggcccagaagatatacccttgaccaataccttgcaaaatagatctgtgagggtagcacctgcatctttgaagagccccgtaattctctgcatatcagatccaatggtgagaaccacagtcactcaactaataaaggtaaatacaatgggaataattggatcccaaggtggcagaggccaagtggtggcactcaaccatcaaaggcaaggtgggcataactaccataacagacagtagtggcaaagcagcaatcagaatagtctgactcatgtagagttctggcattcgctaattaatcacagtgttcccagaagtgaaattgttaggatgcctacttctttcctacttaatttatataagcagaaaacttccaggtcaaatggacaaaacactactttgaattataaaaatagagaatcatggcccctcaatcaatttttgacttgagccagtttacagacacagaaccccttgaataaaggggaagttgggtcccattaaggaaggagcccactacactaccaacaatttatgctgttaatctttctcccattttttcccaaggagacctccagccttttatcaaggtaactgtgcattggggaaagggaaattatcagtcatttgggggattacaggacactagctctgagctgacgttaattctaagggactcaaaacgtcattgtggtcctccagttaaagcaggagcttatggaggtgaggtaattaatggagttttagctcaggtctgacttacagtgggtccaatgggtccccaggctcatcctgtgttcatttccccagtgccagaatgcataattggcatagacatacttagcagctggaagaacacccacattggctccctgactggtagggtgaggcctattatggtgggaaaggccaaatggaaggcattagagctgcctctacctagaaaaatggtaaatcaaaaacaatatcacatccctggagggattgcagagattagtgccatgatcaaggacttgaaaggcgcaagggtggtgattttcatcacacccccattcaactctcccatttggcatgtgcataagacagatggatcttggagaatgacagtggattatcataagcttaactaagtggtgactccaattgcagctgctgtaccagatacggtttcattgcttgagcaaattaacacatttcctggtacctggtatgcagccattgacttggcaaatgcctttttctccattcctattcataaggcccactagaagcaatttgccttcagctggcaagactagcaatatatctttactctcctacctcaagagtatataaactctggctttgcatcataatcttatttggagagatcttgaccactttttgcttctgcaagatatcacactggtccattacattgatgacattatgctgatcggatccagtgagcaagaagtagcaaacacactggacttatttgtgagatgtttgtgtgccagaggatgagaaataaatttgactaaaattcagggaccttctacctcagtaacatttctaggggtccactggtgtggggcctgtcaagatactccttgtaagatgaaggataagttgctgcatttggcccctcctacaactaagaaaaaggcacaatatgtagtgggcctacttggattttggaggtaacactttcctcatttgggtgtgttactcaggcccatttatcgagtgactcaaaaggctgccagttttgagtggggtccagaacaggataaggctctgcctcaggtccaggctgctgtccaacctgctctgctgtttgggccatatgactcagcagatccaatggtgcttgaggcatcagtggcagatagggatgctgtttggagcctttggcaggcccccacaggtgaatcacagcagatgcctctaaaattttgaaacaaggccctgccattttctgcatataactactgtgcttttgaaagacagctcttggcctgttactgagctttggtggaaactgaacatttgattatgggtcatcaagtcaccatgtgaactgaactgtctatcatgaactgggtgctttctgacccatgtagccataaaatgggtcatgcacagcagcattccatcatcaaatggaagtgatatatatgtgattgggctcgagcaggtcctaaaggcacaagtaagttacacaaggaagtagctcaaatgcccatggtctccacaactgccaccccaccttctcttccccagcctgcaccgatggcctcatggggagttctctatgatcagttgacagaggaagagaagactagggcctggttcacagatggttctgcacgatatgcaggcaccacccaaaagtggacagctgcagcactacagcccctttctaggacatcactgaagggcagtggtgaagggaaatcttcccagtgggcagaacttcaagcagtgcacctggttgtgcacttttcatggaaggataaatggccagatgtgcgattatatattgattcatgggctgtagccaatggtttggctggatggtcagggacttggaagaagcatgattggaaaattggtgacaaagaaatttggggaagaggtatgtggatggacctctctgagtggccaaaacctgtgaagatatttggatcccatgtgagtgctcaccaatgggtgatctcagcagaggaggattttaataatcaagtggataagatgacctgttctgtggacatcactcagcctctttccccagccacccctgttatcacccaatgggcccataaacaaagtggccatggtggcagggatggaggttatacatgggctcagcaacatggacttccactcaccaaaactggcctggctatggctacagctgagtgcccaatttgacagcagcagagactaacactgagccctcaatatggcaccattcctcggggtgatcagtctgttacctggtggaaggttggttatactggacctcttccatcctgaaaagggcagaggtttgtcctcactgaaacagacacttactctggatatgggtttgcctaaactgaacacaatgctctgccaagactaccattcatggactcacagaatgccttatccaccatcatggtattccacacagcattgcctctgaccaaggcactcactttatgactaaagaagtgtggcagtggatatacgtggagccaagatggctgaataggaacagttccagtctacagctcccagcatgagcgatgcaaaagacaggtgatttccacatttccaactgaggtaccgggttcatctaactggggagtgccagacagtggttgcaggacagtgggtgtagcacaccatgcgtgacccaaagcagggtgagggatcacctcacctgggaagggcaagaggtcagggaattccctttcctagtcaaagaaagcattcacagatggcacctggaaaattgggtcactcctgccctaatattgtgcttttccaatgggcttaataaacagcacaccaggagattatatcccacacatagcttggagggttctacacccacagagcctcactctttgctagcacagcagtctgagaccaaactgtaaggcggcagcgaggctgggggaggggtgcccgccattgcccaggcttgagtaggtaaacaaagcagccgggaagcttgaactggctggagcccaccacagctcaaggaggcctgcatgcctctgtacactccacctccaggggcagggcacagacaaacaaaagacagcaataaccactgcagacttaaatgtccctgtctgacagctttgaagaaagaagtggttctcccagcacacagcttgacatctgagaatgggcagactgcctcctcaagtgggtccctgacccccgaatagcctaactgggaggcaccccctagtaggggcagactgacacctcacacggctgggtactcctctcagacaaaacttccagaggaatgatcaggcagcaacatttgctgttcaccaatatccactgttctgcagcctctgctgctgatacccaggcaaacagggtctggagtggacctccagtaaactccaacagacctgcagctgagggtcctgaattctagaaggaaaactaacaaacagaaaggacatccacaccaaaaccccatctgtacgtcaccatcatcaaagaccaaaggtagataaaaccacaaagatgaggaacaaacagagcagaaaaactggaagctctaaaaatcagagtgcctctcctcctccaaaggaacacggctcctcaccagcaacagaacaaacctggatggagaatgactttgacgagttgagagaagaaggcttcagatgatcaaactactctgagctaaaggaggaagtccgaacccatggcaaagcagttaaaaaccttgaaaaaaaattagatgaatggctaactagaataaccaatgcagagaagtccttaaatgacctgatggagcagaaaaccatggcatgagaactacatgatgaatgcacaagcctcagtagctgattcaatcaactggaagaaagggtattggggatggaaaatcaaatcaatgaaatgaagcatgaagagaagtttagagaaaaaagaaaaaaaaaatgaacaaagcctccaagaaacatgggactatgtgaaaagaccaaatctacatctaattggtgtacctgaaagagacggggagaatggaaccaagttggaaaacactctgcaggatattatccaggagaacttccccaatctagcaaggcagcccaacattcaaattcaggaactacagagaatgccacaaagatactcctcgagaggagcaactccaagacacataattgtcagattcaccaaagttgaaatcaaggaaaaaatgttgagagcagccagagagaaaggtcaggttacccacaaagggaagcccatcagactaacagctcatgtcttggcagaaactctacaagccagaagagagtgagggccaatattcaacattcttaaagaaaagaattttcaacccagaatttcatatccaaccaaactaagcttcataaatgaaggagacataaaatcctttacagacaagcaaatgctgagagattttgtcaccaccaggcctgccctaaaagagctcctgaaggaagcactaaacatggaaaggggcaacccataccagccaccacaaaaacatgccacattgtaaagaccatcgatgctaggaagaaactgcatcaactaactagcaaaataaccagctaacatcataatgacaggatcaaattcacacataacaatattaaccttaaaagtaaatgggctaaatgttccagttaaaagacacagactggaaaactggataaagagtcaagacccatcagtgtgctgtattcaggaaacccatctcacatgcagagacacacataggttcaaaataaagggatggaggaagatctaccaagcaaatggaaaacaaaggcaggggttgcaatcctagtctctgataaaacagactttaaaccaacaaagatcaaaagagacaaagaaggccattacacaatggtaaagggatcaattcaacaagaagagctaactatactaaacatacatgcacccagtacaggggcacccagattcataaagcaagtccttagagatctacaaagagaattagacacccacacaataataatgggagactttaacaccccactgtcaacattagacagatcaacgagacagaaagttaacaaggatacccaggaattgaactcagctctgcaccaagcggacctaatagacatctacagaactctccaccccaaatcaacagaatatacattttttttagcaccacaccacacctattccaaaattgaccacatagttggaagtaaagctctcctcagcaaatgtaaaagaacagaaattgtaacaaactatctctcagaccacagtgcaatcaaactagaactcaggactaagaaactcactcaaaaccactcaactacatggaaactgaacaacctgctcctgaatgactactgggtacataatgaaatgaaggcagaaacaaagatattctttgaaaccaatgagaacaaacacacaacataccagaatctctgggacatattcaaagcaatatgtagaaggaaatttatagcactaaatgcccgcatgagaaagcaggaaagatctaaaattgacaccctaacatcacaatgaaaagaaatagagaagcaagagcaaacacattcaaaagctagcagaaggcaagaaataactaagatcagagcagaactgaaggaaatagagacacaaaaaacccttcagaaaatcaatgaatccaggagctggttttttgaaaagatcaacaaaattgatagaccgctagcaagactaataaagaagaaaagacagaagaatcaaatagatgcaataaaaaatgataaaggggatatcgccactgatcccacagaaatataaactaccatcagagaatattataaacacctctatgcaaataaactagaaaatctagaagaaatggaaaaattcctccatacatacaccctcccaagactaaaccaggaagaagatgaatctctgaatagaccaataacaggctctgaaattgaggcaacaattaataccttaccaaccaaaaacagtccaggacctgaaggattcacagccgaattctaccagaggtacaaggaggagctggtaccattccttctgaaactattccaatcaatagaaaaagagggaatcctccctacctcattttatgaggctagcatcatcctgagaccaaagcctggcagagacacaacaaaaaaaacaattttagaccaatatccctgatgaacatcgatgcaaaaatcctcaataaaatactggcaaaccgaatccagcagcacatcaaaaagcttatccaccatgatcaagtgggcttcatccctgggatgcaagggctggttcaacgtacacaaatcaataaatgtaacccagtatacaaacagaaccaatgacaaaaaccacatgattatttcaatagatgcagaaaaggcctttgacaaaattcagcaacgcttcatgctaaaaactctcaataaattaggtattgatgagatgtatctcaaaataataagagctatctatgacaaacccacagccaatatcatacatcatgggcaaaaactggaagcattccctttgaaaactggcacaagacagggatgccctctctcaccactcctattcaacatagtgttggaagttctagccagggcaatcaggcaagagaaggaaataaagggcattcgattaggaaaagaggaagtcaaattgtccctgtctgcagatgacatgattgtatacctagaaaaccccatcgtctcagcccaaaatctccttaagctgataggcaacttcagcagagtctcagtatacaaaatcaatgtgtaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaaatataaaccactgctcaaggaaataaaagaggatacaaacaaatggaagaacattccatgctcatgggtaggaagaatcaatatcgtgaaaatagccatactgcccaaggtaatttatagagtcattgccatccccatcaagctaccaatgaccttcttctcagaattggaaaaaaactactttaaactacatatggctctccctctccctctccctctccctctccctctccctctccctctccttctccctctccctttctttgtttcttcagtctccctctgttgccgaggctggactgtactgccatggtctcggctcgctgcagcctccctgccctgggctcccatggttcccctgcctcggcctgccgagtgcctgggattgtgggtgcgcgctgccatgccttactggtttttgtatttttggaggagacggggtttcaccatgttgaccgggctggtctccggctcctgacctcgagtggtctgcccgcctcggcctcccagggtgctgggattgcagacggagtctcactcactcaatgctcagtgttgcccaggctggagtgcagtggcgtgatctcggctcaccacaacctccaccttccagccgcctgccttggcctcccaaagtgctaagattacagcctctgcccggccgccaccccgtctgggaagtgaggagcatctcttcctggccgcccattgtctgggatgtgaggagggcttctgcccggctgccccatctgggatatgaggagcgactatgcctggccaccccatctgggaagtgaggagcgcctctgcccagtcgccccatctgggaggtgaggagcacctctgcccagccgccaccccatctgggaggtgaggagcacctctgcccggccaccaccccatctgggaggtgaggagcacctctaactggccacctccccgtctgggatgtgaggagtgcctctgcccagccgccgggtctgggaagtgaggagtgcctctgcctggccaccccatctgggaagcgaggagcgcctctgcccagctgccaccccatctgggaagtgaggagcgtctctgcctggccgcccatcgtctgggatgtgaggagcacctatgcctggccgccccatctgggaagtgaggagcgcctctgcccggctgctctgtctgggaggtgaggagcgcctctgcccggctgccaccccatctgggaggtgaggagagcctctgcccagctgccacccaatctgggaggtgacaagtgcctctgcctggccaccatcccatctgggaggtgaggggcctatctgcccagccacccttcgtctgggaggtggggagcacctctgcccggccgcccttcatctgggaggtgggaagcgcctctgcccggccaccccatctgggaagtgggcgcctctgcctggccatcccatctgggaggtgaggagtgcctctgcccggccaccccgtctgggaagtgaggagcatgtctacccagccaccccgtctgggaggtgaggagtgcttctgcctggccgccccatctgggaagtgaggagcgcctctatctggccaccccttctgggaaatgaggagtgcctctgcccagctgccccgtctgggaggtgaggagcgcctctgcccagccgccaccccatctgggaggtgaggagcgcctctaaccggccacctccccgtctgggatgtgaggagcacctctgcccggccgccaggtctgggaagcgaggagtgcctctgcctggccaccccgtctgggaagcgaggagtgcctctgcccggctgccaccccgtctgggaagtgaggagtgtctctgcctggccgcccatcatctgggatgtgaggagcacctatgcctggccgccccatctgggaagtgaggagcgcctctgcccggccgctctgtctgggaggtgaggagtgcctctgcccggccgccctgtctgggaggtgaggagcacctctgcccggctgccaccccatctgggaggtgaggagagccactgcccagctgccaccaaatctgagaggtgacaagcacctctgcctggccaccaccccatctgggaggtgaggagcacctctgcccggctgccccatctgggaggtgaggggcctatctgcccagccacccttcgtctgggaggtggggagcgcctctgcccggccgcccttcatctgggaggtgggaagcgcctctgcccggccaccccatctgggaagtgggcgcctctgcctggccatcccatctgggaggtgaggagtgcctctgcccggccaccccgtctgggaagtgaggagcgtgtctacccagccaccacgtctgggaggtgaggagcgcttctgcctggccgccccatctgggaagtgaggagcgcctctatctggccaccccttctgggaagtgaggagtgcctctgcccggccgccaccccgcctcggaggcgaggagcacctctgcccggccaccaccccatctgagaggcaaggaccacctctgcctggccgccatcctgtctgggaggcgaggagcacctctgcccagccgccgccccacctaggaggtgaggagcgcctctggccagccgccccacctgggaggcgaggagcgcctctgcctggccgccccatctgggaggtgaggagcgcctctgcccagccaccaccccatctgggaagtgaggagcgtctctgccaggccgccccgtctgggaagtgtacccaacagctccgaagagacagcgaccattgagaacgggccatgatgacgatggcggttttgtcaaaaagaaaagggggaaatgtggggaaaagaaagagagatcagattgttactgtgtctgtgtagaaagaaggtgacataggagacaccattttgttctgtactaagaaaaattcttctgccttgggatgctgttaatgtacaaccttacccccaaccccgtgctcgctgaaacatgtgctgtgtcaactcagggttaaatggattaagggtggtgcaagatgtgctttgttaaacagatgcttgaaggcagcacgctcattaagagtcatcaccactccctaatctcaagtacccagggacacaaacactgctgaaggctgcagggacctctgcctaggaaaaccagagacctttgttcacctgtttatctgctgaccttctctccactattatactatgactctgccacatccccctctctgagaaacacccaagaatgatcaataaatactaaaaaaacaaattaattaattaaataaatttcatatggaaccaaaaaagagcctgcattgccaagtcaatcttaagccaaaggaacaaagctggaggcatcacactacctgacttcaaactatactacaaggctacagtaaccaaaacagcacggtactggtaccaaaacagaggtatagaccaatggaacagaacagagccttcagtaataatgccacatatgtacaactatctgatctttgacaaacctgacaaaaacaagaaatggggaaaggattccctatttcataaatggtgttgggaaaactggctagccaataaatggtgtagggaaaactggctagccatatgtagaaagctgaaactggatcccttccttacatcttatacaaaaattaattcaagatggattaaagacttacatgttagacctaaaaccataaaaaccctagaagaaaacctaggcaataccattcaggacataggcatgggcaaggacttcatgcctaaaacaccaaaagcaatggcaatgaaagccaaaattgacaaatgggatctaattaaactaaagagcttctgcacagcaaaagaaactaccatcagagtgaacaggcaacccacagaatgggagaaaatttttgcaatctactcatctgacaaagggctaatatccagactctacaatgaactcaaacaaatttacaagaaaaaaacaaacaaccccatcaaaatgtgggccaaggaaaagaacagacacttctcaaaagaaggcatttatgcagccaaaagacacatgaaaaaatgctcatcatcactggccatcagagaaatgcaaatcaaaaccacaatgagataccatctcacaccagttagaatggtgatcgttaaaaagtcaggaaacaacaggtgctggagaggatatggagaaataggaatacttttacactgttggtgggactgtaaactagttcaaccattgtggaagtcagtgtggcgattcctcagggatctagaactagaaataccatttgacccagcaatcccattactgggtatatacccaaagtattataaatcatgctgctataaagacacatgcacacatatgtttattgtggcactattcacaagagcaaagacttggaaccaacccaaatgtccaacaatgatagactggattaagaaaatgtggcacttatacaccatggaataccaagcagccataaaaaatgatgagttcatgtcctttgtagggacatggatgaagctagaaaccatcattctcagcaaactattgcaaggacaaaaaaccaaacactgcatgttctcactcataggtgggaattgaacaatgagaacacatggacacaggaaggggaacatcacacactggagcctgctgtggggtggggggttgggggagggatagcattaggagatatacctaatgctaaatgacgagttaatgggtgcagcacaccaacatggcacatgtatacatatgtaactaacctgcatgttgtgcacatgtaccctaaaacctaaagtataataataaaaaaataagcttataaaatgcttttaatgctatataactttataactctgaaagaataatagatttgtattatgctgtcagtgagtaggtctattaagtgataacattaaacacaaataccaccatttataaagtatgattttgatatcatcggttgtgtattttcaccccaaactctgtagatagtaactttgttttctcatttgaccatgctcaatctttagagaccatgctcttctctcaaaatgactgtaggttcatccaagtatgtttgctacccaaaatcaatgaaacacagtcacaactatgtctgtctaggaataaagccagctaattagattcttattctaaggaacaagaagagggcaggtaagaatttgattatggcagaattctgaccataatcaataactgttttctattttttctccatgttgtcgggtggttcatacctgactttcatcatttccaatgattcctgtttgttttgtttataaatttcaaaatcatcatgaaaagtttcactgaatgaaaacctgaaaattgggaaataaacatttttctgcaaaaaaaaaaaaacaatgaacactgacttctcctatttctcaaagtcatctcaaagccatatgaggattaccacaaacttgcaggtgagaaaattctttgcaatgtaagaagtgccatgcaaattagttgatgctattataattagtctcagggatcaaaaatgcttgaaccctaaatctaacacttcaaaggaaagcattatttttcattcattttacaagttacacctcccttcttccccacatctttgtttagaatctggaccctgaagttagaggaccaagattcaaatcccagcctcatcagtactagctatgtgatattgggaatgttacttgatccctgcttatcttactttctgcatttattaaatggggatgagaataatatctacccaaataaggtgcccaatgcagtgcccaacagcatgaagcccaataaaggttagttaacatcacatccataattgacacctttaggtattagattttcatcatcccagaacattttccttctttaagcctttttctttctaagtggcactttcttggatactgattgcactcctcacaaacttgaaacgttcaaacacacaagatgccatttaggagacattggaacttgggtttccttctctgtaaaactgagtaatgacagtcacctcccagggctgttgtaagaatgaatgagctagagtatgtaaaatatcttagcacagagtgcttaagaaattattagttccagccaagcgtggtggctcacgcctgtaatcccagcacttagggaggccaaggcaggcggctcatctggggtcaggagttcaagaccacctggtcaacatggtgaaaccccgtctctactaaaaatacaaaaattagccaggcgtggtggcatgtgcatgtaatcccagctactcaggaggctgagacaggagaatcacttgaacccaggaggtggaggttgcagtgagccgagatcgtgccattgcactccagcctgggcaacaagagtgaaactctgtctcaaaaaaaaaaaaaaaaaaaagaagaagaagaagaaagaaggaaagaaagagagagagagaaagaaagaaagaaagaaagaaagaaagaaagaaagaaagaaaaagaaagaaagaaaagaaagaaagaaggaaagagacagaaagaaagaagggaagaaagaaagaaagaaagaaagaaagaaagaaagaaagaaagaaagaaagaaagaagggaagaaagaaagaaagaaagaaaaaaagaaagaaagaaagaaaaagaaagaaagagagaaagagaaagaaagaaagaaagaaaggagagacagaacgaaggaaagaaggaaggaattatttccctttttcccacccacgcctcaccacaaaccttgttgtggggataacatgtaaaagtgaacaaaactgagaagatcacatcgcatatcactcagcctctagtgggagacacaggcaataaacaggaaaagttaaaaacagtactaggtagtggtgagtgcaattagcctcccgcagcataaagggaggagaataaccagtggctctttcatgcagagaatcagggtagacctctggggagagacccgcactcagactgggatggaattatttattttatgcgtgttcagttaggagtagaggtgctctgtcgtgattatctaatcttgggaggaacaatgtcagacgggtttcaagatgagtatgagaattggtcttccttctgaaaaaacaagaattgagttcacactaatcacaaatacatcaagcctatttgagtcttgtgtgtgtcatggattgaagtgtatctttccacttagtcaagaagttccaatgagaagaatgctccttaacttcctaagtgcaacagagtagttgaactgagccatggatggtaaatctacttaagaaagcacatgccatggaaagatagcattggctgccctgcctacttctgatggcacagccttgcaggaagggaaagaagccaagaggcaaaagcctggtcttgttctgaaaggcacaaggaggtggaagattaggggaaactcacccaaaaatgactcagctctgaactcagactcaagaagccacaataagcaacatgaatggaactggagggaaataaaccaggcgtagaaacacaaatgttgcatattcttactcatgtgggaactaaaaacatgcatttcaaggagaatagaatgatggttatcagagactgggaacagttgtgggtgggggtgttaagagaggttgcttaatgggtacaaacatatagttagatagaaggtataagttctaatgtttgacagcagagtaggagaactatagttaacagtaatatattgtatactccaaaatagctagacaggaagatttgaaatgttcccaacacatagaaatgacaaaagcttgaggtaatggataccctaaatatcctgacttgatcattacacagtctatgcgtgtaacgaaataccatatgtaccccataaatatgtacaaatattatgtatcaataaaaatttttaaaaagaagctgcaatcaacatttcatcattatcttttcagcagcatccttacaaagttacagagacatcttaagatgtatccctcttcctctgaatcttcctgggatagaacaaatgaaaactaaacaaggagtgggctgggaggagctgtcaacatccatcctaaggaaaagtctgttagggctatgagcttcctctgtcctagagtagagctgggaaaatagagtcttgacaattgatttcttattctttctttctctaaatccccaatgaatatgtttttctttttagtgctcagtggtagacagggcttaattctgtttagttatgcaaacaggccagaagaaactgaaataggctataaatgtttgaagctggccaaaagaagatgtagtcacacaagataccctctggaggaaagtgactgtcaggaaagtcactttcctgaccagcaaaaggaccagcactattttgtcctgctgaagaagtacatttgtcctgctgctgtcatggggacagtggctccagggcttcctgtggacatgccacaagttccactccatgagtcaggagatcatgcggtcagctggggggaacttagggttgctctcttgagcttagccttatgctgcgtgtctgctttgccaaccacaaaaacgatagtttcatagcaagttgcaggctccctggaaacttaacctacctactaggatacatttacagctgcttttctcctggcatcaggctggagatcaagaaatacataaaacatagtccctgccctcagttagctcagaatatggtgggggaatggagacagaagcaaatactggtgggacaagtgacgatgggccaaaatatgggcttaaacaaaggttgtgggagctcagaaaaggagcaactcactctgcctgaaagagtcatggagggctccacggaaaaagcaacatttgtgcaggaggagattagaacacagaggagaaggatagcagcactccagatgaagggaaggaaatgtgccaagatttcatgggaatgagaagatgtaaactgctcaggaaaaaccatggttgaagctcttcacagtggctgaagcatggtgtgattgtcagttttgcttgtcaacttggtcaggctgtagtactcaactattcaaccaagcactgatctaggtattgctgtgaaggtattttgtagtcgcaattaacctctacaatcagttgactctatttaaaggacattattctgtactatctgagtggacctgatccacttcatcccaaaggtaaatgattctccaacagtgttctcatctacatctagggcttggaagatgaaggtgaaggagaatatggaaaaacaacaagaaaaaagtcaatcaatcagaacttccagccctgtgtttgttagttcactttatgttcaaccagtatgtctccacttttatctgcttccttgtaagatttcatctgaaaaagggaattcactcttcaggtgttggaaatcaattatgagagaagcacttacagaatgactatctgaagagctctgcagacattctccagagtaaaacaaccataaccggtgaaaattaaaaacaaacaaaataaaaaaatgttagagtattggaaattgttctaagggccgacagcaaatgaagaaatccaagaaagcctaccaatttcagtgagaggagtgagagtctatggtgttgagtctatggtgtttaagttctgttcatttcctccctctcctgcaatcagttcagtgaaacagaaaccctgctccagagatgtgcagccaaaaagacagggtgccctttcccctcagctcccaatctagggcagactaccagcatttcccaagcccatctctggctctatgttgcagaagttctattccaagaaagtttgactgagaatctgaagcttccttcttccactcagcctctactattaaggcgtaagttctatccccagtgccacgggccaagaatactgatgctgaatgtccttgctccgctacactcatagggcagagattccatgggaggagtgaagtttccattccagaaaaggcagaaaaacagaaattactgcccaatccagtaccccacccataaagaaggaaagacatctgagaaaagcatgacactgtccccaaaaccacctgcagagtagtggcagtagaggcagtagggagactagaggacctgcctagagggagaagtaggccataagaagaaaagtctctagttctccctaaagggacaaactttatttgcaacagaacatgcggaagttcaagcctaagggcactgtcaaaaacaatgaatattttggtggtaagcaattaataggttaatggcagcttagtgagagcaacaaactaaaccataaaccagctagacatatacaataaaaatccaagaaagagagagccaagaagggccttcctgaggttaaaacaaacatcaaagtcttgtctgaaaaactgctcctgcaaaggaagcaaaatatatttggatcagactgtggagcaatttatgcccctaaaaagctgtcaaaaccaaaagagcaattatctagcaattgctggaggttaacagttgggtatgataccaaaagaggcaaacaactgaacagatcagagaaagaggcagtcaaagagagcactgctaaatgcactgtaattccaatttgagagaaaatgtgcccagtgctgtgactccctcaggaacaacatcagaggccacaaattatggtggaaataggcttcactatatagtctagccaggcaattaaacaaataaacaattaaacaacagtaacatagtgaggggggcagaaatgagtattgcaactagctagaacatatttttgaacaaaaaaattatgagtcaagcagagatatggaaaagacagagccatacaccagaaaaaaggtaagcaagagaaactgcctttgtgagtgccaagatgtcagacatagcagaaaaaaaacctcaaagtaattattataaatatgttcaaaaactaaaagaaaatgtgcttaaaaaataaaagatggtatgataatttcttgtcaattcaaaaataccaataatagattaaaaatattttttcaaaagttaattaaccaaatggaaattctggggtttaaaagtaaaataacaacaataagaacattttgctagaggaaatgaacaatagatttgtaccagaaggaaaaataatcaaataaacagggatttcatcaacaccaaacctgtcttacaagaaatactaaagggagttcaatctgaaagaaagaacattaacaagcaacaggaaatcatctgaaggtacaaaactcactgtaccttcagatgataataagtcctcaaaaaacacagaatattataacactgtaattatggtgtgtaagctacttatatcataagtagaaagaggaaaagatgaactgattaaaaaacaattacaacagcttttcaagacagtataataagatatataaataacagaaagcttaaaagcatataaataaagttaaaatgtagaggtttttttagttttctttttgcttgattgtgtatttatttatgcaatcagtgttgttttcatcagcataaaataatgggttataagatagtatttgcaagcctcatagtaacctcaaatttaaaaacatacaatgtatacacaaaaagtgaagagcaagaaattaaaacataccaccaaaaaaaatactttcactaaaaaggagacaggaagtaagaaaagatgggagagaagatcacaaaacaaccagaaaataaataacaaaatggcaagcaagtccttatttgtcaataataatattgaatgtaaatggactatactctccagtaaaaagatacagagtggttgaatggattaaaaaaaaggacccaatgatctgttacctacaagaaataaacttcacttataacaatacacagactaaaaataaagtcatgggaaatgatacttcacgacaatggaaaccaaaaaagaacaggagtagctatacctttatcagactaaatagatttcaagacaaaaattgttaagaaaaaccaaataaggtcattatataatgataaagagatcagttaagcaagaggatgtaacaattgtaaatatatatgcactcaacattggagcacctagataaataaaacaaatattattagagctaaagaaagatagaccccctcccccaaaacaataatagctgtagatttcaatgctccactttcagcattggacagatcttccagacagaaaatcagcaaggaaacatcagatgtaatctgaactatagaccaaatgggcctaataagtatttacagaatatttcatccaaaggttacagaagacacatttttctccttagcacatacatcattctcaagaacaggccatatattaggtcatgaatcaagtctcaaaacattcaaaaaaactgaaataatctcaagcatcttctttgaccacaatggaataaaactagaaaccaataacaaggggaattttggaaactatacaaaaacatggaaattaaacaatatgttcctaaatgataagtgggtcaatgaagaaattatgaattgaattgaaaattttctaaaaacaaatgacaatggaaacataatgcaccagaacctatgggatacaacaaaagcagtaccaagagtgatatttccagataagggcctacatcaaaaaggaagaaaaacttcaagtgaataacctgatgatgcatcttaaagaattaaaaaggcaagagtaaaccaaacccaaaattagtagaagaaaagaactaataaagatcacagtagaaataaataaaattggacttctgctccaagatggcctaatagaaacagctccagtctgcagctcccagcatgattggcacagaagatgggtgatttctgcatttccaactgaggtaccaggttcatctcattgggactggttggacaatggatgcagcccatggagggtgaggtgaagcagggtgaggagtcacctcaccccggaagcacaagtgattgggggatttccctttcctagccaagggaagccgtgacagactgtacctggaaaatcggttcactcccacccaaatactgtgcttttcccatagtcttagcaaccggcagaccaggagattctctcccaagcctagctcatcaggtcccatgcccacggagcctggctcactgctagcacagcaatctgagatcaacctgcgaggctgcagctgggtggggggaggggtgtcagccattgctgaggactgagtaggtaaacaaagtggccaggaagctcaaactgggcagagcccaccgcagctcagcaaggcctactgcctctatagattccacctctgtgggcagggcataactgaacaaaaggcagcagacaacttctgcagatttaaacgtccctgcctgacagctctgaagagagcagtggttgccccagcatggcatctgagctctgagaacagacagactgcctcctcaagtgggtccctaaactccatgtagcctaactgggagacatctccccataggggccgacagacacctcatacaggtgggtgccactctgggacaaagctctcagaggaaggatcaggaagcaatatttgctcttctgcaatatttgctgttctgcagcctctgctggtgatacccaggcaaacagagtctggaatggacctccagcaaactccagcagacctgcagctgagggacctgactgctagaaggaaaactaacaaacaaaaaggaatagcatcaacatcaacaaaaaggacattcacaccaaaacctcatctgtagtcaccaatatcaaagaccaaaggtagataaaaccacaaagatggggagaaaccagagcagaaaagctgaaaattctaaaaactgagcaccgcttctcctccagaggattgcaactcctcaccggcaacggaatgaagctgggtggagaatgactttgacaagttggcagaagtaggcttcagaaggtcggtaataacaaactactccaaactaaaggagcatgttctaacccattgcaaggaagctaaaaaaccttcaaaaaaggttagacaaatggctaactagaataaacagtgtagagaggaacttaaatgacctgatggagctgaaaaccgtggcatgaggacatcatgatgcatgcacaagcttaaatagctgattaaatcaagtggaagaaagaatatcagtgactgaagatcaaattaacaaaataaagcaagaagataagattagagaaaaaagagtaaaaagaaatgaaaagcacctccaagaaatatgggactatgtgaaaaaaccaaatctacacttgattggtgtacctgaaagtgatggggagaaggaaaccaagttggaaaacactcttcagaatactatccaggagaacttccccaaactagcaaggcaggccaacattcaaattcaagaaatacagagaacaccacaaagatattcctcaagaagagcaaccccaagacacataattgtcagcttcaccaaggttgaaatgaaggaaaaaaatgttaagggcagccagagagaaacgttgggttaccaacaaagggaagcccatcagactaaaagtagctctctcagcagacaccctgtaagccagaagagagtaggggtcaatattcaacattcttaaagaaaataattttcaacccagaatttcatatccagccaaactaagcttcataagtgaaggagaaataaaatcctttacagacaagcaaatgctgagagattttgtcaccatcaggcctgccttacaagagctcctgaaggaaacactgaacatggaaaggaacaactgttaccagccactgcaaaaacacgccacattgtaaagaccatcgatgacatgaagaaactgcaacaattaactggcaaaataagcagctcacagcataatgacaggatcaagttcacacataacaatattaaccttaaatgtaaatgggctaaatgcctcaattaaagacacagactggcaaattgcatagagtcaagacccatcagtgtgcggtattcaggagacccatctcacatgcaaagacacacatagggatggaggaagatccaccaagcaaatggaaagccaaaaaaaaaaaaaaaaaaaaaaaaagcaggggttgcaatcctagtctctgataaaacagagtttaaaccaacaaagatccaaagagacaaagaaagccattacataatggtaaagggatcaatacaacaagaagaacaaactatcctaaatatatatgcaaccaatatgggagcacccagattcataaagcaagtctgtagagacgtacaaagagatgtagacttccacacaataataatgggagactttaacactccactgtcaatattagacagatcaatgacacagaagggtcacaaagatatccaggacttgaattcagctattcaccaagtggacctaatagacatctacagaactctacaccccaaatcaacagaatgtacatacttctcagcaccacatcatacttattctaaaattgaccacataattggaagtaaaacactcctcagcaaatgtaaaagaacagaaatcacaacaaactgtgtctcagactacagtgcaaacaaattagaactctggattaataaactcactcaaaatcacacaactacatggaaactgaataacctgctcctgaatgactactgggtacataatgaaatgaaggcagaaataaagatgttctttgcaaccaataagaacaaagacacaacataccagattctccgggacacatttaaagcagtgtgtacagggaaaattatagcactaaatgcccacaagagaaagcaggaaagaactaaaatcaacaacctaacatcgcaattaaaagaactagagaagcaagagcaaacacattcaaaagctagcagaaggcaagaaataactaagatcagaacagaactgaaggagatagagacacaaaaagcacttcaaaaaaatcaatgaatccaggagctggtttttaaaaagatcaacaaaattaatagaccgctagcaagaataataaagaaaagagagaagaatcaaattagactcaataaaaaaagataaaggggatatcaccactgatcccatagaaatacaaactaccatcagagaatactataaacacctctacataaataaactagaaaatctagaagaagggggaggagccaagatggccaaataggaacagctccagtctacagctcccagcgtgagtgacacagaagacgggtgatttctgcatttccatctgaggtaccgggttcatctcactagggagtgccagacagtgggcacaggtcagtgggtgcgcgcactgtgtgcgagccaatgcagggtgaggcgttgcctcactcgggatgtgcaaggggtcagagagttccctttcctagtcaaagaaaggggtgacagatggcacctggaaattcgggtcactcccacctgaatactgcacttttccaacgggcttaaaaaacggcgcacctggagagtatatcccgcacctggcttggagggtcctatgcccacggagtcttgctgattgctagcacagcagtctgagatcaaactgcaaggcagcggcgaggctgggggaggggcgcctgccattgcccaggcttgcttaggtaaacaaagcagctgggaacctcaaactgggtggatcccaccacagctcaaggaggcctgcctgcctctgtaggctccacctctgggggcagggcacaggcaaacaaaaagacagcagtaaccactgcagacttaaatgtccctgtctgacagctttgaagagagcagtggttctcccagcacgcagctggagatctgagaacgggcagactgcctcctcaagtgggtccctgacccctgacccccgagcagcctaactgggaggcatccccgagcagaggcagactgacacctcacacagccgggtactccaacagacctgcagctgagggtcctgtctgttagaaggaaaactaacaaacagaaggacatccacaccaaaaacccatctgtacatcaccatcatcaaagaccaaaagtagataaaaccacaaagatggggaaaaaacagagcagaaaaactagaaactctaaaaggcaaagcgcctctcctcctccaaaggaatgcagttcctcaccaggaatggaacaaagctggacggagaatgactttgacgagctgagagaagaaggcttcagatgatcaaattactccgaactacgggaggacattcaaaccaaaggcaaagaagttgaaaacgttcaaaaaatttagaagaatgtataactagaataaccaatacagagaagtgcttaaaggagctgatggagctgaaaaccaaggctcgagaactacgtgaagactcaggagccgatgcgatcaactggaagaaagggtatcagcgatggaagatgaaatgaatgaaatgaagtgagaaggaaagtttagagaaaaaagaataaaaagaaatgaacaaagcctccaagaaatatgggactatgtgaaaagaccaaatctacatctgattggcgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaacaccaagacacataattgtcagattcaccaaagttgaaatgaagggaacaatgttaagggcagccagagagaaaggtcgggttaccctcaaagggaagcccatcagactaacagcggatctctcggcagaaactctacaagccagaagagagtggtggccaatattcaacattcttaaggaaaagaattttcaaaccagaatttcatatacagccaaactaagcttcataagtgaaggagaaataaaatcctttacagacaagcaaatgctgagaaattttgtcaccaccaggcctgccctaaaagagctcctgaaggaagtgctaaacatggaaaggaacaaccggtaccagccgctgcaaaatcatgccaaaatgtaaagaccatcgaggctaggaagaaactgcatcaactaacgagcaaaacaacctgctaacatcataatgacaggatcaaattcacacataacaatattaactttacatgtaaatggactaaatgctgcaattaaaagacacagactggcaaattgcataaagattcaagacccatcagtgtgctgtattcaggaaacccatctcacgggcagagacacacataggctcaaaataaagggatggaggaagacctaccaagcaaatggaaaacaaaaaaaaggcaggggttgcaatcctagtctctgataaaacagactttaaaccaacacagatcaaaagagacaaagaaggccattacttaatggtaaagggatcaattcaacaagaagagctaacaatcctaaatatatatgcacccaatacaggagcacccagattcataaagcaagtcctgagtgacctacaaagagacttagactaccacacattaataatgggaaactttaacaccccactgtcaacattagacagatcaacaagacagaaagtcaacaaggatacccaggaattgaactcagctctgcaccaagcagacctaatagacatctacagaactctccaccccaaatcaacagaatatacatttttttcagcaccacaccatacctatttcaaaattgaccacatacttggaagtaaagctctcctcagcaaatgtaaaagaacagaaattataacaaactgtctctctaaccacagtgcaatcaaactacaactcaggatgaagaaactcactcaaaactgctcaactacatggaaactgaacaacctgctcctgaatgactactgggtacacaacgaaatgaaggcagaaataaagatgttctttgaaaccaatgagaacaaagacacaacataccagaaattctgggatgcattcaaagcagtgtgtagagggaaatttgtagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaacagagacaaaaaaaacccttcaaaaattaatgaatccaggagctggttttttgaaaggatcaacaaaattgatagaccgctagcaagaataataaagaaaaaaagagagaagaatcaaatagatgcaataaaaaatgataaaggggatatcaccaccgatcccacagaaataaaaactatcatcagagaatactacaaacacctctatgcaaataaactagaaaatctagaagaaatggataaattcctcgacacatacactctcccaagactaaaccaggaagaagttgaatctctgaatagaccaataacaggagctgaaattgtggcaataatcaatagcttaccaaccaaaaagagtccaggaccagatggattcacagccgaattttaccagaggtacaaggaggaactggtaccattccttctgaaactattccaatcaatagaaaaagagggaatcctccctaactcattttatgaggccagcatcatcctgataccaaagccgggcagagacaaaaccaaaaaagaggattttagaccaatatccttgaggaacattgatgccaaaatcctcaataaaatactggcaaaccaaatccagcagcacatcaaaaagcttatccaccatgatcaagtaggcttcatccctaggatgcaaggcttgttcaacatatgcaaatcaataaatgtaatccagcatataaacagaaccaaagacaaaaaccacatgattatctcaatagatgcagaaaaggcctttgacaaaattcaacaacacttcatgttaaaaactctcaataaattaggtattgctgggacgtatctcaaaataataagagctatctatgtcaaacccacagccaatatcatactgaatgggcaaaaactggaagcattccctttgaaaattggcacaagacagggatgccctctctcaccactcctattcaacatagtgctggaagatctgtccagggcaatcaggcaggagaaggaaataaagggtattcaattaggaaaagaggaagtcaaattgtccctgtttgcagatgacatgattttatatctagaaaaccccattgtctcagcccaaaacctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaccttacaagggatgtgaagcacctcttcaaggagaactacaaaccactgctcaacgaaataaaagaggatacaaacaaatggaagaacattccatgctcatgggtaggaagaatcaatattgtgaaaatggccatactgcccaaggtaatttacagattcaatgccatccccatcaagctaccaattactttcttcacataattggaaaaaactactttaaagttcatatggaaccaaaaaagagcccgcatcaccaagtcaatcctgagccaaaagaacaaggctggaggcatcacactacctgacttcaagctatactacaaggctacagtaaccaaaacagcttggtactgttaccaaaacagagatatagatcaatggaacagaacagagccctcagaaataatgctgcatatcgacaactgtctgatctttgacaaacctgagaaaaacaagaaatggggaaaggattccctatttaataaatggtgctgggaaaactggctagccatatgtagaaagatgaaactggatcccttccttacaccttatacaaaaattaattcaagatggattaaagacttaaatgtcagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaataggcaacctacagaatgggagaaaatttttgcaatctactcatctgacaaagggctaatattcagaatctacaaagaacttaaacaaatgttcaagaaaaaaacaaccccatcaaaaagtgggcaaaatacatgaaaagacacttctcaaaagaagacatttatgcagccaacagacacatgaaaaaatgctcatcatcactggccatcagagaaatgcaaatcaaaaccacaatgagataccatctcacaccagttagaatgacgatcattaaagtcaggaaacaacagatgctggagaggacatggagaaataggaatgcttttacactgttggtgggggtgtaaattagttcaatcattgttgaagacagtgtggcaattcctcaaggatctagaactagaaataccatttgacccagcaatcccattactgggtatataccgaaaagattacaaatggtgcaactataaagacacatgcacacgaatgtttattgtggcactattcacaatagcaaagacttctaacaaacccagatgtccatcaatgatagactggattaagaaaatgtggcacatatacaccatggaatactatgcagccataaaaaaggatgagttcatgtccttttcagggacatggatgaagctggaaaccatcattctcagcaaactatgacaaggacagaaaaccaaacaccgcatgttctcactcatagatgggaactgaacaatgagaacacttggacacagggcagggaacatcacacaccagggcctgttggggggtggtggactgggggagagatagcattaggagaaatacctaatgtaaatgatgagttgatggatgcagcaaaccaacagggcacatctatacctatgtaagaaacctgcactttgtgcacaggtaccctagaacttgaagtataataaaaatgaaaaaaagaaaatgttactagcaaattgtagatgggtatacctaatataactctgcatgtgcactatgtgtctggatacacatggaaagtattcaggcatacacaccaaattgttaaaataaatccccttccaacattaggagtggctggggagcagatggctttcacttccgcacattccatggtgccagggtaataccacatcacaatagtaaatagcaaaaataacaaccttaagtttagattttcttatctaaattttaattctgtgaagaagtttccatttccctttttcacacaggatagtagaatgcagtttagaaagagtgagatcacttgttagactgtacaatttttaagcatcagcgaagtataccattaaacttctctatcaatccattctctaaacttcccaacccaaaaaaaaagaaacacataaaattgaaatgaagaaaacaatacaaaagatcaacaaaaatgaaaggttggctttttaaagagataaacaaaattgacaaatgtttagccagactaagaaaaagagaaggcccaaataaataaaatcagagatgaaaaagcagacattataactgatactgcggaaattcaaaggatcattaatggctactatgagcaactgtatgccaaacattggaaaatattgaagaaatagataaattcgtagacacacgcaacctaacaagattcaaccatgaagaaattcaaaatctgaacagaccaaaaacaagtaacaagatcaaagccataattaaaattttcccagcaaagaaaagcctgagacccaatggcttcactgctgaattctatcaaacatttaaagaactaataccaatcctactcaaactattccaaaaagtagaagaggagggaatatttccaaacttattctatgaggccattactgctcctatatcaaaaccaaggacacatcaaaaaaagaaaactataggccaatatctcacatgaatattgatgaatcctcaaaaaatgctagcaaactgaattcaacatcacattaaaaatcattcattatgaccaaatgggatttatcccagggatgcaaatatggttcaacatatacacatcagtcagtgtaacatatcatatcaacagaatgaagaagaaaaaccatatggtcatgttaattgatgctgaaaaagtatttgagagaattaaacatctcttcatgacaaaaaccctcaaaaacactggagacagaaggaacatacctcaacacaataaacagacatatatgacagactcacagctagaatcatactaaatggggagaaactgaaagtcattcctctaagatctggaacaagacaaggatgctcattttcaccagtgttagtggaacatagtactgaaagtcctagctagaacagactagagacagaaataaggggcatccaaactgggaagagagaagtcaaattacctttgttcgcagatggtatgatcttctgtttggaaaaacctagactccataaaaaaatgattagaactgataaattcagtaaagtttcaggatacaaaattaacatacaaaaatcagtagcatttctatatgtcaatagcaaacaatctgaaaatgaaatcaaggaagtaatcccatttcccatttgcaatagctataaataaaattaatataatctcatctcttcaataagtggtgttgggaaaactgcatatccacatacaaaagaataaaattagacccttttaatatacaaaactggacccaagttaatatacaaaaattaacttgaaatgaattaaagacttaaatgtaagatctgaaaccaaaaactcctagagagaaacataggggaaaagctccttgacgttggccttggcaataattttttgggatattacaccaaaagcacagacttttgaaaaaataaacaagtaggactacatcaaactaaaaagcttctgcatggcaaaagaaagtcaacaacatgaaaaggcaacctacagaatggagggaaatatttgcaaaccatatacctgatgagaagttaatatcaaaatatagaaaatatataaggaactcacatatctcaataccaaaaaaataataacctgttttataatgggcaaaggacctgaatagacattttttcaaagaagacacacagatggccaacgagtgcaggaaaaagcgttcaacatcactaatcatcagggaaatgcaaatcaaaaccacaatgagatatcactccacacctgttaggaaagctattatgaaaaacacaagagacaatgaatattggcaagggcatggagaaaaaagaacccttgtacactgttggtagaaatgtaaattgcaacagcctttatggaaaatagaatggaggttcctcaaaaaataaaaatagaactaccatacaatctagcaattccacttatgagtgtacatccaaaggaatcaaatcactatgtcaaagagatatctgtacttccttgtttattgcagctttactcacagtagccaagataaggaaaaaatctaaatgtccatcaacggataaagaaaatggggggaggggtgtgcatgtatacatacacaatggactatttttcagccataacaaagaaggaaaccctgccatttgtgacgatatgaatgaacccagaggacattatgttaagtgaaataagccagacacagaaatacaaatattgtatgatctcatttatatgcgaatctaaaaatttcaaacttgaagacgaataagtagaacagtatttatcaggagctaggggatgtggggaagaagcaaaatattgggcaaagagtataaactttcagttatgagatgaaggccaggtgcgatggctcatgttggtaatcccaatactttggaaggctgaggcagagggattgcttgagaccagcctaggcaagaaagtgagacctcatctctacaaaaaataaaaataaaagaatcagctgggagtggtggcatacacctgtagtcccagctagtcaggaggctgaggggggaggatcatttgaaattggaaagtcaaggctgcagtcagccaagatagtgccactgcattgcagcctgggtgacagagcgaaaccctgtctcaaaaaaaaaaaaaaaaaaaagatgaataagttctggggatcaaatgtacagcatggtgactatagtttataactgcgttattacttgaaattggataagagcagattttaagcatccccagcacccccccaacatacacacacacaaatggtaactataggtggtgatagatatgttaatttgactgtgacaatcagcattcaatatatacatatatcaaatcatcacattttaccccttgaaatagaaactttgatttgtcaatcaaatattttaaaacgaaaataatcataatattaatatagcatacaggaaaaaatttcgtatctcgactgatacagaaaatttcatgataaaaacactttaaaacaaaagaaataaaagggaactccctcaacctgataaatggcatctgtggaaacccccagctagcatcaaacttaatacagaaaggctgggtgttcacctcttgaaccaggaacaagacaaagatgcctgcttttgccacttccatttgaccttgtactgaggttctggctagggcaattatccctgaaaaagaaataaaaggcttccaaataaaagaagaagtaaaactatctctactcgctcatgacatgatcttgcatatagaaaatgtgcacatgtacacacacacaaaccattagaactaataaacaagttcagcaagtttgcagaatataaaatgaatgtacaaaaatcaagtgtttttctatatactagcaattaacaatctcaaaatgaattaaaattccatttacaatagtatcaaacataaattatttagaaataaaaagtgcactgaaaactacaaaatattttgaaataaatcagaaaagatttaagtaaatggatcacttgaacctgggaagcagaggttgcagtgtgccgagattgtaccactgcactttagcctgggcaacagagggagactccaaagagtcgaaaagaaaagaaaagatttaaataagctgaaacatattctatggatcagaagacttaatattgttaaagtgacaatattccccaaattgatctacagcttcaactcaacccctatcaaaatcctagcttgctttttggctgaaattgacaagctgattctataatttatatggaatctcaaaggatccagaataaccaaaacaatattgaaaaataaagaacagcgttggtggattaacattttccaatttcaaaacttactatagcactgcggtaatcaagcagtgtggcactgtatagcatgtacattacagatcagtggactagaatcaatgtccagaaataaaccgttatgtttataatgaattactttttaataaggtgtcaagacaacgcaatgggaaaagaataatgaattcaacaaatgatgcatggacaaccggacatgcacatgcaacacaatgaatttgaattcttctatcgctccatgcataaaaactaactcaaaatgggtcacggatgtaaatgaaaagctaaaactataataatcctagaggaaaacctaggagtaaatctttaagatgttattgtaggcagtggtttctcagataggaccccaaaatcacaagcgacaaaagaaattggacttaaagttaaatacttttgtgcttcaaacatcatcaagaaagtgaaaacacaacccgcagaagcaataaaaatgtctgtaagtcatgtatccgattagagacttctatccaggatatataaataatgcaattcaatgataaaaaagataaatagcccagttttccaaagagtcaagcatctgaatatacatctctccaaaaatatacagatatccaacaagcatgtgaaaagatgttcaaagccatttgccaggtgcacaaacccaagacagtatgaggagatgctacagggactctgctgcttcacagacatgaagcgttggtgagaatgtaggcagccgcctttggggacttcacatccccgccgccccacgcacggtgagctagtgtttaaacttagccgagatcaatacacgcgactgtgtgcccgtcagaccctgcgctgccggcggggctgggagaggcgggcgccaggagtgggcgggaacctgggggtcaggccccagccgcgggaagccgcccaggagcgcgcgaaaccttctccacacccttccaggcatttgcccgccgcgattcagagagccgacccgtgacccctggcctcccctagacagccccgcatgtccagatgtgccgtcccgcctgcctcccgcgaccactggccatctctgggcctgggcgcggtctcggcgcccgcctgcccccgccaggagccgcaggtccagccagtgaagaagcccgcgctgaaggagcctctgtgctccagaatccatcctcagtatcagcgctggggtggcctcctccaggaagcccttctgattctctcatgggtcgctcttcctctgcagactcccggagcacccctgctccaagtaccgcaagtggcactgagaacttggggagagcagaggctgtgcctagatttgtagggagtccccgcagctccaccccagggcctacaggagcctggccttgggcgaagccgaggcaggcaggcagggcaaagggtggaagcaattcaggagagaacgagtgaacgaatggatgaggggtggcagccgaggttgccccagtcccctggctgcaggaacagacacctcgctgaggagagacccaggagcgaggcccctgccccgcccgaggcgaggtcccgcccagtcggcgccgcgtgaagagtgggagagaagtactgcgggggcgggggcgggggcgggggcgggggcgggggcagccgggagcctggagccagaccggggcggggccgggaccggggccagggaccagtggtgggaggaggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtgagcgcgggcggggcacgggtggagcgcgggctgaggtgcgtccgggacccggtttggacggcagaggcctgggcgggggcgccgagggcccgtcggggcggcccggacaggactgggggtgtccaggaccctgtcagggagggcagaactgcggtggggcgtgccctgggctcccagtggccggtgggtaccctggtgggcaagcgtccaggacccctcgcggcggccgcgacccctgtcggaaacggagacttcccgcgtgccgcctgcaaggcgtcttccctgggaggagaaggcccaaggtttcccctccacttcaagatctgggctccgaggctccggagcccccttcactgggccgcgtttcttgtgccacctcttccttaggctccttctgcaggtcgcacagggagggagaggcagatgagtcatgctcacagaactctgagggcacctcggagcagccagctgtgagccgtggggaagggtgcacgtcagcgggtccagaggcctgagttctgtccagacatgaccaccagctcactctaccgtctgtctgggcctcagtttccccagctgaaaatggagggttggcttcagtctggtccatgagtcatgggtgagcccaggcccatctggtggctcagacggcacctgggcagcttacattctcaggacagtccccagaggaaattaaagggaaggaacagaacccaggccaggagaggcttttcctaaatggaggggctgcactccctcccagcagaatgtacaccagggaacacttccacgctaggtgtgaggacgcgagggagccctcagcatttggaagctagttcctaatgctgatctggacctgaattccagccccacgactcttttccatgagcatgggcaggtcgcagttctcactgagcctttaatgaagtgcctaatccagtacctggcacagaggaagcgctccgtaaatgactggtaatagtcccagacatactgcaggtgcgcagggaatatcagttcccttccaccccaccccagctcctaactggaccaaaaagatttagactttaccaagctgccttctcaccatttagtttattatttgatcaaaccttgtgaaattgctcataatggacaaatacaaccggcaagttcatgtttcaactgattactcttggataaaatttgtgttttaggtgtgcagagcctaaagtaagtaaaaactactctttttctggattccaagctctccatgggctcgattcctatccaggagcccataccctcgctgtagcacgacatggccctcagccaagttcactagcatcctggcttgagctcccttcaagaagagttaggtgttgagtacaagagcaaccttcagttgcttagttgccccagtcggggaactgaccctgaggactgcggtgccctggagttaatgtgtcgtccatttagggtgatggcaccctctgccatttctgacgcaccttcatttacttccattatttcatggattccccacacctgggggagaaggacagggtacaggctacttcccctttgtaagtgcttcctcctccccattctcctccacacatcataaggttctagaagcacaggccattggtgtgctcacactgcacagcacgggcaccccgtgtgtgctttcctcctgcaggggacatgataacgtggccatagcgggctcttcggacaaagagtgaaggcactgttttgtccactatctccctctctcggtctgtcttcccctaccctgagaagtcattcaaatgacattataattaaacacctcagccggaatcccaggggcaaatttcaggagagatttgcatgtcacatttccattgggttgagagggctataagtcaggggtggggcggggggtggttgggggtgggggctaccgcagggtggggaaccagctaaggctgaaagtttccttgaaaaaatcagcttttgagaaagttcctgttgatgcaaagttactcaacactttctcttgcccagcccagaactacttcctcattctcccagcttggtatctgtaaagacaatcatcctttttgggtaaaggtaaaagagaaaccctagaggaagtacttgctgagaagacaaggttatcccattttacagggaaaagtgttaaaatctgtattgttaacagtagtaacgataacaataacaataaaggtatttccacacaatttaatcatttccaagttattggcaggtcaacacccccctcctccagggcatagttcagtcaaataatggacaggactgattttttccttgataaagtgagtcacaggtcccttgttattctcatcagagttccgcatagtgattcagtcaggactgggaatcaagtccttcgcaggtgggattatcctataaacggttgtgtcttccttggctcctcactgtctgctggagaaagccgggatcctacacagaatggccctgtttccagaggctaacccaagtctaggcaaatttaacaagttgatttatttctttaactctgtaaatttaaagtaattcagatcggatacgataactgtaacagatctgaagatttctgagaaatcttagttggcccatttcattctgtgctggtacttttaagaaagctaagggcaatagcgtggtgtttaatatatgatacttgaatatgttcaacaagtgtagaaaagtgttataatgattcatgcttcttaagtcagtgagtattcttacattcatgaaaaattaattctagaatacctccttcttgtgaatgggaatatattagtggagcataaatatttctttggtatgaccctcaatccgtctctcatctcccagtctccccctctgagccatcttttccctacattctgccccctcttctgcctcctcttccttcccctgctcccagttccctaaatgccccccgtttctgctctctaccctacaactctcccttcttttttgctctgaattttcctctacactctgtcttccagccacctctcagaggccccttctctgctccctcaatctccggctctctgtcccacattttcccccttctctgccccttggtctccctatccactaccccaatccctctctccgtcccttgttttcctcagctcttccccatagcctccccctctctcatcccgagtctctgttttgtctggcccccaatcttcctctctgctctacagcttcctcctcccacagcccctcattagtccccctccaagatgggtagtctgggggtggggcacacatccttgcttccgcagagagatccgtctccctgtcccagcaacagcagagatctgatgaaagacagatgaaaactttcctaaaatgctgatagaaagctcacatgaaaactgaccaactgactctttgccgaaatattcaaaagctttaaaactacatatccaataaaaagttaaaagcaacaagcaaaatcagcaaagtggccccttgtgaaatgaggccggtgagttgcaggtttcccttgtttctctccagcatctgcaccaccacgccacccacttctgtccccagaaactgtgtccagccttcctcctcccacgtgtgaatcccccggggaccctgccctcccagttccccacatctgaaatgtgctacccatgcccatcctcctactcatctgccctctgaaatctgatcagcccctaaaagctgcctgaaataccctcttatgaagcttttccctgtccttccatgccactccacattgcccctttacactccatccagggtacaaaccagggctcaaagctgggccttctagcttccggttcagggcttttctcaagatgtggccttggggaactgtgggaggaacctgggcttggccatcacacaggtgtaggttctgatcttgaggccaccattgctctctgagcctcagtttctatctgtaaagcaggataatcactcgctcggccattcccaggcccagtgcttcctgagggcctgttggggggtgtccactgttgatagtgcccaccataattcagtgtgtcacctgagaatttaatgtgtcacagcaaatagacaaatatagcatcagcccagtgtacttggcccagagaggagggaggaaggtggccattgtagttccacaaaccttccgaagatattttgcagtttgacacatgtgaccctggtattttcctggaaggaggcctttatctgtcattcttccattagtggcccctgggatgttagaaccacagccatcaagctttgtcttttactccctgagttgggtcaaggctggagccctctgccccttgttcacctcttatcatattcaggcttgaagccagcaccaggaaagtggctgggctggccatagaccagccagactgcaggcctggccccctcctgctgtggaagtccctgtcagatggcagatggagtccttgtaaatctgcctagtgatttcaccccaagtgaaactcaggggctctccaccaggtgcctgcaggtgtaggtagggcagggggccaggagtgtcccagtcccctgtgactgcaccacaggtgtgctggagggtcaccccactgtccactccctcagagaagctgctcagtctcttcgtgtgggtcgtcacccccaggtagacatcgggccctccctgtgggacctgcccagtcctggaatgcctcctcagcccatctccctcccctcttagtccaaggtactgggagcctccctcccatgagagtgtccctgttagctcctcccaccccaccccagctttcctgtcatctatcccctggggacaccttcctccctctccagcccctcagagccataggaaagctacttcccctgcagcagccacactcagaccaggcccgggcctctggtggccgcccctcagtcctcaccgcacacagacttgctctgcctgccccaccagcattcagaatgcctcccactctccctctgtcctcacagccctgtctccagcctttcaggagttccttctgggctttgagtgaaggagtttgaggtcacaggttcagtttcctcctcccatgtgtgctccagttactcggattggcacatgtagtcacgaagtggccgtgacgcaggggcccatgctagctcacaggcggtgtggggcctggtgccctgcaaccccctggattcaggaaggggcactggtggttctgatgcacacaaccggtggcctgtgcctctggagaaaggaggccacccaggatggtgtcatttcattttctcaatggtcctgcaagtgaggggtatctcctttgggtagatgaagaaacagcttcagagaatgaagcaatgtgcccaggccatccagctacttgcctgaagctgggatgtgaattcagagctccagaccccagggcccaccgagccttctacccctcactgccctctccccactcctcggtgggatcaggaatctctgtcttggctcacaacctgcagctaaggcctctgtaaatccctgtggcatgcagggcctggcgtggggcaggcccgacgcgtatccagtcctgggccactcagcccccactctgctcctccagatgggcccgagcccctgagatgctgagactcctgtcccatcagaacctgcccaccctgtccatgatgggcgaggccttgtgtgtggccctgctctcctgaggacaagctgtggcaggaaggctttctcagaggtggcagatgaggctgatactctccctgcaggaggggcattgtcgtggggccgaggctggtccacatgtggctggacccaagacatgtcatcccaccacatgggcctggctcctctgtcatcagaaactgttcctagggcctctggcctagactacagagcacagggaggaagcttccgctttctgaccacaagcgtctggcctcagcgtcagccaccccaaactgctcacggtattcagagccaggaggtttgtggaaaacactcaagttcccattcctcttaggaagccctccaggggtcctcctggcagcttggaggcagggcatggaatggggatgcctgcgctcgcacaaaggatgatacccctcgccccttccactttgccatcatgctgagaactctaggttctgccgccagggataaagttcaagggttgatgaatctggcttagaaagtgccttgcaggggccaggcacagtggctcatgcctgtaatcccagcactttgggagaccgaggcaggtggatcacttgaggtcaggagtttgagaccagcctggccaacatggtgaaaccctgtctctactgaaaatacaaaacttaaccagatgtggtggcaggtgcctgtagtcccagctacttgggagactgaggcaggagaatcacttgaaccctggaagtggaggttgcagtgagccgagatcgagccactgcactccagcctgagcaacacagtgagactccacctcaaaataaaaaagaacatgccttggagggcatcgagtccggggctttccaaacctgctggtcatcagaatgcgtgatgcaatgcctgagcctctcatcccaacttcctgtctgccatccattgctgcagagacaaaagccctccagaagctatggctgttgcctcagagccgcctgtgtcctggaagcaggagcctggcagggagggggccaagcagccttgtcccagaggcctgggcagctgcgctgtacacagcctggggtggtgccttctagctgcaaggctagcctcaccctgccaccagtaatgccacaggtgcagcagagctgcttggtctcactgttctctgggcatcaccatgcagctgtgaactgcaaatgtcccaggacgactcgaatccatgcaagctccctgtatctaagcctcaccattttcactcacttattatccccactgaaaactggaaagagaggaagtggctatgatggaaagacctggggtgtgactccagctctgctggcaagtggcagaggtgggagtcactgagcctcgctgtcttcatctgtggaaggggtggtaactcccctgcactcccagagtcattgtggggatccactgtcagcaagcccatctccagttgtaaaggtctcccacaaggctatcccatgtgggggcagctgcggaccctcactgggcacagcctcgcaggtgcaggcatgagcctgggcatctccccatcctccagcctgagctaagtgcagtcagcaggcgttgccctctgagcagcacagcaccatcctggctcactggattctctctcctcaagggcagggcccaggatttgtccatttctttcacctgcctgggtcgtagcactgagccttgtcaggggcaggccttcagtgaatgtcttgggtaaatgaattcaggagttcatttaaggtgttcatgaagaatcttggctccatgaactgtagtggaggcaaaactccacctcttcccatttcagctaggtctgagaatcggcataagacagattcatgggcgaaagcctacagatttctttaatacaagttgtacgtggcatgggagccctcttaaaaagatgaagaccccaagaagcagttagagtcaatcccccttagatactgcattgaatgaatcatcgtgagatgtgataaggccaaggggcttgggctagggcaggtaactgggcagggaagtgactcgggaggtaagcgttcattgtacaagatctgtttgtatggatttcctttggcttcaacttcccaaccttgatgaaaagagtgttactttccttttggtatagtgaggacatctttcataggggactttcatctcctgcttctaagaaacagcacgaatgtcagagtatcttgcacctgctgtttttttaagtgcttttcattcaacgtagtccctgtgccacagcagcataccttggggtgacaaattcttaacacctccagaacaaaggctcaggagaccacgcatggcctgattgcctgttctccttcccaggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcggtgagcagctcaggccccttctgccccgggcttcccaagaaccgaaagttcttcctgtcctcaaagcactgtagtcataggaggaatgacactgctgtgcaggggcgggaagtgggagggctctgccctgtgcctcgacacacctgcaggaggcatgactttccttgggattcttacaagcccctgagggtggagcgggtggccccaggcctcactgtcgtcatgtcctcactctgcgctacagttctacaggggagggttgtgcccctctttttgtcagtgggtaactagggtccatacaggcagatacctatgggacatgcccctggatgggcacttctctagttgccagggtgtggcatcactttctagttcatagcctgccctccgtgagatcacagtagggctcaggcaagctcagggtgccccatgtgggcctagggagggaaggggtggacaaggagcaccccaagtgccagctctgaggagccatggacaagcctgcaaatcacagttaccagttcttcaacccgaagtctcacctttcgctgaaagaaagaagaacctcaaatctgttccccttactaagatgcccagatgtgcagaccccagttaggaggccattctttgttagggacacacagctgacctggtacagagcatcagagacggacgcaggcgtcaaggtcagccaaggctccctgaatgaaccaccttgcatacccagcctcctagtgtgcctggcaaaatcctacctcacttcgagtcataacccttcagcttgctctcagtttaaacctggaaagataagccttcaaaggccaggcagccaccgtaataagagaaagccactgcttctgccatgacagcgtcaaactctttctctttgccaagtttcctgtagctagtgtgttcttcacgaagtttggtggggtaggtaggaagagatgactgttacccccattttatagctaagaaaactgagacaaaggagaaaaaagttattctgtacctgctgttcttaagctaccaggccacatcccatcgtttctgatgtggaatttgacttaagaaaccaaatttccagaatatttctgaacatggagttaagaggatttttgtccccctacctaatgacaggaaaaaaaatcacaaagttcatttattcctgtggtcaacagaatgtggaaggttgtggacagggcacttctctttttctggtagttagaaaatgctggctctgaaactccctcctgcacatctacccaaggtctcggttatgaagcccttcttcctgcagacccttcagctcatcttggcaaaaaacagatggtacactaggatgagggtttaacaaaggggcatcacaaaggtgtgggcccatgtgcagagggaccatgcagagtgcggggccatcagcaccactagtcctgatgcagggggagggggaaggttgtgggagtaatgcagaagtatcctggagacagcacccttggaggagctgcggccctcagtagaaaggttctggggagtgattggcctctccttcctctacacattccctcctttctggtcagagttcccagtggaaaacccattgaggcatctcattccaatcactttcagggacagcacaggttggagggtgagcatagagaagctgtccagcaagttccattctctctactgctgtaaaaccaacctccttggtaactttaaacagccatttaattttgttcatgctcttgcaggtcaggaatttaggaaaggcttcactgggcagttcatctgtggccatgtagcatcagctgaagggggctgggccttcttctgtcatgtgtctggcacctctaggctccttggcctctctgtccatatggagtctcattctttaaggcttctcacagaatggtgtcctctgggtgcctgcatttcttacatgatggctggcttccaagagcaagttttctaagagacagaaagtggaagctgccaatctcttcaggcttgggcctggaaactggcacactgtaacttccatcatattctactggtccaagcagtcacagagcccacccagactccgggggtgggggtggggatgcagacccccccatctctcaatggaaggaatgtcaaagaatttgtggcctattattattattattattattattttgggacagagtctcactctattgcccaagctggagggcagtggcacgatctcagcccactgcaacctctgcctcccaggttcaagcgattctcctgcctcagcctcctagggagcttggtttacaggctccaggtagccaccaagcctggctaatttttgtatttttactagagaaagggttttgccatgttggccaggctagtctggaactcctgacctcaggtgatccacccggctcggcctcccaaagtgctgggattacagtcatgagctaccatgtccagctgtggccaattattaatccaccacatggcaaaacaaccaatcccttgaacaacctggaaatgaggggggccagcctacaagtgattcaattactcaccatatgatcaccccttaaatctaatatttcaccactacaccttgggtgaacatgaatgtcagagggccattactgtggccccacagatccagagcatctgtgtgaagggacagcttcattaaggcactgtgtcagtccttggaacctgccctgctgagctcttctgccgtcagtccaggctttctcatcctgctgtgctcccagaacttcatcagccattggataaattcttcaaacaccttcgggaccaggggagacagaactattctctttttgaaacttggcatgttgcaattccgcatgtactgacttattcataccagtgaaactgaagagatccagctcctcagagtcaaggtgcccaagagattagctggttccttaaggtagataagagatgatgaatgttgagtgcctccagaattacccccatagccaatgataacagttattgtcaccattaatactcagcttgccttctgtggcctcaagcctcccctcctggctggctttacatccccaggggaggatgcagaggtatcccgttaatattcctttttggaccccagttccaagctcaaggatgaagatgtctcagcctggaagtgctgtcgggtggacagctcagaatgtggcctgagtgtcatctgagaactaactgcgtccaggtctgcaattagatcagtacagaggttgaagcctatagttccagcactttgggtggctaaggcgggaggattgtttgagtctaggattttgtcacaagcctgggcaatgtagagagaccccatctctacaaaaaaaattgaaaattagctaggggccgaggcgggtggatcacaaggtcaggagatcgagaccatcctggctaacacagtaaaaccccgtctctactaaaaatacaaaaaattagctggatgtggtggtgggcaactgtagtcccagctacttgggaggctgaggcaggagaatggcgtgaacctgggaagtggagcttgcagtgagctgagatcatgccactgtaccccagcctgggcaacagagcaagactctgtctcaaaaaaaaaaaaaaaattagccaggtgtggtggtgtgtgcctatagtcccaactacttaggaggctgaggttggggaatcacttgagtcctgaagttcaaggctgcagggagctatgatcatgccactgcactctagcctgggagacagagggagaccctgtctcttaaaaaaaataaaaataaaataaatacaaaataaaatacaaagactcagaggaggggttttagaaacttttatagcaacttaacagaacaattttgtgacttttgcacctaataagaaaaaaaaagacttggattttgaatatctttgggtttttaaaatttcatttttctagtaattaatttttattatattttacaaaaatataataatctgtgttgaaaagtaagttttaaaacacaatgctttaccacgagagctagagaaactattccaggacctgttttcaggagatctgggctccccctattcacagctctatgggctgcgttcacaggcttggccttaagcaatagtttaaagagtggtcatgatatgacctcatctgctctaaaggctctgagaagcagccccgcccttagctacctgctacctgctccaactcctgcagtgagagacggcagcaggacaggctgagagataagatgctctcagagctaggcttagagggaggagcagaaccctcaggccagtgatgactataggcataatgataatgatcattgttcccatccattggcatttactgcgtgccaggcgccgtgtggagggctttcctgcattctctccccaaatgcacaccatgacccggagaagtaggcattatcatctccattttacatgtgagggggtcagggcaactcttggtcacacagcttcagtgacagagcccaagtccaagcacatgtgtctcttctaaagccatctaggacactgcactcttttagaatggagctcattctcaatcctctgtgtaggcacgacaggaaaccgggttgtgtcatcgtcacacatttctccatgaaacaatgaaatggacttagaaacataagagctgtgagaactgctgctctcacaggcaacactaaaacccagagtgaactcccgtttttgctcagtataagaatttcagagaagaggagtaaactattctgcagtgatttaaagatacccaccaagggccacgaaatgcctttctcctggagcaaaaaggcagctctgcaccaggggcccttaggtccctgaagagtcttgaggggctgagtggaaggttaggacctcaagtggaaatgcacacgcaggccagagttaggcatgtactgtgcctgccaagcccagtgagaaccaagcctggctcttgcatctgaacatgattctctaagcactgaaaggcaggggccccaaggcttgctgagtgagtgggcaagaggatgaggaactggatttggcttttgtaaagtgagtggctaagagcacaggagttgagttttatgttgaaaattcactaattcagactggttccaagatggccgaataggaacagctccagtctacagctcccaacatgagcaatgcagaagatgggtgatttctgcatttccaactgaggcactgggttcatctcactggggattgttggacagtgggggcagaacagtgggggcagcccattgagtgtgagcatcacctcacctgggaagtgcaaggagtcagggaattccctttcctagccaagggaagtggtgacggacagcacctggaaaattgggtcactcccaccctaatactgtacttttccaacagtcttagcaaacagcataccaggagattatatcccatgtctggctcggagggtcccatgcccacagagccttgctcattgccagcaagctcgaactgggtggagcccatcgcagctcaggaaggcctgccagcctctgtagactccacctctgggggcaggtcatagccgaacaaaaggcagcagaaacctctgcagacttaaatgtccctgtctgacagctttgaagtgactagtggttcacccaacatggaatttgagatctgagaagggacagactgccccctcaagtggctccctgaccccagagtagcctaactgggaggcaccctccagtaggggcagactgacaccccacatggccaggtacacctctgagacaaagcttccagaggagcaatcaggcagcaacatttgctgttcagcaatattcgctgttctgcagcctctgctgctgatactcgggcaaacagggtctggagtggacctctagcaaacatcaacaaacctgcagctgagggtcctgactgttagaaggaaaactaacaaacagaaaggacatccacaccaccaaaaccccatctgtacgtcaccatcatcaaagaccaaaggtaaataaaaccacaaagatggggaaaaacagagcagaaaagctgaacattctacaaatcagagtgcctctccccttccaaaggaaggcagctcctcgcgagtggtggaacaaagctggatggagaatgactttgacgagttgagagaagaaggcttcagatgatcaaacttctcccagctaaagaaggaagttggaacccatcgcaaaaaaagctaaaaaccttgaaaaaagattagacgaatggctaactagaataaccaatgtagagaagtccttaaatgacctgatggagctgaaaaacatggcacgagaactatgtgacgaatgcacaagcttcagtagccgattcgatcaactgtaagaaagggtatcagtgactgaagatcaaatgaatgaaatgaagcgagaagataagtttagagaaaaaagaataaaaagaaatgaacgaagcctccaagaaatatgggactatgtgaaaagaccaaatctacatctgattggtgtacctgaaagtgatggggagaatggaaccaggttggaaaacactctgcaggatattatgcaggagaacttgctcaccctagcaaggcaggccaacattcaaattcaggaaatacagagaacaccacaaagatactccttgagaagagcaactccgagacacataattgtcagattcaccaaagttgaaatgaaggaaaagatgttaagggcagccagagagaaaggtcaggttacccacaaagggaagcccatcagactaacagctgatctctcggcagaaaccctacaagccagaagagactgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagaactcctgaaggaagcactaaacatggaaatgaacaactggtaccagccactgcaaaaacatgccacattgtaaagaccatcaatgctaggaagaaactgcatcaactaatgagcaaaataaccatctaacatcgtaaagacaagatcaaattcacacataacaatattaaccataaatgtaaatgggctaaatgctccaattaaaagacacagactggcaaattggataaagagtcaagacccatcagtgtgctgtattcaggaaacccatctcatgtgcggagacacacataagctcaaaataaagggattggaggaagatctaccaagcaaatggaaaacaaaggcaggggttgcaatcctagtctctgataaaacagactttaaaccaacaaagatcaaaagagacaaagaaggccattacataatggtaaagggatcaattcaacaagaagagctaactatccgaaacgtatatgcacccaatacaggagcacccagatttataaagcaagtccttagagacctacaaagagacctagactcccacacaataataatgagagactttaacaccccactgtcaacattagacagatcaatgagacagaaagttaacaaggatatccaggaattgaactcagctctccagcaagcggagctaatagacatctacagaactctccaccccaaatcaacagaatgtacattcttctcagcactgcatcacacctattctgaaattgaccacatagttggaagtaaagcactccttagcaaatgtaaaagaacagaaaccataacaaactgtctctcagaccacagtgcaatcaaactagaactcaagattaagaaactcactcaaaacctctcaactacatggacactgaacaacctgcacctgaatgactactgggtacataacgaaatgaaggcagaaataaagattttctttgaaaccaatgagaacaaagacacaacataccagaatctctgggacacatttaaagcagtgtgtagagggaaatttatagcactacatgcccacaagagaaagcagggaagatctaaaattgacaccctaacatcacagttaaaagaactagagaagcaagagcaaacacattcaaaagctagcagaaggcaagaaataattaagatcagagcagaactgaaggaggtagagacacaaaaatcccttcaaaaaatcaatgagtccaggagctgattttttgaaaggatcaacaaaattgatagactgctagcaagactaataaagaagaaaagagaagaatcagctctccctctcccctctcccctctcccctctctcctctcccatctcccctctcccctctcccatctcccctctcccctctccctctccctctccccacggtctccctctccctctccccacggtctccctctccctctctttccacggtctccctctgatgccgagccaaagctggactgtactgctgccatctcggctcactgcaacctccctgcctgattctcctgcctcagcctgccgagtgcctgcgattgcaggtgcgcaccgccacgcctgactgtttttcatatttttttggtggagacggggtttcgctgtgttggccaggctggtctccagctcctaaccgcgagtgatccgccagcctcggcctcccgaggtgccgggattgcagacggagtctcattcactcagtgctcaatggtgcccaggctggggtgcagtggcgtgatctcggctcgctacaacctccacctcccagccgcctgccttggcctcccaaagtgccgagattgcagcctctgcccggccgccaccccgtctgggaagtgaggagcgtctctgcctggccacccatcgtctgggatgtaaggagcccctctgcctggctgcccagtctggaaagtgaggagcgtctctgcccggccgccatcctgtctaggaagtgaggagcgtctctgcctggccgcccatcgtctgggatgaagtgaggagcgtctctgcccagccgcccatcatctgagatgtggggagcaccactgccccaccaccctgtctgggaggtgaggagcgcctctgcccggccgccctgtctgagaagtgaggagaccctccgcccggcagccgccccatctgagaagtgaggagcccctccatctgagaagtgaggagcccctccgcccggcagccgccccttctgagaagtgaggagcccctccgcccggcagccgccccgtctgggaagtgaggagcgtctccgcccggcagccaccctgtccgggagggaggtggggggcggtcagccccccgcccggccagccgccccgtccgggaggggaggggttcagccccccgcccggccagccgccccgtccgagagggaggtgggggggtcagccccccgcccggccagctgccccgtccgggaggtgaggggtgcctctgcctggccacccctactgggaagtgaggagcccctctgcctggccaccaccccatctgggaggtgtagccaacagctcattgagaacgggccatgatgacaatggtggttttgtggaatagaaaagggggaaaggtggggaaaagattgagaaatcggatggttgctgtgtctgtgtagaaagaggtagacatgggagacttttcattttgttctgtactaagaaaaattcttctgccttgggatcctgttgatctatgaccttacccccaaccctgtgctctctgaaacatgtgctgtgtccactcagggttaaatggattaagggcagtgcaagatgtgctttgttaaacagatgcttgaaggcagcaggctccttaagagtcatcaccactccctaatctcaagtacccagggacacaaacactgcggatggccgcagggtcctctgcctaggaaaaccagagacctttgttgacttgtttatctgctgaccttccctccactattgtcctatgaccctgccaaatccccctctgcgagaaacacccaagaatgatcaattaaaaaaaaagaaaaaaaaaagaagagaagaatcaattagacgcaataaaaagtgataaaggggacatcaccacggattccacagaaatacaaactaccatcagagaatactataaacaactctaagcaaattaactagaaaatctagaaaaaatggataaattcctcgacacatacaccctcccaagactaaaccaggaagaagttgaatccctgaatagaccaataacaggctctgaaattgaggcaataattaacagcctaccaacccagaaaagttcaggaccagatggattcacagccgaattctaccagaggtacaaggaggagctggtaccattccttctgaaactattccaatcaatagaaaaagagggaatcctccctaactcattttatgaggccagcatcatcctgataccaaagcctggcagatacacacacaaaaaaaacaattttagaccaatatccctgatgaacatcgatgcaaaaatcctcaataaaatactggcaaaccgaatccagcagcacatcaaaaagcttatccaccaggatcaagtgggcatcatccctgggatgcaaagctggttcaacatacacaaatcaataaatgtaatccagcatataaacagaaccaaagacaaaaaccacatgattatctcaatagatgcagaaaaggcctttgacaaaattcaacaaccattcatgctaaaaactctcaataaattaggtattgatgggacgtatctcaaaataataagagctatttatgacaaacccacaaccaatatcatactgaatgggcaaaaactggaagcattccctttgaaaactggcacaagacagggatgccctctctcaccactcctattcaacatagtgttggaagttctggccagggcaatcaggcaggagaaagaaataaagggtatttaattaggaaaagaggaagtcaaattgtccctgtttccagatgacatgattgtatatttagaaaaccccattgtctcagcccaaaatctccttaaagctgataggcaacttcagcaaagtctcaggatacaaaatcaatgtgcaagaatcacaagcattcttatacaccaataacagacaaacagagagccaaatcaggagtgaactcccattcacaattgctacaaagagaataaaatacctaagaatccaacttacaagggatgtgaaggacctcttcaaggagaactacaaatcactgctcaacgaaataaaggaagacacaaacaaatggaagaacatcccatgctcatggataggaagaatgaatatcataaaaatggccatactcccaaggtaatttatagattcaatgtcatccccatcaaactaccaatgactttcttctcagaattggaaaaatctacgttaaagttcatatggaaccaaaaaagagcccgcattgccaagacaatcctaagccaaaagaacaaagctggaggcatcatgctacctgacttcaaactatactacaaggctacagtaaccaaaacagcatggtactggtaccaaaacagagatatagaccaatggaacagaacagagccctcagaaatgacaccacacatctacaaccatctgatctttgacaaacctgacaaaaacaagcaatggggaaaggattccctatttaataaatggtgctgggaaaactggctagccataggtagacagctgaagctggatcccttccttacaccttatacaaaaattaattcaaggtggattaaagacttaaatgttagacctaaaaccatcaaaaccctagaggaaaacctaggcaataccattcaggacataagcatgggcaaggacttcatgtctaaaacaccaaaagcaatggcaacaaaagccaaaatggacaaatgggatctaattaaactaaagagcttctgcacagcaaaagaaactaccatcagagtgaacaggcaacctacagaatgggaaaaaaattttgcaatctactcatctgacaaagggctaatatccagaatctacaaacaactcaaacaaatttacaagaaaaaaacaaacaaccccatcaaaaagtgggcgaaggatatgaacagacacttctcaaaagaagacgtttatgcagccaacagacacatgaaaaaatgctcatcatcactggccatcagagaaatgcaaatcaaaaccataatgatataccatctcacaccagttacaatggcaatcattaaaaagtcaggaaacaacaggtgctggagagggtgtggagaaatgggaacacttttatactgttggtgggactgtaaactagttcaacctttgtggaagacactgtggcaattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatgtccatcaatgatagactgaattaagaaaatgtggcacatatacaccatggaatactatgcagccataaaaaaggatgaattcatgtcctttgtagggacatggatgaagctggaaatcacccttctcagcaaactatcgcaaggacaaaaaaacaaacactacatgttctcactcataggtgggaattgaacaatgagaacacttggacacaggaaggggaacatcacacaccaaggtctgtcatggggtgggggtaagggggagggatagcattaggagatataactaatgtaaatgacgagttaatgggtgcagcacaccaacatgacacatgtatacatatgtaacaaacctgcacgttgtgcacatgtatcctagaacttaaagtagaattaaaaaaaaaaaaagaaaattcactaattaggtgtgtgaccttgggtaaagttcaagagcaaagctacacaacttccctaagcctcagtttcttcatcattaattggggaagtgctctgaggctcaaatgaggtcatgcacataaagcactcggcatgggcagggcatctgagggaagcctgaacacttggcattgggcattgttattgttcttcctcaggctcctctcatgttgttctttctttacagcaaagttggcccgagatgaccaaattcacattctcaagcaacaccgacgtaaagaactggaaacacggcaaaaacaatatcggtgagttatgacatcagatcgagtggccacggggccatggtttcttctatctcaagagcatggtatgaaataaaccctttccacagtgtatggcctgtcactgctggaaagtcaccaaggcaccagctcccagtgtgggtgcacaatccccaaacttcaccttacctacaactccagacaagagatggagaggagagtaatgaaaataactttggatcaaccatattggcatgtaggaagaatgggcagaaaagcttgagtgtaccttaatgttctccattgtaggggttgcctcttacttcttatgtcttcttataacaattcaattataaaagtgatacatgatcagcaataaaattgacaactcttcagccaactgaccagaggattcaaaccattaaaatgagcaataagagaaaatcaatacagaaattaaaatgaataaaaaaggaaaaatgagactcataaaatgagggaaaatcaatacagaaattaaaattaataaaaaagaatactatgaacaattgcatgccaacaaactagttaaatgaaatgcgcaaattcctagaaagacgcaaactgccaaaactgactcatgaagaaatagttaatctgaataaaacaatcacaaccaaagagattgaattactaattctaaaatttcccacaaatagaagcccagacccagatagcttcactggctaattctatcaaacatttaaagaattaatactgatcttgcataaactcttttaagaaatagaaggaacacttcccaattcattgtctcatacccatattataccaaaactaaaggcatcacaagaaaactataaaccaatatcccttagcaatatagatataaacattttcaacgaaatactagcaaacctaacccagaagtatataaaaggcattaaacaatatgaacatgtgggatttagcccaggaatgcaaagttggtttaacatccaaaaatcaattaattgaattcaccatatcaatagagtaaataacaaaacaaaacaaagtacataatcatttcaatagacatacaaaaaaggcatttgacaaaatccaacacccattcatgataaaacactcaaaaaataggaattgaagaaaatgtcctcaacctgataaaggtttgaaaattcacaattaggctgggcgtggtggttcacacctgtaatcccagcactttgggaggccaaggcgggtggatcacgatgtcaagagattgagaccatcctggccaacatggtgaaaccccgtctatactaaaatacaaaaagtagctgtgtgtggtggcatgcgcctgtagtcccagctactcaggaggctgaggcaggagaatcacttgaacccagaaggcggaggttgcagtgagctgagatcatgccactgcactccagcatggtgacaagcaagactccgtccccccacatacacaaaaaaagaaaattcacagttaacattatacttaatgatgaaaggctgaatccagaaacaggataaagatgttcacttttgctacttctattcaacattgtactggagggtctagccagctcagttagggaataaaaagataagtaaaggcacccacaatggagtacagtaagtaaaactaccacaatttacaaataacatgatcttatatatagaaaatctgaaggcattcaccaaaagaaattattagaactaataaaccaccaagattgcaagatacaagataatcaattgtttttctatacattaacaaccaactatgtgaaataaaagtaagaaaaagttcaatttacaatagcatcaaaaacagtaaacatttatgaataaatttaacaaagtagtctgagacttgtacaatgaaactacaaaacattgtttaacattattaaagaagatctaaataggttgaaagacatttcatgttcatgaatcagaggacttaattttgttaaaatggcaataccccacaaattaatgtacacgttcaacacaacccttatcaaaattctagctgatttctttgcagaaattgacaagctgtcaattctgcaaattcatatggaaatggaagggacccagaatagccaaaacaatcttgataaaaagaaaacaaagatggaggacttgcacttctcaatatcaaaattactacacagctatagtattcaagacaatgtgatatcggcataaggatagatatatagatcaatgaaatagacttgagagtccagaaataagcccttacacttatggccaattaatttttgacagaagcagcaagacagtttaacagagaaagaatagtcttttcaacaaatggtcctagcaaaactggatagccacatgcaaaagaatgaagttggatccttagctcacaccatatacataaattaacacaaaatgagtcaaatacctacctaaatgtaagagctaaaactataaaactcttttaagaaaacacaggagtaaaccttcatgactttggatttgacaaaggactcttgatatgacaccaaaagcatcagcaacaaaagaaaaatagataaagtgataaagtgatgtcatcaaatttacaaacctttatgtttcaaaggacaccatcaagaaagtgaaaagatgaaccacagaatggaagaaatatttacaaattgtatatctgataagggccttccatccataatttataaagaactcttacaactcaataaagacaaatagtccaattaaaaaatgaaaaaaatgagtgaggatctgaatagatatttctccaaggacccattagtcatctaggaaatgcaaatcaacaccacaatgagataccacttgatactaggatggctagaataaaaaaatccgacaagaacaagtgttgacaaggatgtggagaaatcagaaccctcatacactgctggtgggaatgtaaaatggcacagctgcttgggaaacagtctgctagctcctgactgttcaacagagagttacaatatgacagcatttccactcttaagcatattcccaacagaaatggaaacatatgcccacacaaaaacttgtacatgcatgattatagcagcatgacctgtaactatcaaaaagtgtacacaacccaaacgtccattaatggatgaatggataaaatatagtatatctatataatttgaccatgaaagaagaatgaaatactgacacttgttacaacatggatgaatctcaaaaacattatgctaagtgaaagaaaccagtcacaaaagatcatatattgtatgattccttttatatgaaatttctggaaaagaaaaatctgtacagatataaagtagattactggttgcctaggggcagggaatgaggaagtggtcatgggagtgacagctaaaggatacagtgttccttttgccggggatgaaaatgttctaaaactgatggttgtccattgtgtaaaaattaatactaaacatccttgaattgaacactttaaatggataaattttacagtatgtgcattatatttcaataacgctgctagataaatttaaaaattaattcaaaatggatgatagatctaaaagtaagggctaacaacataacactcttggaagaaaacatacaagtaagtcttcataatcttgggttcggcaaagtctcttagatatggcaccaagagcacaggcagcaaaagaaagtagacaagttagatgtcattaaaatgtaaaagatctatgcttcaaaggacatcatcaataaagtgaaaagacaatccacagaatggagaaaatatctaaatcatatgtctgataagggacttgtatccagaatatataaagaactctgacaactcaattttaaaatattctgtacaaaaaaccccgtttaaaaattagcaaaggatttaattaaatagttctccagagaaaatttgtgaatctccaataagcacgtgaaaatatgctcaacattattaatcatcaggaaatttcaaatcaaaaccacaagatacaattctaaccactaaaatggttagaataaaaaagacagatagtaacaagtgctgccaaggatgtggagaaactggaaccctgatgctgctaccggaatgtaagatgatgcagccacttcagaaaacagtttagtggttcctcaaaatctgaaacccagctacaatatgacccagcaattctactcctaggcctctacccaagaatattgaaaccacatgtctatacaaaacttgtacacacatatttatagcaccattgttcacaatagtcaaaaagtagaaacaacctaaattccattaactgaggaatgaataaacaaaatatagtttatccatacaatgggatattttttggcatcaaaaaggaatgaatgccaagcgcggaggctcacacctgtaatcctagcactttgggaggttgagacgggcagatcacttgaggtcaggagtttgagaccaacctggccaacatggtgaaaccccatgtctacaaaaatacaaaaattagccgggcatgttggtgcacgcctgtaatcccagctgcttgggaggctaaggcaggagaatcacttgaacccgggaggcggaggttgcagtgagcctagatcccgccactgcactccagcctgggtgacagagcaagactccatttcaaaaaaagaaaagaaaagaaaagaaatgaactacagatagatgccaaacactgaatgaacttcaaaaatatgctaaatggaaaactcacttacggaagaccccatattgtgtgattctatctgtatgaaatgtccagaataggcaaacccacagagtcaggttagtaggtgagtagttgcctagcactaggagttggggaggggaaacaaggagtgaatgttaatgggttcgaggtgtcctctggggatgagattatttcagaattgggttataatgatggttacacatacaactctgcaaatatattaaaatcttttgatagcatatttttaaggggtgaatttaatggtatgtaaatgtatctcagtaaagctttttggaagataataacacattacagagtgctcctctggaaatgggtggctgatgggctgtatccagcctctacaagtgtttgatggatcattattgacttatgagtaaacagagatattcttcaggcttccccagtccacacttgtctgttgtctatatcaaggttttctttcatttcatttcctgctttggcccctggaaacatttgagtctgtgcctccttccaagggaagaaagtggaaggaatcattctacatggacagtgaagttacctgggctgtggaggggcctttgggagccaatattgtgatacttttctacatatccctcaatagttgaacttcttacaaggaatatgtagtatatctgggttgtttttttaactcaaaaaagtaaaagaaggaaaataatatagagccagaaaaatacctattttctgtatgaattatgaattttatgaactttttcataaaaattcatgtttaattgttttcactttgtcttattcactttttaaaatttgggattgtgctatatataccactttgcatcctccttgctgccctttagcagtgtagcaaaaatcattttcccatattttcaaaatctcatcataaacattattctagtttctatgtactattccattggatggatgcctcatcattcacttaaacacccagcttccctggacatttaggaggtttctaatttttgtattcttataagcaaagtgaaaacccttgtatgtgaaatttgtatacattattaagtattttcctaggacagatgcccagatatgaaattaccaaatagtaaaagttattagtatacattgacaaatttctcctcaaaaatctttaaccatttgggaggctgaggtgggtggatcaccaggtcaggagatcgagaccatcctggctaacacggtgaaaccccgtctctactaaaaaatacaaaaaattagccgggcgtggtggcgggcgcctgtagtcccagctgctcgggaggctgaggcaagagaatggcgtgaacctgggaggcggagcttgcagtgagccgagattgcaccactgcactccagcctgggcgacagagcgagactccgtctcaaaaaaaaaaaaaaaaaaaatctttaaccagttttcacgagccatgtatgggtccctgtttcatcaaacacttgccataactgagcaatatcttcatttttcttaatttttctaagttgcaacagcatccctcaaccctgtagctccttcttcccctatgcccagccacccactgctgtcaaggggtgagaaatcccacaccaagaacacaattgccccacctcaaaactgtcttagcttcatcccccttttcatcaaaaacattccttgaaacagaataaagaaacaacaaacagccacacgtatgtgggtactgggtctgctacggagggctcggctgatgggtggcactgggccactggacatgcatctcgaggacaggggccagccagcacggagggctgaaggagaaggagaagaaatcagactccacctcttgccattcaggagactcagcttggggttgattagacttaaaagttaaaggcaaaactgtaagacatttagactacaggtgattattcttccaggtctcaagctaaaaggatttttcaaacaagactcagaacatattaaacacaaaggaaaagattggtaagtttgcctccctcaagataaggacactctgttcattgaaagacaccaggagagagtgaaggcaagtcatggagtgattgacgagaattattcctagtatgtgaaggacctacaaatctttaagaaggggagtgtcattcactagaaaatgggcaagaagtttgagtacttactgtacaaaatataagcagcaagtatacaaaaggtgttcaacttcattaggactcggggaaatcagaagatcacagtgaactgctgctactaccacacatatgcccccagatgggcaacacttcaacaactgacaacacctgagtattaaagaagatccagagggctgggaacactcatataccaccggcaggaggacaagttggtaagacctccgtggaaaacaatttagcaatatgtcataaaactgaagctacattataatctatgacccagaaatcctatagtgggatccaaatttgtgtgcatgtgcgcctggatactcacaacagcattactcatgatggccaaaaaatggcaacaactcaatgtccaacaaacagtagaacagacaaattgtcaaggaaaattctacactgcaaggaaaatcaacaaactgctgctaacatggacaaacctcactgacgcagtgttgaaggaaagaagccaggagcgtgtctggccaattcataactttggaatgaaattgtttagggaggtgtgtcatagcggaaccttaaacaataacaagaaaatgattatcataaagccgaggatggtcattaccggggatggaaggagggttgattgggaaaggtgggggtgagggtacggacaatgttctgattttttacctggatggtgttcgtacaggtgttttgtacatttttctgcatgtgtgagtgtgtgtgtgcatatatacatatccatacatattttatatattctatttcccaattgaaaaatcaaaaataaaacttacatgccattagcatcaagtgtgggagagtaacctgctgtgctgtgggtcatgttaagggtttataaatgtgtgatttgttttagagtatttgtgcacaagcctctcagctcaggcaccatatgatgtgtttccagacttccatacctggtgcagtgcacacgttgtgcttgagctctgcctcccatcccaaagggctgttgtttctatgcttcttccttggcttccctccctgtttcagacacctatggcaaagcccctgcagccagttctcagagcacttctggcctgtgaatctgggttaagataaaatgcccataaaattcatttaatttgttataagccactaacactttagtatgaattagtggggctctaattagactttgctatctactcatctaagataacacaaactagcccaattatctgggagctacttaacattatcataatcttgcagcagggggcttctggtgagatcgtttccccctttcttagatttaatcatttttttcttcctccttccactcatctgtccttttcagaaaccctcctttgcttccgttcaggaaacactgaactttgcactgtctgcacaatcttggagttcctctttctcagaagatttctcaggcttccagatcagagtttggaagtaaagcaatgactaagaatagtccacactatgtcagaaagctggcgcttcttgcaggccctccttactcactcagccacgcagggagaaggagaagcagacccaggtcatagcccacagcttgtgctctcccactgtgaccacatctgtctgtgttacatgcacactcacacacagcagtaaatggcaaagtgtaggtgtttgttaatcgatataatttaatctaatcattatgtgacctgcacttttcactcatcactaagtattgaagaggatctggttgacacagatagatgtggttcatgcagttaacttcttcatggcatatcagtatctgaataacccatgcgctcgtccgctctcctgctgatgggcaggcgggctgtctttaatttctagctgttgcaaaccaagcgacagtgagctttctcacacatctctctgtgctctcatggaagagttactgtagggaatattccaagaagtagagttgcagggttgcagaccacgtgtttttaagctttctagatattgctgattgttttccaaaggcattctgccagtagacaccccagtaactgtttctgagattcactgtttccctgcatcatcaacacttcgcatcttcagatgttttcattcttgcgtgtgaaatagtatctcatatattttccccttcttaaactgctactatttcttgccttctgggaatgcaccataatttacttagccattcccctattcactgacgttcagttcatttcccatttgtagatgtgtttgtttgttttgggtattgcagtacaaacaatgctgccagaaccaaccttgtacaaacatcttgatgtactggtgctttaattaatggcagatccatttccagaactcagattgctggaacaaatcagcattttttcatcttaagaaataccgacaaaaatcctttcacaaaattgtatcgtaatttgcggtcctaccagctgtgtatgaaaagatacttttgcccatccatacatttgtcagtacccgatgaccttgtttgacagtctaaaaatccctaagaccttgtggttgttttagtctgcactcccctgaccactaataagcatcactgcattgcctatttataagctttttttccctattgttctttcaattattaatctaaaggagctctttctatatcaggatagtatccgtttgttacatatgtatagcatttattatttgtcttctgttgcttttgccacaggagattttagttctttattttattaactatgtattgtttacatctataacttttgggtttcctcctttgcttaagaaaaccctttccatcccagtgttacacaaatacttcccccgtaattttgtctaatacttttataatttcccctttgagtttagagctttcattcatctacctttttttttttttttgagacagagtcttgctctgtttcctaggctggagtgcagtggcatgatcatggttcactgctgcctcaaactaacccaggctcaatccatcttcccacgtcagcctcccaagtagctggggctacaggcgtgcgccaccatgccccactcctgccacgtgttttcatacatacctgggtggaactctcccggtagcattcgttcctgacttggatgacagggatgatgtctttcctcctgacttggatgacagggatgatgatacccacggtacaagctggcataggatggcagtcatgagctctggattcgagtgtctgggctcaactcacacttactggcactttctccagtcctgtgaaagttgtttaatctgtctgtgcctcacttccctcatctgtaaaatgagggaaataacagtgccttccttttaggggtttgagataataggttaaaccatgaaaacacagagaatagtagtaggcacatagaaagcactggataagtgttggcgagttttgtattatgtatacatagtctctgggtctgtttccgcactttatgtgttagcctatttttctactcgagaccccagcaccagcttttggttatcataactttctaataaatgttaatgtctgttacatatctcactgttctttcttaagtttttcataatgagaattactttgaacttcacataactgtgttatgtgttggcattttactgagattcagtctttccatccaggaacacagcgtgtctttccacctctctagatcctgtgtcaacgtacttccatagaatttctagttttcttcatgcaggtccttcacctttctagctactctacatttagcatttgctgttctgagtaggatatttttctgtttgcaaaaatattgctgggataaatgtaaattacttgtttcttacatttactgtgtgttggtcccttactgaattctttcattggttctaatcacttgtttttgtttgtttgttgttagtgagtctggttagttaatgtgctcatattatctaaatgttaataattttgtctcttactttccattatctacaccactgatattcttttcttattccatgtctggaattcccaaaacaagtagtggtagtagtgatgaacatccctctcatatttttgtttctttgtttactattatatttgctgtagttttataatgcatattctttgctgtatttaggagtttattgattcattctaatttaatttttgttcagctgaacttgttcaattaatttcctcagaaggtccatgtgtagtgtaagatctgagtctgtgcttgtcgtcctgtccccctacccatcccctcaaacaaattcccctgccctcattgatgacaatatgagaggcttagatgacgatctaaaaaaagtgtgtatacacttcagtcttcccattttcagaatgacagaggagaaatctaatgatagtttgtttcttttcctagagtttctatctccctccctcccccactttcttcctctctcgttcactctctgcatctctttccttctctctgtctctgtttctcctgtctcttggacattttaaaatgtattcagtatatacctaggtgtatctttttcctttttttttttcccccccacctaggacttgtcattgagaaaaatgacgagacaagtctcaatcattttaggaaatttatttgcgaaagttaaggacgcatgcccgggagacagcactatgcctttctctgaaggtgattttgagggctccaaatttaaagggaaaagggcgggatattgagaagtacacaattttcatgtaagagcagggcagggaaaaatagttattcatgcctttctctggctcagtgaatctgcattttttttaacataagatgacataaacaaatgaggcagaggaaaaatgcagggagtctgcattttacataagagaacatagataaagtaaggcaggggaacaatcagatatgcatttgtatctggtgggtgactgcacttgtaaagataagctatcaatttgcattgccatggtgaaattttaacggttcactaggaatttccttgtgagcaaaatatggtggagacatgtagcttttcatcatagccatcttatttaggaaccaaaagggggaggcaggtttgcatgacacagttcccagcttgacatttccctttggctaaatgagtttggggtcctaaaatttaatttcctttcacagacttaagatattgaagtatttttcagcttaaaggagttcttcttttatttctttgatttttttcacttctccatatattactctctctccttttggagcttttactccttgcatattacatctgtatctggctttcatgtctgttaatgaaaagagtcacactctgtgaaatatttgaaaagacttattctgagccaaatatgagtgaccagtggcccatgatgcagccccaggagatcctgagaacatgcacccaaggtggttggggtacagcttgcttttgtgcattttagggagacataagacatcagtcaatacatgtaagatggacagtggtttggttttggaaaggtgggacaacttgggggaggggagcttccaggtcataggcagattcaaagagtttctgattggcaactgcttaaaagaattattatctaaaaacttggaatgtctaggttaagataaggggttgtggaaacaaagttttttatcatgcagatgaagcctccaggtagcaggcttcaggtagaatcaattgtaaatgtttcttatcaatcttaaagagtctgttctaatgggcttaacatctctgtgttgatgtgaatgctgatcagttgtgcctgaattccaagaggaggagagtacaatgaggcacgtttagccacccattcctatcatggcctgaactaatttttcaggttaactttggaatgcccttggccaaggggagggtccatcagtcagttcaggggcttagaattttatttttggtttatgtctctcatagtttcatttatggcttccatttctttgtagtttcaccctgtatttgggttacatgttcttctattttgcacaaagcacttcctggcacatagtaggtgctccataattagttgtcgaatgaacaccttctctcttctaggtgttaatgagtttagcttaaacttttctccttacatattttaaattcagcctaaaagtttctctgtacatagtgaactgtaacctaactggatgtgtaaacagactgtcacctactctcatagcaagtaaccaagtctcagccaatcacagcggccagacttcagccactcacagtggccagctgttcaaactgggctcaagtaaggcaaatgctgagccatcaccaatctggctgtttctgtacctcacttccattttctgtacatcacgttcctttttctgcccataaatcctatccaactatgagacagcatcaaagtcactcggagcctgctctggtttaggggctgccctattcttgaattgttctttgctcaattaaactgctaaatttaatttgtctaaagcttttcttttaatacaagagaccaaacatctcacagtgattattctctttgtctgtttctctattgaagtcttcattcagaaatcatgtttgtggttacagaaagtctttttacactccaattatactaactgcatccccttaggatctctctgtctgtctgtctctctctctctctctctctctctgtctctctgtctctcttgctttctctctctctctttctctctctctctctctctgtctctctgtctctcttgctttctctctctctctttctctctctctctcattttttttccaataaattaaatgcctttctacttctttgttccttctgcctgggtgttccacttggtcttcctcaatggagtgggattccatctccaccagttaatgtctgtggccatgcaggccttcggctcctgtgcaggtcagcctgtcagggtctcttaagcagcagtgacctgcagtggaagggacataaacatttggtttcaggggggcagtagtgaactagcaagcaagctgtcctgtctccatgtgctgtgaggccatcatcttctaaccacacaagtggggcatttctgcccattggtgctgccaccctccatagaccagggcagggcatggggcaagaaggtctttttggtgctgaagaagtattccacatccgtccaagtggactattcacttaagaaaacattaatgccatttgctggcacagatgcccttgcatggctcattgtttacatactgaaaaacatctagctccactgagcttttaaaattaactagagcccttgaactgtccaggcaaagagaaaatcatcagtaatatttaaattgatatgactaatgatagctaattaattgatcattactaccagtgaggctactgaatggctcaattttagatatatattggagatgccttgagtcattttccaaaacaaacaaacaaaaaatgtgtagacttgtccacatttttatccttgttaatatactatcattggcattaatacaaacagcaaaaatggaaggttttcttaaaatctgaggacgtagaatattctaaataaaccaacagtgagaaatgtaaggtgccacataacagaaaacacttgacaaaatgcctttgctgtcagaaggatcatacccggtccctgttcacttcttgtgatcctaaggagaggctactgggccaagaggacactgtgacagttgggatttggggaaagtcaaagcacaagatcatattaaaataactcaggacttttttaagacccaaaatctcgatattttactttcctctcaaaagaaaattttaaaaggaaggagaattaggaatataaatgaaaaagctaaaaccctaaaatgtaaaatctggtttttaaacaaacacaaaatcattctccctccccaaagaaactaacaggatttcattttgtttttgttaccagaaaggggtcctgatccagaccccaagagagagttcttggacctccacaggaaagaattcagggtgaatccataaagtgaaagcaagtttattaggaaagtaaagcaataaagaaaggctactccataggcaaggcagtagcatgggctactcgactgagcatacttacagtcacttcgtgatcatgtgctaaacaatgagtggattattcatgagttttccaggagaggggtgggcaattccaggaactgaaggttcctcccttttttagaccatatagggtaacttcctgacattactatggcatttgtaaactgtcatggcactggtgggagtttcttttagcatgctaatgcattataattagcatataatgagtggtgaggatgaacagaggtcactttcatcaccatcttagttttgttgggttttggccggcttctttaccacaacccattttatcagcaaggtctttctgccctgtatcttgcatcaatgtcctgtctcatcctgtgacttagaatgcctaacctcctgggaatgctgcccagtaggtctcagccttattttacccagcccctattcaagatggagttgctgtggttcaaacacctctgacattttcacaatttaagtttactcaataagtaaacaaaaaagcaaaataaacatttttcaaaaacacaaatgcccaatgccacgggatacgtttcaaggatgtcaggatctgagcatgtttactggatgcagtccgtggcttgtctttggggaagctgttttgattgtaataatctctaaagctgctattggccagcaggtgagagagggaagccttttagccatctgtgcctgggtccctctcccaggccacctgctgccgtgtcgtcctattgtgaaggcagaagaactgtcccatttccccaaatgccacatgcaggacatgcacgcagtccagggcacacactgatcaagttggcagaatggtggatgtccaggttgggcgtggctgggcagccttaataccttctacctccagtgactggcaaggcaggcctctactgttcaatgtcacctctagtaagtgaggtctccctagactacctacagaactttttatgcagtggtgcacacctgtaccactataagcccagtctcagggttcccactctgatgctcagggcacagcaaagttggtgcgactggactttggaagaggtcccagaaccttactggacacagggtcagcctatgatgtgttgactttattttgagtacatcaatctccctgtgtaacatcgtctgacagtgtgggcggccctcagctgagggggcagaccaaaggctggcatttaactcaatttcttctcctttctcatgctcagatggatggagtggaaccctggcttccccttgagcatcgatgccaaatgccacaaggatttaccccgtgatatccagtttgatagtgaaaaaggagtggactttgttctgaattactccaaagcgtaagtttacgagaactgagggactctgggcagcccctccagtggctggtgctgggggtggaaccctcactcctttcctcatggggtccttgggttgggggaacagcctagctgagccaaacgctttgatgatatgttggccatagagtggattctcaacgcacaattgcaggacaaccggtatcttaaaaaaggcataaccagaggactccagacaccagacatacatgtgtttttggcccaaagcaggggtctttagttggaatgcctcctccccatccatatctcatgctctctatggccacttcaaaggtgtgaaggctttgtgtccaggctgtcaccaagatggcaggtgctatggtaagaatggccaaattgccagtgctgatcccaggacatatgtcccctgttcctccgtcacaaccccacgagggagccacagtcatcatccccattttacagttgaggaactgaggaatacggaggttgactaccttccttgcctaaggcccccagctaataaatggcagagatataggttctgtgcacctttgtttcatccgaatgtccgcagggctttttaaagcttgcccaggctatcgggagactctaggctgcttgttaaacatatggatcccccgaccctatcccaggactactgagtgtagggatctttaaatctgcacattgaccctatagggaattttaaaaatcatgtcagtttggcgaaactattccaatcaatagaaaaagagggaatcctccctaactcattatatgaggccagcatcatcccgataccaaagcctggcagacacacaacaaacaaagagaattttagaccaatatccctgatgaacatcaatgcgaaaatcctcaataaaatactggcaaaccgaatccagcagtacatcagaaagcttatccaccatgatcaagtgggcttcatccctgggatggaaggctggttcaacatacgcaaatcaataaatgtaatctagcatataaacagaaccaatgacaaaaaacacatgattatctcaatagatgcagaaaaggcctttgacaaaattcaacaaccattcatgctgaaaactctcaataaattaggtattgatgggatgtatctcaaaataataagagctatttatgacagacccacagccaatatcatactgaaggagcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgtagatgacatgattttatatctagaaaaccccatcgtctcagcccaaaatctccttaagctgataaggaacttcagcaaagtctcaggatacaaaatcaatgtgcaaaaatcacaagcattcttatataccaataacagacagacagccaaatcatgagtgaactcccattcacaattgcttcaaagagaataaaatacctaggaatccaacttacaagggatgtgaaggacctcttcaaggagaactacaaaccactgctcaacaaaataaaagaggacacaaacaaatggaagaacattccatgctcatggataggaagaatcaatatcatgaaaatggccatactcccaaggtaatttatagatcaatgccatccccatcaaactaccaatgactttctgcacagaattgggaaaaactactttaaagttcatatggaaccaaaaaagagcccgcattgccaagacaatcctaagccaaaagaacagagctggaggcatcatgctacctgacttcaaaccatactacgaggctacagtaaccaaaacagcatggcactggtaccaaaacagacatatagaccaatggaacagaacagagccctcagaaataacaccacacatctacaaccatctgatctttgacaaacctgacaaaaacaagcaatggggaaaggattccctatttaataaatggtgctgggaaaactggctagccatatgtagaaagctgaagctggatcccttccttacaccttatacaaaaattaattcaagatggattaaatacttaaatgttagacctaaaaccataaaaaccctagaagaaaacctaggcaataccattcaggacataggcatgggcaaggacttcatgtctaaaacaccaaaagcaatggcaacaaaagccaaaatggacaaatgggatctaattaaactaaagagcttctgcacagcaaaagaaactaccatcagagtgaacaggcaacctacagaatgggaaaaaaattttgcaatctactcagctgacaaaaggctgatatccagaatctacaaacaactcaaacaaacttacaagaaaaaaacaaccccatcaaaaagtgggcaaaggatatgagcagacacttctcaaaagaagacattcatgcagccaatagacacatgaagaaatgctcatcatcactggccatcagagaaatgcaaatcaaaaccacaatgagataccatcttacaccagttagaatggcaatcattaaaaagtcaggaaacaacaggtgctggagaggatgtggagaagtaggaacacttttacactgttggtgggactgtaaactagttcaaccattgtggaagacagtgtgacgattcctcaaggatctagaactagaaataccatttgacccagccatcccattatcgggtatatacccaaaggattataaatcatgctgctataaagacacatgcacacgtatgtttattgtggcactattcacaatagcaaagacttggaaccaacccaaatgtccatcaccgatagactggattaagaaaatgtggcacatatgcactatggaatactatgcagccataaaaaaggatgagttaatgtcctttgcagggacatggatgaagctggaaaccattattctcagcaaactatcgcaaggacaaaaaaccaaacaccgcatgttctcactcataggtgggaattgaacaatgagaacacttggacacaggaaggggaacatcacacaccagggcctgtcatggggtggggagaggggggagggatagcattaggagatatacctaattaggagttaatgggtgcagcacaccaacatggcacatgtatacatatgtaacaatcctgcacgttgtgcacatgtatcctagaatttaaagtataataataaaaaaaaagacatacacggaaaaaaggaacacaaatccacaggaacagttggtggactgtgcctttttccgaagatgtctttaagggcatcaatatttaaaggagaacaggctggaaggaagaaagggagggcatggtcacgttactgaatccacatgttgcaaaagaaaaggagcaggtaggggaatagtcagttatgtattcctcttgcgcttagtacatcagcacttgataaggtgaacaccaagagctacctgtggaggttttcaccttttatctgtagctatcttcgtttcttgcatcactcagctttcagcttaatttttcccttttggcagagtgaattggggtccaaagattttcatttccttttacacctagaatcctctgaggagcattagcacctgctagtgccaggccaaccccacacccacagatgacagtctatgagggtgggaccctggctttgagtctgcacacccagcaggtagacgaggctgagaacccagccagacttcaaagcttaaaataatattatttatttctaaacattgtgtcggtgttttggggggtacaataatctattttaagcttcatggccatcctgggaggtaaataatattattgaccatttctaggtgaggaaactgagtctccaaggggtcaaggtcaaggagtttgcctaaagtcatttaggcagaaattggcaaaaccaggatttgaatccaggtctgtttgtgtccaaagctggggcatttttctcctaccacaattggggtctactggagagaaaaattaaaacctaacatctggattagtaatgcagcagtatccaccatctccctggaaacatcacggcagttaggggctcacttcccttcccctactctgggattgggattgttgatcaaagccatgtagctttagtgggataggtcccagaccaggatgggacaggcaggacagaaggcccttgtgaaagagacagtttggagggaataataaggatggtgaggtagtgaggtggagagtactgccacccagtttggagggaatggaggaatactggacagatggacaatcaaaccgatggacaggcagatggatgggttgagggatggatgatgaatggatggatgaagggaaggaggaaggatggaagaagaggtggatgggggatggatggagagatagatgagaaattgatatacggatggatggattcatggatggtggatggatggatggatgacagatagtgagatggatggatggatagatgggtggatggattgatgggtggatggtgaatggatggtggatggatggaagtatagacagagagatggatggatagatggatggatggatggatggaggaattaatggtggagtgaaggccagactgtgcctttcttatctctgttcagtgtttctgaaggtcattgtcatctctgtatctcaggagcctctgtatcttagcagctgtcacagaataggtgctcattaaatcctattaaaatgaaagtgtgacccacctggcccctgagtgcccctgagtgccagctgggtcacagtccattttaacagggtttaatgagcacctatcctgtggtatagaaggtaactgtgcacctccttttcatgtatccccatcatggctaacaacagcctagacatatggttctcaatcctgtgtgtttagtgttacagactccatgctgcccactctgcacaaactgtggaaccaggggaagtccagcacagttatattttagggctactggtggattccagtgtatagccaggattaagaacactggcctgtaatgcctttctgggcctccccaccccccacatatggttgcatctatttgctgagtcaagtccatctgctgggtcccagggagtgcctcctcctctcccagctccaccatctctcctgagtgagggcaggagcatctttccagctgcctccctgggctccatctctcaagacagtgggagggcttattctcaagtgcttgtataatttgttggaggctcgctctaaaaagtaaatataatttcttggttggctcaattgcaggtgagagcccagatgtctctgcccagaaatggagatacatccatagggacgcacccgcccctgccatctctcaggtcctacatgcataggatgctccaccgtggggagccagcagggctttgcagagcatctcttgtctctgacctagctgtttcctttgccacacccaccctccccacttcttggccaagacatgggtgaggggccccttcttgcagaagcttctagaagcctctggccccagtgaggtcccctcccctgtactccccagtgccgcccaccctgcccttggccccagaagtgctgcagcccacgtttctccacatcgtcctgtcattagccccttgagtgatggcctattggcaggagcagagcgaaggaatcctgagaggggcccttctgcccctcctggcccagcaggctggacagtaagcttagccccactctgagcaccgcctctgtgctggcacagtggatggagacccttgagttctgcgggggagagaagaggtgtccctgtatttgaggagctgagccaagggggctggaccacaaggaagcagcttagaggagcctgtgtggggatgaggggtgcctgggagagggccctgggccggtgggggttggggggaccctaggaaagtcgtctaagttccctgagcctcggtgtcctcaaatgaacaatgagacccggccccagctcctccccagggttgtgagattaaaatgggatcgcacacatcagcccctcagggaagtttctccctaaagacagcctttgtcttctccattcttggttcaggccctctgggaccgcgtctccaccatcacacaccggcctagggctgcactcttggaagggcccctgcgcttgcagggtgggcaggggaccctcgcttcacctgggcgtcctctctgatggggcccaggaaggctttgcagccgggggccatctgaccaggtcttactgggcccaggcagaggtacgtggggcctggagaatggcacagggggctgcagcggagagagactgtgggcacaggtgtggcgaggccaggccgccgagagccaagtggtttgcgaaatttcctggtggtgtggagggaggaaaagctgatgtgttcacctccccactcgctgtttgcagcctggaagacgattgcagggggtggcagggctgaaaagacaatgtcctcattaaaggaaattgagaaagagagtttccttcccagtggggcgggacagtgcagaaatgcggccggtcctggaagaggtgggggcgaggggtcgggggctcacacgccctgcgatttcctcccatgagaatgggcgggggcagctccgggaagggtggcggatggagccgccctctccccaggaccacaggggcgctttccagtgaaggcgccgtaggaaacgccagtctgtgccgcagtgtacgtagaggcgctatgagcccgagtttcccacgtccagggacaaactgggagccgtgactgtcaggccgcgcggaggctgccctggccgcctttgcggtcaggtgaaggcgcagaggcagggaggccgggcgagcgcaggcgggcggagagcagaccacgcggaagaggccgagagagaaagcggggcacccggccgggggggtcatttacaagggacgctgggcacgaaggaggctggggcgaagatgagtccaggggttgggttgagagcgctgcgcagccgggctgagaagagaagctgacgagtgactcccgacaagggacgggggagagggaacctgggggcaggcagaggcctagggggtgggctctgagggcagccactcccaccggccctcccccagccccgcaggccagccacatgccccgtgctccagacgacccagctacatggatggcagcgtcctgaagggggatgatcggtagggagtgggtgcggaggctcacgcctgtaatcccagtgttcggggattcccgagcgggaggatcgcttgagccggggaggtggaagctgcagtgatctgcgccactgaactcccgcctgggcggcagagtgagaccctgtttcaaaaggcaccaggggtgtagggaaggagcgatatcccccaggcaaggaaggctgcggaggggccaggccaggagagaagggccctgagctcagtggacgggcagggtgcctgtggaggaagggagggacgtagcagcaggaggaagggtgaggacccaggctggggatcgggagaagtgatggcggaggaaagagaggccggaagaggagggggcctgctggcctggcactggaaagcaaagcgtgggtttgtatatgggaagaagaccacatcccctcttatcgtcatcccaactcagaaaccatttggccccaagtcaccaaagcactcataggaaccacttttcctgtgacacaagtaggattctcccacttttaacttcccaaatgctacccgaaagcctctgaaatccttggaaatttaaaaaataatccccttctattaactgatgcctataaaacatattgactttcattaaattttgttatgaaatcagggatgtgtcccattgtaaaataaatttgtttggaaaatgtagggtggtatcccatctaaaaatcagacgaggctagaaaatttcaattttatttgctaaggtagcatcatgttgttaaaaatgcatcataaaataagaccaagagttaatacaaagcatgaagtcatgtttccctcaaaaaaatgatttgttctgtagtcaaattaatttggaaaacattgcaaactcttcagcagtggttctcaaagtatagcttgcgtcagaatcccctggggcccttgctaaaatctggatggctacactccccgcctagagtgggttaaactcagtgcccactggcaggaaactgaaacttggctgaagtcaccgaggaggccttccccgttaaacctctggctggcgacagcttggtttcctcgccgctgcttctgagtaattctggcacgcagttcctcctagccacctgctgtacctggaagggggccagccctcctcagcaggctttgctcctgccctgcacagcacaactgtggcgtaaaaaatggaaaagctggtagcagaaggaaagagcagggagacagaggttaggtgaacctcaatggcctcattaaagcaaattgagaaagagagtttccttcccagtgaggcgggacagtgcagaaatgcggcccgtcctgggagaagtaggggcgaggggtggggggctcaccgggcacatggccaacagctggtgcccagcctgggccacagtttggcacaggagaaagctgaagatgcaggagaaagctaggtcactgcccctaggccaggtgatcaaggtggctgttacctgcctgtgtggccttgaaaaagcctggtgccctctctggcttgcagggtccttctttttacaaaagcgggtcttcgaagccctgaatattccagttatctgtaaggatatagaaatattttgcctctagatgacatgtaaatatgttcctcctaactccacttcttcctacatctgtggcttcttctgagaactaccagacccaccctgttttcagagtaaacctcctgttttgaggtcaaacagacccagctgggtaattggtgactcactcctggttcctccaaagaacaggggcaagggaccacccgggacctcaggtgccccagcacaggacctctttctggggcaccctctggcactgggccatcttcaggccctacagggctctcggggcctgcgtaggcctctcatctcccagaaataagttcttttccccacccagactgacaccagatgctacagtgaggtttacccctccagcttgacaagcattcctagcccagaacactcagctgacgaggggtgctgggggaggaaggaggcagcaaggctgaaagaagcttctctgggtattccagtgcctggctgctggtcgtagccatggtgagaccacagcagcctccctggaagcaagcacctgtgtaaaagcccctccttccccacaaggggctggatccaagtgaagaaggtaccagaaggactggaagatgatgctggtattattcgacagctccagggtgctgtagcactgagcacctactgtatgcagcccatcacaaagccagccacactgcccaggctgtgccatggcaacttccagcagtacaccctctcggtcacctgcaggctccttgttcatcctgacacatgaggagaaaaagacagtactcacaaaggcctctagccttgtggccccaggaccctctcctgagcatcatggcctcctaggagacccagggtagccaggacaaaggagagaagcatttgctaagctaagaaaggatggaaggggattgctgttctgcctggatgcacccctagacctggcagggcaggcaggagagacccccagtgtctcttgcttatcctaggagttcccccctgtggttgctccagtttgctgccttcatgcatgttcacagggtgattcccctgagacaacagagctgggatgtcaccaagccctgtgtcccatcagccaggctctccccagcctccatcctctcattctgctggatcaggaggatgtggggaggtccctgactccccagctttccccatgacaaggtgtgtgtctacagctcagacccagccatgctccacctgagaagtgggtccaggcagagcactgggtcctggccacctagggctgcctcctcaggggtgggcaggaaggggagccactggaggagtgccccgggcacagtcccctgcaccaggtgaggtcacctcttagtccatgaggcgatgctgcatgagcccctctggacactagaaggcctgggctcaatgctgagtaaagtgcaggcatgactgtgccctcagcatgcatagggcagcaggcatagattcatacacgtgagtttgcacttaagctgcagtaagagctacagaggaaatgaacagagacagcatcactccagtgagccctccagatacaccccatgtgcgcagtaagagaatggcatagtctattgggacagccacatcaaaataccacagaccagatggcttaaacggcagatatttgtctctcacaggtccggaggctagaagtccaagattagggtgccagccaatccacttgctggtgagggccctcttcccagcttgcagatgtctctgtgttcccacagcatggtcacgtggcagagagagggggacagggcatgaataagccctcggtgccttcctcttcttacgaggatgctaatcccatcacgggtaccccaccctcgtgacctcgtctaaccctaatcacctcccaaaggccccatctcctaatgccatcacactgggggtcagggcttcaacacatgaatttggggagcacaatttagtccacagcagaaaagaaaggggcacagagcattccagcctgaaggaaacagatgtgcaaaggcccaaggcaaaggcctgagctctgaggggcaaccagagtcaaggctgaagagtgggcagtgattgagcactgacggtggagaggcaacaggctatcttgttaatctcagtcttttgtgtgccagagagagaaactgaggcacagtgtgtcatggtgaacactgggcagcactcccacgctcctgtcctgcactctgcagggttatggaggaagcctgggaagtctctcccctcttttccacctttcctggacccatcccacaccctgcctcctccaggaagccctggggattgctcatacactcacatctcactccttagtacctgcagcctgcattctgaatttagcaagctctggccttgggtttctattttcttgtcctgtgcagtgagcatttggaaacttctcctcagcaccaaacacggagccatttagcagaaaatacatgagttttcaagtcaattgaactgttcatcgccccaaaagccaggcaacacggtagagcagctggatctctgttcgtagaagctttctcagggactggcccaccgagtgggggactgcaagtgcccgatgagtgaatgaatgaacacatgtgtgaatggaattcaaggcactgcaggctattctggagggtactggcctgtctcttcgacaggtgaggtgcagtagaacagcatcccgtatagatgccagtttctgacctggttctgaaaagccagtcacctacctctgcagagctgcctggagggggcgggggttgtgaggacccctgagagcttggtgtgaaggggctctgcagagggaggcatggctagtgtgcgcaaggtgacctctctcctggtctgcaggatggagaacctgttcatcaaccgcttcatgcacatgttccagtcttcttggaatgacttcgccgactttgagaaaatctttgtcaagatcagcaacactatttctggtgagtgtgcctctgggggcccaagtggtgctggggacaggggatgctgctctcctgtctgatacttgccgggaaattgacaagggccttcctgcctgctgcagcatgggggcctcgctgccaccatgccaccctggacagcaccccctacactccacaccttttaccatcactgtggtcacccttgtgcccagaggtttctcctcctcagatattcaagctcgagcaccctcaacctcatttcactatcaaaagtctcaaaagtatcagaactttttcttggcacaaatcaatcatttgtgcttctgaacagagcaaaggcagaacttggcttgtgttttaggtatttacacaaaagcaactttgggttcctttggactaggatgtgtttgatgagagcactagcttcatagtggccagtcatggcatgggaaggacgttaggaaggcaggaatggctggacaagaagaggtgctgaaatcaggacatggggaaccaaacttggcaaactgcccccagggactctcctccacgccctccttcttccatcctggacactccatgctgggctgaaggacctgagtgctccaggaggcttctgagccacgaagggccagctcaggtatgatgagttggtgccacagcctgacccagtgatgggcagggggcagcagttggagctgtgcccatccagggagcactcgggagaggagaccaagcagggactctgctcttaggtgaggtcaggagggccatggccctggctgccctctactcagagctcagggtgggcctcgcttttctcctggtagagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccaggtaggggttgatgggctggggaagtggccaaggtcacagtctgtcaggtggaagccagttcctcctggccagtgctcataggccaccaagacgctaactgcaggcccatctggcctacagcagccgcttccttttcctggcagcagtgtcagccagggtcctgggcattatgcagactgtcttgtgcaacatcagaggaggaattgcggggaatgtttctccatgatgctcgagtctgggaacataatgtcaatattttcactatcagtatcaataattacaggagctacccttgattaggggcctgtggtgggacaggcattgtgacaggtgctttacacacaaggtcatcagttgtcacccaccttgcaaaggggagaacactggagaaagaagcagaccttgtgtgagaataaaaaaggggcacgaggagaaacccaacagaatggttgattttctcgttagaaatgctgctgcccatgctcctgtcgcaccctcctccccaccctcacctgcagactcagctgcctccggctgcaaggctgacctagtcttgagacagaagaagttcaaaccaactccacctggatctggtggggctcagcaacaggcgctggcccatcagcctgcctcttccccatggatccagcgtgatggggcctcctgccacccaggccctgctgcctatccccaggtgtccaggtggcctctgctgcttccagtcttttgagctcagcttaccctgaggccctagttggagagggatggttggtgccctttagagataaacctacagccccagtacctggcccacctgaatctagagggccacccacccagctgaagtccctgggcaagtctcctgccccagtgcaggcagtgtttcctaacctcctcctcctcctgcacccaaccaggcccagaacacttcctggtcatgtgaacagctgacagttacaatcccccacacactgagagagcatctgtgttcctgagtggactgaattgctagatgtagtaacattgatttggtggctataggtttcaaacttcaagtcagagatcatagaactttaagccatatagaatcctagaattggaagactctgagcagccatctctgcacccagcagccaaggagtggccatcctcagcacctggcagggcatcagcctcccactgggagtcccggccacctccagggcacgtgggttatgagtcacctttcctttgagctgacccacccctcactgactagactcttaaacacacactgccccgtctaatacacaccagcatgattcttaatccccacagtcattcacgctgcccatctggcagcaccttaatgatctacagcaagcttgtggcctactaaaaacgcctccattgttttttaaaatgtgcagttattttccggatcatgaatagagaaattgtatccctgttgttggtattgattcagtgttccagctcaagtttgagttcttagactttatatttggattctttggtttcaaatcacaaaaatcaactccatctggtttaatccaagaactctattggctcaggcaacagtaaaaagcaatgctaactcatttgggaccagggctcagatcatcccctgcactgtctctctctcgctccatgtctcaatcctctgcctctggtgattttttccttaggagggtttccttatgtggaggtaaaaaatgatcaccggcagcttcagatttaccttccaccagcttagcaaacaccacccactcccagcaagaaagaccctgtttcccaatgctcccagcagatgtcttaggccatcctcgggcctcactgattctgtgagccagtgcccacggccaggagaatggaatacactgacctagaggggacagggactctagacaggcaaaaactccactgtcagaagcagaatcctaaaatgtcagaactgaaaggtaggcccgcccctcgttttccagaaatatgaaagggaggcttgggataacagagaaatgctgcaggcattggccccaaatctcaggcctcctattcccagtatcaccttcaccagcctgggtggtctcaagattggattagcagccattccttctgggtagagtctgatggtcacttcagctctcaaagtccagctatccagccatagtcctagaaggcaagacatcactgtgcccgaccaacccaagggtctccacctgcccccctcaacacaaggtgccctgagtgcctccgcggggatagtccccgtccccacccctgcttcccccgcccatcgcgacagatgctcagagctcatccctggtgtcacaccacataaaggaggagggcggtggccaggctccgagctcctgccgtcctgggtgggtggcttctgtcctgcgtgccgccgggcagcccgggggtcctgcgcgcgggcgcggtcggtggagctgcaggggggcgctctgggatgtctccaggcagagtagatactgacccctccgcagccgggaccctcaccctttccttcatcactcaggaaacagaaaaggcttcagaaggagcggccatgcccccggcctaagcgctgcgttcccggcccagcaggcctaccctgcacctggcgttcctaggggcccctctgcgggacccactgcgcggctcgcagcggccgcccgcctcccacttcaccggcacgctcgttgcgtgtcgaggtgtgttgactcctacagcaaagggcacggatccgcgggtcagcaagcccgacgaatttacaccaatgacccgccgtgtcgccagtctcagaccagggcacaacacgccaaccctgcagaccacccccacctccccagccactgcagacccttccccctctgcttctgcagcacctctcccgaaacacgctcattcccgcccccgcagaccttccctacctcctggagacccccctcaacccctgtagagtcccctgcccgtgcagaatcccctcccccttcccccgcagcccccctaccccacccggcggacagccccgcctcgcttcctgtctcttcctcccaagggagacccctgtcctggctctgactggggttgagttcgccagttttgacttatgtgtagagtccggcagcatcattttttggcatttaactcgtcacatctatttcacctaacctctttcttcttagtaaactgacactcgggtcggtctctcatctttcgtgccagtcaagcaggtttcagacaccacaaatgccgaatgagctgctgccattccttcatcttaccccgaactgccacaacctgtgaacaccttccatgtgaatcaatcagccttggagtcagaggagagaagtacacattctgagctccgctgagtcgcaggaaagggagaggggtgcccagaggtcatcactctttccccaggcctgatttttggtccgtctgctgagcctgatttggacacatctctctgcctcctgcagcaagggaacattttcatcgtggactttgagctgctggatggcatcgatgccaacaaaacagacccctgcacactccagttcctggccgctcccatctgcttgctgtataagaacctggccaacaagattgtccccattgccatccaggtaggctgctggggggcacacctttctgagcagctcagtcctctgcgatccagggctcctgggtggctccattcacactccagctgaggaagctatgtcttgaaagacactagggcttcctgcaggccctgaggtgggctgtccataggggcggagagggttctactccccaaggcacacttgagaagcccctggccagtcgaggcacactgtggaggacctgccctgggatcatattctgcactctccaccccagcaccctgaccaagggcccccagtcaaggtgctgccaggggccaggcaggtgaagctgtggactaagctggagaccaagaccactgaggggcaccatgggttctggggtcaggaaccaggccagtcctggtatgccacctttgatgatgatgtgagttcttatgtccaccggagatgaggcaggaggaagagggagaccctggaggaaaggcaggcgggcacagggctttgtctccccctgttcctggcaccagcctgctgccaggctgggagctggtgtgcagacagcaggggccaaggccaggactggactgggcataggtccctgggagtagggaggaactgcgcagaggacaccgtgggagactggcagatgagcattcagcaaataatgtccatgaactggaccttgggagctgtggacacaatagcagctggataggtcaggcaccagccacatgccaaggctatcctatgggttaacctgcacagtccgcaatcccttaccctcgattctaaatctaaaaaatctgaaaactgctgcatatttcaaaactgtgcagcaaattcattgtttgtaaacaaaccttctttgaagcaataggtgaggttatttagaggctttttccattcaatgtgatatgtatgtggatcactgcagaaatactgctctgttcgattgtaaaatagtatgttgccctagactgggggtgggagggggtatggcacataatgaagtatacccactgctaaaatcctaaaaattctggattctgaagcacatttgaccactggggttttagataacctatctttatttgtgtaatcatcaccacaaccatcctaggtagtgggctctattgatgttgatcattttacccagataagaaaactgagacacaggtgcccacagccagccacagagctaggattcaagccaggtcatctgactctagattccagcctccccacagtctcccaggggcacgtagcctcagaggagcttcctgtctgttaccagagagaagccctgtgcctaagaaactgaagcagcaggtaaagggacaggtgacctaaaagaagacaaaattgctgggagatccccggagatcccaggcaccactgatggtgccttcaaaagcttggctcagagatctcttggagcagcctggagtcaggggcctagcttaaattccagttcagccacttgctagcaggctgtgggaccttgagcaagccacagaatgttcctgggtctctttcttcttctgaaaatggaaactttgcaaactataaagactcaagcaaatgaaagccagaggatagtaaatccaagatctggttctttgaaaggtccaaaaaataataataataacctcctcatgaggctgatggaaaaaaagagatagaaaaaaaaaatgcaagattcggaataaaaaaggaatcataaaaagagtaattatagccaggcaccatggtggtacacaactgtagtcccagctacttgagaggctgaggcaggaggctcacttgaggctgtagtgtgctatgatcacacctgtgaatagccacagcagtctagcctgagcaacatatcaagaccccgtctcttaaaaaaaaaaaagaacagtaattatgattacatattttttaaatgagagtaatatggcaaaaatttgaaaaattagagaaatggataaaaacctaggaaaagataaattagaagaaattgtagaaaataggccaatttccatatagtgattggaaacagacctacacagcgagcagctgagtctcacccagccactagacagctgacatttccagggctctttatcagccccaaattgatcatataaagctggtgtaagcttagttctgaaactggatacaggcaggcttcaaaagaaggctgaagaccaatccaagtattaaataaagatttaaaagaaaactaaaggtgatattagcgaagtgagtgcagcagtgtattaaatgactatatgtaataaccaagcagggtttattccagatatttcaatatcaagagagctaccaccataatttattatacccataaggataaagtttatgattatatcaattcacactaaaagggaatttaataacatttaatagccacaactaataaaaattaataggaggaaccttactttatatgataaagatagctaacatcaaaaaggtgcaactctaatgccatttccattaaaataataagaatgctgatatcactgtttttattcaacattattttagaggtcataccacatgataaaacaggaaaacaatcaataaacatattgtcaaagaacagggaagatgatcttttctggtaatgctatggtagacctagaaaacacaagagattctaatttttttaaaagctactagattaataaattcatttggcaaagtgtttagataaatatatttctcaaaaaaatcaatagcctttctccatactaacaataaaatataatgcccatataaggaaaaactataaagttatttatttatttatttatttatttatttatttatttatttgagatggagtttcgcactgtcacccaggctagagtgcagtggcgtgatctcggctcactgcaacctccacctcccaggttcaagcaattctcctgcctcagcctcccgagtagctgggattacaggcacctgccaccacgcccagctaattttttgtatttttagtagagacggcatttcaccatgttggccaggctggtctcgaactcctgaccttgtgatttgcctgcctcagcctcccaaagtgttggcattacaggcgtgagctaccgcacccggccaactataaagttattttaaaggatatacaatgaactcttaacagtgatttgatattggggaggaaactgtaaaaatgtcagttctaccaaattctattataaaaacttaatgcacttccaagtaaaatttcagccagaattttttatctttcttggtgggggtgtggtggtggtgaagaggaactaaaaaggagagaaaacaattaaaaaattgaaagattcatatggaaaaagaaatctagcatagtcaaaaattttttgaaaaaaattaaaaccacatagagaggcagggcaaccaagtgagacctcatgtcttaaaaaaaaaaaaaattaatagaaaaaattaggtatggtggcgcatgcctgtaatcccaactgctcaggaggctgaggtgggaggatggcttgagtccaggagtttgaggctgcagtgagccatggtcgctccactgcactccacactgggcaacagagtaagaccctatctttaaaaaaaaaaaaaaaaagtaaaagaaaacacagaaggaacactttccttgctggatttgtaaggttactgttaagcagacactgtgcttgaaaacagagagaattgggggacagtatagagtaagatccagaaatggactcccccacagaggaattcagtgtatcacaatggaggtttttcaactcagtgaaaaagggatattattttaatgatgctatcacactgcctttgcatgagaagaaaattaaattggactgctctgtcatgccatttacaaaaataaatctcatcatgtagaggagttgcttagaagaaaaagaaaaaattcagatgaagtaaaaattaaaatgaaaaaagtaaacgaatttagaaaaactaattacgcagacactcagaagacttttagaaggaaaaggaaaccaagaagttataaggggaaagctaagcatatttgattatgtaatgttttaaaacttgagtgataaaccataaacaaagccaaaaagcaaaacagagattagggtgagtaaccataacagaagtgacagctaagagatgcctatctatgatacacaggtagctcctttacattgacgggaaaataccaatactccagtggaaaaatgagcagagaatatgaataggcaattcacaaaagaagaaatgtaaatgggcaaccagcatatggaaaaactcctaacttcacctgtagttagagaaatgcaaatgaaagttaacaatgagatatcatttctgacatgcctggttggaaaaacaaaggggtaactcccagacaccagcaaggacggagccccatgctctgctcatgagttgttgcagcctggcagtgttcacgggataactggtgggcctgggcagcccaaggtcagagcttcggccagcaccggagcaaggtcagagcttcggccagcaccggagcagatcccacagcgcctgctgtaccaggtgcatgttgcagtgggcggtcagagggtcctggggttgaggctgtcgtggcgaggacagttgtgttaccgagctggactgggatctgcttgcccagtgcagcaaaaccaaacactgagattgggatataatctacgagaacacaaggcatttattgcggggaccaaaaaaggagaattgggcagctcactcttaagaccggaactccctgatggcttgcaggtaagggtttttaaaggcagagtgaatttcaggaattgcagaagttaacaggcaaaatcattaatcaatacatggagggtacacattggttttggcctaaaagggcgggatatcttgaagtgggggtgggcttccaggtcataggtagattcaaaaatttgttgttttgaaattggttaaggaagagaagtttcatttaaaaatttgggttaccagaaaggaatgttagctgtggcttgtgggcgggacttcccccaggccccccaggaagaaatttagaacaaagagcctgctcagagttcagtcctcagttccgtcttatctgaggtctctgtgccagtggatcggtttggtgggggtctgggtttctgaaaaacaactcagagacacatgttcaggggttctctttagtttccagagggaaccaaacagcccaggactctggcttccttggctgttgttttaggctgctgttaccctcttgtttgtcaagttgctcatttatttctcagggctagctaggtgcctggaacttcccttcaaggaactcgggattttccttcatttccatgccctgttgcggggctggggggctacagtgccctaagaggaggcccctgccccgtctcaattggaggagcactggaggggactttattgtttaagtgttctgacagccagtagcactgaacaggtgtgcaccaggagagtgaaactgtctgaggaacagtagggcaggcactgtctactcgaaaacatacccaaacccccaaggctcagccttcgctagcagccactcagcagaaatgaaagcacaaatgtgtgtgggtagcaacaggagcatagtttgtgatggggaaaaaaattgaaaacagtctgaaggcagaagaggattgagtgagtgagcccttccatgtcctcaccataaaatgttgaggcgtctttgaaaggaatgctttggttcccttccagctgacctggaggggtctccacaatgagttaacagtggaaaaacaagacacaagggaccgataaaggatacatatctgtcgtatacaaatagctccttcaaactgctaaggcaatgggcatggtctcacttatgtaaaatgaatgcaaggatgcagcaggcctactgtgccagcatggggacacaaggacgcagtgtcaccaggtaggaacacagtgatggcccagtgggggacaggtgagcaaaacaaagagacagatgttgattataatcatattcagttgatggaaaattggacagataaatgtgcacacatgcaaagacctatgaaaggaggctccccagaatttggtggttatccctgggcgctggaagatgagatgatgttttctttctcaggctctcctgtcatgactcagatttctttttacgataagcacatattcttttctaatcagaaacgcaaagctacttccttacccaaaaaacaaatttaagaaacacaaattgctcagggcaagttctggcatcccatggcaggccaaaatcctggacaggagtgggaggatgtgaaggatgggttggggaaggcccagctcagtggtacaagagctcaaggagatgggcaggtgaggcccggtcaggccgggaggtgaagagaagcagaagggagagtgatgggctgaaataggcagagcactgggcccatcctcattcagctctttttttactggtcagaacagtttttttttttttaatatataaaattttagattcaggtacatgtgcaggtttgttacatggttatattgcataatgctggggttaggcttctattgaacccatcactcaaatactgagcatagtacccaatacccagtttttcaaccctttcctccctccctccccttcctggagtccccagtgtcttttgttcccacttttatgcccatgtgtacacaatgcttagctcccacttataaataagaacatgcagtattcgattttctgtttctgggttaattcacttaagattatggcttaagtgccaatcctaagctgcatccatgttgctgcaaagaacacgatttcattcttttttatggctatgtagtattccttggagtacatgtatcacattttctttatctggtgccactattgatgggcacctaggttgattacatgattttgatattgtgaacagtgctgcaataaacatatgtgtgcctatgtccttttggtaaaacaatttcttttcctttgggtaggtacacagtaatggggttgttgggtcaactggtaattctatttgcagttctttgcaaaatctccaaactgctttccacagggatggaagtaatttacactgccaccaacagtgtgtaagcattcccttttgtctgcatcctgccaacatctgtcatttttttactttttaataatagccattctgactggtatccctttgtggttttaatttgcatttctctgatgattagtgatgttgggcattttttcatatgtttgttggccacttgtatgtcttcttttgagaagtgtctgttcctgtcctttgcccactttttaatggtggtgttttttcttaagttcctcatagattctgggtattagtcgtttgtggatgcatagttgcaaatattttctctcattctgtaggttgtctgtttactttgttgatagtttgttttgctgtgcagaagctctttaatttgattaagtctcatttgtcaatttttgtttttgttgcatatgcctttgaggtctagtcataaattctttgcctaggaaatgtccataagattttttcctaggttttcttctagaatgtttaaagtttgaagtcttacatttaagtctgtaatccatctagaggtaatttttgtatatggtgagaggtaggggcccagcgtcattcttctgcatataggtagccagtttttccaacactatttattgaataggatgtcctttccttattgtttatttttgttgattttgtcaaaaatcagttggttgcaggtatatggctttatttctgggttctctgttctgttccattgatctctgtgcctatttttgtaccagtataccatgctgtttttgttactgtagtcttgtagtatagtttgaagtcaggtaatgtgatgcctccagctttgtatttttgcctaggattgctttggctattcggctattttttggttccatatgaattttaggatttttttttctaattctgtgaaaaatgatgttgataatttgataggaattgtgttgtatctgtagattgctttcttccaacccattagctgggatgtttttccatttttttgtgtcatctatgatttctttcatcagtgttttatagttctctctgtagagctctttcacctccttggctggatacattctttggtattttattttgtgtatgggggactattgtaactgagatcaccacgttcctgatatggttctcagcctgaacctgaacattgttggtgcatagaaatgctactgatttttaggccaggcacagtggctcacgcctgtaatcccagcactttgggaggccgaggtgggcagatcacctgaggtcaggagtttgagaccagcctgaccaacatggtgaaaccccgtctcaattaaaaatacaaaaattagccaggtgtggtaacacctgcctgtaatcccagctacttgggaggctgaggcaggagaattgcttgaacctgggaggcggaggttgcagtgagctgcgatcacaccactgcactccagcctgggtgatagtgagactccgtctcaaataaaaagaaatgctactgatttttgtacactgattttgtatcttgagtgtagaaagtcaaaagttttttttttgttaaggagtaaattatgtgttagaaataatagttttttctaaagactaactttttttaagccttttcgctttgtgctaataactttttgttaagccctatcatatgtagctgttagatataagggaatgagtacattctatgtccttgtactttaaccaagatatttgtgctggacgtgctcacaggcatgtcccagcttgcagcccatgccccttccttatttggaaatgttattacttttctaagtcctttcataagcaacttcctcttttcctttgtctttccactgcttttacctatttagaaaagttttaagttattagccagtcgggttttagtttagactgtgaggtttggctccagccaatggagacaggacacggtagcagggacaagctgcgtaaggaataaaaattgcttctctccattattcaggtgtgctctcgccattgttccatctgcgaggagcaccctttctgcagaaagtaaaattggcttgctaaaaaaactttttgtctaaatgctgatttttccttgcagtaccgaggaacaagcattctgtttctaaacaagcattttacttataacattgagactttactgaagttgtttatcaagtctaggagtcttttggaggaatcttcagggttttctaggtatagaatcatatcatggatgaacaaagataatttgacttcctctttttttttttttcatttggatcccttttatttctttctcttgcctaattgctctgactaggacttccagtactctattgaataggaggggtgagagtggacatccttgtcttgttccagtttttagggggattgcttccaatttttgcctgttcaatatcatgttgccggctgagctctttacctactgtgtgacttgggagagctgctaaaccagctggagcctcagtttccccccatgtaaaatgggtacagcaaggaatatctgccttgcagggtcaaagtgaggattaagtgagatagcatgggtaaagcccctagcacacaacaggggggctcctcggccccagaggatgtcaggaacatgtcagtgtcccagagccatcaggaacatgtcagtgtcccagagccatcaggaacatgtcagagcatgtggggacatgtcagaaagtgtctcagagcatgccaggcagcccagcattctagggcacagatcaggtatcagtggcccaggcatctcatgcaaacgggtgtggcagtggggaccctgagagctgggactctgtaaaagggacaagagcgtagttctgtgagaacctgggtgcagagttctgagaccttctaatttttcaagaaaaccaggtcattcaaatttttatgtgaaactgtctggtatttaaaagcagccaactaatctcaagtataaacagacaggcacgcctaatgtgcaagtcacactctgctctccctcctccctcccccctccttggtcctcagggagtgctgaggcttctggggtctctctgaccagggtggagccactggccaccagggctctggagcacttgggatttggctcgtccaaaccaaaacctgctgcaagtgcaaagttcacacctgatttttaagacttagaataaggaggtggggaatgtgaaatatctcatttaatagttttagattggtttcatgttgaagtgataatattctggatatattgggtaaaataaaattatattattcaccggcatttcacctgtttccttttatttttattaatatggcttcctgaatatatacaattccatgtgtggggtagcattatatgtctattggacagcactgttttcgagggagagacgcccaaggaccccaccttccacaatacttatagcaagtgacacagctgtgtgctctgggacagttctccctccccagccatgaccactgtgctgcagtgacactggtctttcccagcacctaaagtctggccatgccccttcctggccgctcttggctgcagccctgccacccacctcattctttctgtcaacccctccaataccccatgtcttcatgtaaaaatgggcaatgccagcacctgctgccggctcccgtgagaactcactgtcgggtgctgaggctgtgctgggctctcaataagggggcaacgtgcagggctgctggcatggagggacctggggctgggtgctggtgtgggggcacgaaagtgaggctgtgtgtacagaggcatcagcaaccaggtcaccacagagcttggggattttattttctggcattaagaggtgattgaggaggcagttaacatgacatgatttgcattttggaaaagaaaaaaactcaccttgtcccagtgtggagtggaaactggaaagggaagacaggtccagcctctgctacaggaggtgcctggccacaggtgtgggctccaggcagagctcaagctgcagaccctgatctgggaggctcagtaccaggagggccccaagcctttaaacaggaggagctgacttagggcaagaaaagaagacaggagcaccagggcagaccctggggagctccagcatttcagggaagaggagagggaggaaagtatgagagaccaaggagaggcagtagaagagggagcagggcaaggagggaagagggggacagcgatcctccccctccgctgctgggccttcggcctgcccgctccttccatgctgccagctcctgagtaactgtgagccgagcgatcactgtccccacatgacagatgctgaagccggagcttagaaagcccagtgtgtcatccagagtcatgcaggttgtaagtaatatggctgggacaggaaataccaccgcagggccctttaccccctccaggctcttctgattccaaagtcactgttaaagaaattcagatacttctggaacttcccaagaggcgaagttctccaacaactatactctgaagtgaaatatagcagtgtgtttcctttcccccaatgtatcagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaaggtacagccagctaccgccccacctgctatgggagggcatctgagatgtggagtgggagggatcactgacatcccacagggggacctgtggctgggagtgggtggcagaaagggagccctggagagatgttctcagagtcagtaatgcccctaaaggaagaaaacagctaggagcctgctgttccccaggacacgcggctggggcatgggcctgacacacgggcctcgctggccagccagtagagttggaaaaggcaaatgagttcatggtgatcctcggctgatgctgatggccgcccctgccatcactctccgtccctgttctcgaatcctacaagcattggctgctggggtgactgcatgctaaaagtacccatgtgcctcagtttcctcaccagtaaaacaggtcaaatagtacagctgccttacagaatgatggtcagattaagacagtgaactcagggagcaaagaggtaagcattgtacaagtgctggccaggaccctctgaatcattatcatgcttagtaagcatcagaggggtgcaggcctccagcacttattcagcagaaagatcagcacccagccttcacttcctccctgcgcccagcatcatcctatagggcaggcctgggtgggggagctgcgggtccctgaggcaccaggtcacctgactgggccccctctgaggcctcctcctctcccctccccagctgctggtggcacacgtgagattcaccattgcaatcaacaccaaggcccgtgagcagctcatctgcgagtgtggcctctttgacaaggtgggtgccctcctaccctacttgttgcctggaagagcccagcctggccgccttcactccctatctgagatctagacaccctttcaggaggcctggaagggtgaaggctggagtctgctcagagcactggctccagcatcctcctgatgtctccagcccgtgccattcagccaggagcactcctccaggcgcaccaccaggtcttccttctcactgatggctcctggtcccctcctcccacccctcccctctcccagcctctgggacctgggtgtagacccccctctggaacacactccttatggccccctgacctcctacgcaccaggaacctgtgtctgcctcttaatctgccacacccctgccaccctgacctggacctccccagcactctgcttcccgggtcccaaccctcccaacccactgtctcctgcatcggggactccaggccctgcccagccctcgcatccctcaggtagcaccccacctcgttttgagccctctgtagccttaccaagcttggactctcacatgggcccttgccccaaccttcctcctttccccagcccattagtgaccaggccagatgaccactgaagttgagacactgtttgggctgcaaatgacaaaacccaactcaaaccagctgcagctggacaagacatgccttatctcaaatacctggacacaatagagggtcgggggcctcagccagaaatggatccagggactcaagcaatgccccagggtgcatgcacactggctccctctttctgtctctttcacctgtgttggcatcacactctcctgctgcagacaggcccccatgggagagggcacaggagctcatcatagtagctccacctcaggttctcatgtggccattatctcccagccgcatctaaacagaaagtgctggggggcagctctggttggtcctgcttgggctgaatgcccaccgtggaccaatctctggcaccccagcacccaagtccttcttcaaaacctctgtggcaccgacagcccagccccctgggtgtatttgcatgtgtgtgtgtgcacgtggacacacatatgtgccagtgagcttgtgagtgtgtctgcatcactcagaagccgggatcgggatcaggaccaggatccctccttgtgggtctctccagccctcacctgagcacacaacaggccctcaacagagttgcatgggtcctggaaactgagggtcactgagagcaatgactgagggtcgtgtgctcagcactagagcagacttcacagcccaggcccgctggtgctggggtcccccacacacctgcccacgcctgctgccctcctgtggctgggagcgcacccttccctcttgtactctgcagccccacggttcagtcccttgcattggattgggcgggaggctcctccctagcacctctccacccggctgcccttgtcattctctgcgttaaacatccctcccccatctcacaggacaagggcttgcacctctgcctgcctggcctcctcgcctcccctggcacatttcctcagggatgggtctggacagctgtgggaggagccacccgctcagggcactctacctcccactccaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgtgagcgcccgcggggcggtggtcctgggggaggagccgggacccctgcctgactacctggggcgggcctggcccctccaccgctagcgctgaatggggacggggtgggggagtcccagcgtccgtgagggggttgccgccgggcaccgctccgcagacctggctgggtcgcccaccccggctgcgccccctgagccaggttcacggccgaggtggtagacatctactacgagggcgaccaggtggtggaggaggacccggagctgcaggacttcgtgaacgatgtctacgtgtacggcatgcggggccgcaagtcctcaggtagggcctccgggacgtctccggacccggctcccccgcagtcggcagcgctggcccctccgccacccctccggggtgtcctgcccagggtgccctccggccttggggcagggaatccgggcacggggtgggcgccgggccctggggtcctcagggactgggcctcagcccgccggtggttccaccctaggcttccccaagtcggtcaagagccgggagcagctgtcggagtacctgaccgtggtgatcttcaccgcctccgcccagcacgccgcggtcaacttcggccaggtaggcagggccgggcccgctgggcagggctcccttctcaaggccgctgcctcctcccccgccccggttctgcacgcgtactgcaccctcggacagcctcggggcctggcacgggacttgcaggatggattctgcccgctcagccaagggcgctggccgcggggaaagaggatggacggactgcagggcccgctggagttggggggcacggggaggacggggcccagggggcagctgggcagcagggcttcgggggtgcccacgcttgctggcggtcgtctccgcagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgaggtgaagctgggcagggcggggcacagccccaggtcaccccaggttaagcggttcctcagcctcagggctttgtgactcgggccccaaggctcacttggagcaaaggaatcctgacttccaaggctggaagggcccagaaggctgcagccgccaccaggtcccccggcctcagcctggacagagctcagggtgtgcagggcaggagagcacacagcccaggctttgctcactgtcaccagagggtcgtgtgtgacgccccctccccccagctattgacaaagttcttgcacatgtgttttaccctggtactccagagggaatgaccaagagtttcctgggttccttccggacacgtgcatctcatttaacctaacaactgaatccggtgtgtcttcgtggatgcacccgctttggggtagctcagtactgcatagaatggccggaccagtccaacctgctccagactgctgggtgtctgagttgttcccggccaatgtgttggtccctcactggacatccttgtttttgtggctttgcacatgtgttcagtatgaccgcacacattcctagcagacaaattccttggtcaaagaatattgatactgaattgccctccacaaactaaattcaaaatcccattatcaatagcctatgtttcttggacctttccagctcagaagctttgtgatcttaatccaatacagtatttttttaaaatgatatctagctctgccccgcagacatctgtgtgagaatgcaaataagcacaggaccccaacagggcagccaccccttcaggctccctggcccgctttctgccttcctgggctggagaggccagtgctggccccagcgcccctgatgggaggtgagagtgctgcgcaggggtggcccaagacagcaggataccatggctgcaaacaccagcagcccccagcttcatctgcatcatctcgtaaccacttggcagcaggcagttattttcccacttatccatgaagccccagccctggagccttccttagagaagcaggttggaggcgacgacacttgccttcccgaggccctcttgtcaggcagcagagggtgaatatggggaggtgaatagatgctccctccttcatctcccaaacggtggctggccccttgggatgagacaggcctgtcagtttacacgggtagtggattgacctatgtgtgtgtccatgtctgggccctcagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaatgggtcttgttccatgtgttatattccaatcaccccaaacagctcactgccatctcccacaccaagagaaaaaaaaagccatagtcaccgtgattttatcaaggcaaaagcctccccacccaagtctggatagaaggtgctttttccctcaagcagtgtctactctctttggaacacatcccaaatgtcaccacctctgggaaggcatccttggttcctgtctctaccctggatttgtcagaacctctgttcttgccccctctgtggtctctcccttgggacaggagcccctggaaggacagaaaacccactttatttatgtctgtgccccagggctggcataaggcaccagcactcagctgttctctccttttcctcctggaagggcacctagctaatggatattaggcattgtcttgggagctgggggcttattttttcctgaggcagggttcttaacatgacataaaaaataaaaatgggcagggcgcggtggctcacgcctgtaatcccagcattttgggaggccaaggtgggaggatcatttgaggtcagaattcaagaccagcctggccaacacggtgaaaccccatctctactgaaaatacaaaaattagccaggcatggtagcaggtacctgtaatcccagctactcaggaggctgaggcaggaaaattgcatgaacctgggagacagaggttgcagagagtggatatcgcaccactgcactccagcctgggcaatagagcgagactctgtctcaaatagttaataaataaataaattaaattaaataaaaacgcattctctttccccagccccaagtagcagagcccgctctgagcctgggcatggtgacccattctcctcgtgctcacatgcccaactcccagccctccagcccctggcttcggaatcatgtcatcagggtctcccatgtctctggaaggtgcttccagtgtggcaggccatcagctcagtgtctgggtaaaggcttctacagggccagcatggcataggggggaggtgtgcatgcgttcctgaagccacaaggtcttctgaggagacctgactattggggtggggactagagactgaggtccagccccttaatgccccagactccctgccatccctcggagaatttcccaccacacttatgaatgatcttcgggacaggtgacataaacatacagctatggtagaggcattcagctccatgccactgtgagaatgaacataccaacttttaggcaacaaggccatgtggtcaaggagagaggagaaacgaataggagtaggcaggggtggtgaagcaggtctgacattggcaaaagtgacagagaaggattgggttggaagggcttcagatggcagagaacctctgaaaaagtctcatgccagctaatgaagagtcctcaaagtcaccatcacagaaatcttacatctggcagaaatgacagcaatagtttggcatgaaccccacagtggatccaaacgtgtggcagctgagatcgtcagttaattatgttctctgcagctggtccttctggttccctggagctgggtatctgagtagcacagctccactgctaccacaggagagggagaatcccaaattctgtgcatagactgtctaaacctctggatgacccctaagacacatgtacataaggcaaactgcaaacagcccaatttaggataaaacagcctgtcttactctgtttgtgctgctataataaaatacctcagactgggtcatttatatagaacagaaattgattcctcacagttctggaggctggaagtctaagaggaggcactggcagtttcagtgtctggtaagggagggatcagtgtctgctcccaagaggatgccctctgtgctgtgtcctcacccagcagaagagcaaaaaagggcgaacattctcaaaagcctcttttataaggacatcaatccattcatgagggcagaaccctcaagaattaatcatttctcaaaaggcccctcctcctaatgccatcaccttggggtttaagttccaacacatgatttttggaaggacacatacattcaaatcattgcacaaccaaagtgatatttgaactttcaaatagtttgcagtttgagatcaactaagttaattgcttgcttgaataaaaacatcacagccgggcacgatggctcacgcctgtaattccagcactttgggaagccaaggtgggcagatcacttgaggtcaggagttcgaaaccagcctgaccaacatggtgaaaccccatttctactaaaaatacaaaaattagccaggcggccgggcgtggtggctcatgcctgtaatcccagctctttgggaggccgaggcgggtggatcacaaggtcaggagattgagaccatcctggccaacacagtgaaaccctgtctctactaaaaatgcaaaaattagctgttgagactactcgggaagctgaggcaggagaattgcttgagccgagatcgtgccatcgcactccagcctgggggacaagagcaagacttcgtctcaaaaaaaaaaaaagaaaagaaattttctggattaggataatgttctatatttggataagggtttaggttacctagatagatacatttatcaaaagtcatcaaatggtacacttcagatgtacgcatgtcactgtatgtaaatattaccccaaaatcaacaagaaccatgagcaaatactgacttctagtgaacgacatgcatactgaaactttcgtagtgaagtataattatggctgcagttgactctgaaatacataaaaacctaagttgatgggtgaatacagtgattaatagatagaaatctgtggtaaagcatacggagaaaaatgttaattgtagattctagggtttatatatattctcactatataattaaacgtttttatgtttaaaaatttttataatgttgaaaaaccatgaaatcctacctaacgcagtaagacaagaaaaagagataaaaggtatatgtactgggaagtaagaaataaaaccgtctttgttagcagatgacatgctcatctatgtagaaaatccaaaagaatggataaagaaactcctggaactaataagtggttacagtaaggttgtaggatacaaggttaatatacaaaagtcaatcactctcttattcaccagtaatgaacaagtggaaattgaaattcaaaacaaaatactatttacattaatactccaaaaatacatacttaggtttaaatctaataaaatacatacaagatctttatgaggaaaactgcaaccctgatgacagaaatcaaagagaaactaaagaaatagacataagtaaatattccccagaaagactcaatattgtcaagatgtcagttcttcaaaacttgacctatagattcaatgcaatcctaatcaaaatctcagcaagttatgttgtggatactgacaaacttattctttttttttttttttttttttttgagacggagtttcgctctgttgcccaggctggagtgcagtggcgcgatctcgactcactgcaagctccgcctcccgggttcacgccattctcctgcctcagcctcccatgtagctgggactacaggcacgcgccaccatgcccggctaatttttgtatttttagtagagacggggtttcaccgtgttagccaggatggtctcgatctcctgacctcgtgatccacccgtctcggcctcccaaagtgctgggattacaggcgtgagccaccgcgcccggccaacttattctaaaatttagatagggaagcaaaagacccagaacagctaacacaacaatatagtaggaaaacaacaaatttggaaaatggatactacccaactccaagacttactataaagctacagtaatcaagatagtgccgtattggtgaaagaatagacaaatagatcaatggaacagaatagagagcctaagaaatagaccttcataaatacagtcaactcatccttgacaaagtagcatagacactacaatggagcaaagattgtcttttcaacaagtggtgcaggaacaactggatatccacatgcaaaaacaaacaaacaagcatgaatctagatacagaccttatgctcttcacaaaaattaactcaaaatggattatagatctaaatgtaaaattcaaaactataaaattcccataacataggataaaatctagatgacctaggtatggctatgactttttagacataacaccaaagccatggtccatgaaagaaataattggtaagttggacttaattaaaattaaaaccttccgctctgcaaaagaccacactaggagagggaggaaatatttacaaagacacatctgataaagaattgttacttaaattatacaaagccttcttaaacttaacagtaaggaaacaatctgattgaaaaatgggccaaagactttaacaaacaaaagaagatatacaaatggcaagtaagtatgtgaaaagaagctgcacagctggggggcgtggtggctcacgcctttaatcccagcactttgggaggtcaaggcgggcagatcacctgaggtcaagagaccagcctgtccaacatggaaaaacctgtctctactaaaaatataaaattagctaggcatggtgatgcatgcctgtcatcccagctacttgggaagctgaggcaggagaatcgcttgaacccggaaggtggaggttgcagtgagccaagatcgcgccattgcactccagcctgggcaacaagagtaaaactctgtctcaagaaaaaaaaaaaaaagctgcacattctatgttatcagggaaatgcaaatttagaataacgcaataacaagataccactacatacatattagaatggccaaaattgagaacactgacagcaccaaatgtggaggaggatgtggagcaacaggaactagagagaatgcaaaatggtatagccacttaggaagacagcttggcagtttcttacaaaactaaatatactcttaccacacaatccagcaatcacactccttggtatttacttacatcccaacaaaaaccctcatatggatgtctagagcagctttgttcataattgtcaaaacttggaagcaaccaaagatgcccttcggtaggtgagtaaataaataatatccagacaatggaaataccattcagtactaaagagaaatgagctatcaagccatgaaaaggcgtggaagaaactgaagtgtgtatcactaaaagtcaatctgaaaagggtgcataagtttccaaagatatgatattgcagaaaaggcaaaactgtggagacagtaaaaagattgccaggggctagggcagtgggagggatgaataggcagggcacagaggattttcagggcaataacactactctgtatgacactataatgttggatacatggccagatccacagaatgtagaacaccaagagtgaaccttgaactatggactttgagtgatgaggatgagtcagtgtaggctcatggattgtaataaatgcaccactgtggggggggggggatattgataactggggggctgtacatgtgtagggacaggagtaaatgggaaatctctacttttgttaccggtggagggtgtaccgcattttgaacaaaaaattggacaaaacgcacaaagcaaggaaagaatgaagcaacaaaagcagagatttattgaaaacgaaagtacactccacagggtgggagcaggcctaagcaggtggctcaagggcctgaatacagatttttctggggtttaaataccctctagaggtttccattggttacttggtgtataccctacgcaaatgaagaggatgaagggaggttacaaagttatttacttggtgtagaaaattagggtttttcccttttatttagttgtaggaagcccttaggttacctgcctccagaccctattctcctgcctcattttattcctaattttgttgtgaacctaaaattgctctaaaaaatgaaatcttttaaacaagaaaataaacttataaattgcaaatatgtgtcacttacataaaaacaaagaattagtgtccctacatcaggaaaaaaacacctataattcaatgtaaaaatgcaaaaaagccaagagaaatggccaagccatggaaattcacagaagtagaaataggcagtaaataaacaatgctcaatttcatttatctgagaaatggagagtaaaacttcagtgacatacaaaggagtaacaatcattttaggaacaattttaaaaataacacttgtgatgtggctcaggaaagattcatattctcactgtaggaaggtaagtgaatcattttagaggtcagttttgcaacttagaagatcaaatgcatctaccctttttctacttctagaaatgtatcttcagaagtgcccctccctccctcacacacccccaagtgtacaaaaataaatgacatggatgtggactgcagccttgtttctaataccaaaaatcagtaaacaacctaaaaatctgtatccatgaggatttaaagaaatcctgcatgagttagaaagaataaggtagatgcctgggttctaacatagaaaatatcaaactggttgttagatgaaaaaagcaagttgcaaagtgaggtaatgtgtaaatgcagtaagcaaaatacatcatatatatagtactttctatgtatttacctatatgagcgtgatgcctccaactgcatagctgtggctccgggagcaggaccttgtaacagagcctctgcccctgactgtcctgaggggcctttccctgggaaaggaaccaggtttgattttcagtctcttttgttatcaccatgctgacagctttgcttgtcatatgcctttccctccgctgtactgattttaccttacagaagctctccttagtgcttcatcagacactccctcttttccaaagaaaagacagccgcattccatggtcatctggttgagctcgaggtgagccccagggatcatgtgcctcccaccaggctgacaccccagtggtgaggagttgccccttggctttttcgaggccaagcaactcagaggtgtggcaggattgcatgtcacagtggcacttccaaggccctggagagtgactcaacgcctctgttattaagatgtcacacaggctgtgcagcaacaactctagggacacccttcacactgacagagttggcaagcttttcctataaaggggcacacagtgaatactgtaggctttgtaggccatactatctgtcccaacaattcaactttgcccactgtagctgtgaatcaaccgtagataatattaagtgaatgtgcactgctgtttgctaatagtttattgacaaaaacagctgcttttgagcagtttgctaccccgacagagactgtggggagtccctggtggcagcgagctacaggcagccagtaccccatcagtgtggctggttccatcctctcaagcctgcctgcacccagacactgtcgagtgtgtcttcagaaaaactcctaaaattccccaaaagcacagtggctccccgagagccacctccctcaccttcttacaggggcaggttcctcttccggttccaccctcctcagcacggagctcaggggccatccccacctcctcttggccgcaagcacagaccttcccacacaggctcagcagctctgcgggcctgtcccccacctggagctgcaggcctccactcctggggacagctgtgaccatggctctgcaaagcagccttgtgcctagctcccaagtcagctggcagcccagagtggaacaattctgtggatcacctctgagacagcagcacatctgggcaagcctggcttcccacccctcacctcctgcaacctctgacccttgccatgcatgtggtagggaagctgcaaccaggcctcagcactcccagacctgtgggcggtttgctgtctgaggatcgtggcactgccttccctcagaggccttgccagagccaggggatgcagcgtggcagagctgtcactggcaaccctgctggtctccctggtgctttctcagctgggctgtgggtcaggacaaatttctatggataaggctggatcataatctagtgctccatggtcatgcagcgacagactcgagtctgccttctctcagggtggtgagctcaggtaggaacgggatgtttgaagcaagcacacctgtgagaaatgcctgttttcactcccatcccacacactcgtccagacactgccagcccacccccgacacacgtgtctgagggaggctgaggaaaacagacacctccaggagccgcatactatttcctgatgtgtaagccagacaaccctggaaaggaggtcagggaaccggagtgcctgccaacgtccccagcctccctgcagcaaaacactctcatggcaaaactcctttttaaagaaaggctttattgctgcaattagacatcccagtgtatagcacaaacccccctgtacagagaattattcaagtggtaatactgagaaacagtgaacacacacaaaagaatacaaaactagacatttagatcactagaaactttctaaggtaagaaaaatttcaaatgtgaagtgccttttagaaactacaccacacatgccagtgtaaatttggtttaacaatcaatttctataaacattgcatctaactgtgcactgatcaactgcacaacttcaacaattacttccaagacaaagataaatgcttttatttccctatgttttggtctttccttgggctagagacagaagctgcatgtttcaaaccagattcaaaagggaaagcacttcaaaacagaaagtacttcaattgtgtatttgccttcagccacatccagagacttgtggatctcacccggttggtcccagcccttctccaaccctgaagcccacagcaggggtgcagaggcagccccagatcgtgcagacatcacccgaggctcccaaactggcccagctgcctgaggcctgcatgcctgtggccaggtaggacacatgtgcaggtttgaaaactaggcctacaagactgaagagtggactgaagcaaaaaggggagaaacattagaggcctacagtaggaagagaccttttatagagttttcaggaaattctcacaataaacttgggcacaaagaccaaattgctgaggccagaagcctgcttatggtactgtgacttatggggagtagaggccaaatcagagagggctggctggtgataccccagaccacttgcctcttccccttccctggcctacaaataccaggcctcctggccctgagacctcattctgggtttctatatgggtcaaccaaatgccatcctttcactaaacccaggtgcaaaatggggggggaaggggggaagctggggagtacacagcacccaaaagaaccgagagagcaagttttccaaggctacaggaacattggcagagctggtggccacaccagatgggagtaccacatccccaccaggcttcatgcttcactgctagatgcagggggctagaagggtctgatgaatcaggagctgaactagaaccttcaagaaaagaaaaggcaagggggtggctctgtgccccgccaggagaggaaagaagaatgtgtgtggattgtccacagtgaggccagaaacgatgagatggtgttaggcagaaaagaagggagagggcttcccatgagaatctggctgggcatgggagggatacagggctcagttatcaaggcacctttgccatagtggggtgccagctacattgggtgggatgcccaggggctgtccctacctaagcactttcttgtctacaggaagtcttggtgcttttcaagttcagcataaggggttccatatgtgaagtggggattcacacttagaaaatctatcctggtcttcacctgaaacactcatctactgctgggtggcaggaacaagtatacaaaaccaggggccttgcctgggcagttcctaagggacattggcagggctgacctgggattcagctcccctgagtggacagtctgtggttgcctggggtccccaggctgagaaggggtatgggtaattgcacttcggggcacagtgaacacaggcacgggctggatgtgccctgggagacagaaaggagaggctgacctattctcaggagctggctatggctggacagtgcctgcccggccagaggaaggccacagcagagccactccacagactaagacctgtgttgccaaggaatcagacactggcttggaggagacaggaggacaaagcctgctgctattaagcccacaccgtagcttagagatccttcagcctcctggccttcaaaacaaactccagggcttccactctgaaaggcaaaggaatcacctcgtgtttgcttcatccccttagcaggatgaacgaaacgcctaaggcccaaaaagactgagggcaggacccccagcatctcccatctcctccgtgcaggctgggtgagagaatggcctggaaaggaagcatctgcgctacattgtgcttcaggcccccccagcaactttcccggaggtaactatttgcctggaaaactaggaaactgggttttaaaaacagaattttaagcagactttttagagggacaaggccatttgatggtagtgattttggttttgttttatgaaaatggtacaggtggtaatccctgatgacagaatgcactgagagtggggccaagggccctgaaggatcctgtctgttcagtctggttaaggcgacagctgggcgggcatgtggccggggagcagtggcacagcggaccctggcagtttgctcacacctggccctcgtcccagagccagcccacctgcctcttggccctggtagtgactccacagaacttccccgagcagaagcctcacagtgggccagcacccatcttgcatgcaagggagaacctgcatgcagtgcacacaccccggccagggtggcacatggctgctctttcaatgtgaagccaacaccaactggagagatttaactataaaggaatattttttaaatattcagttttgttgtcattactcacttcctttccttccatttcgatctcagaaactgttctttttcagtgttgacaaaaaagaaatgtatgggccaggtctacaaagtaacaccttgtcataaaacaggctcaaaagcataggaatcatgctttaattgccatttagcatccactaattcccatgagatctgtgattaaaaaaaaagcctctggcctgcttgtcctgtcttaaaagtcatgagtctgttttatgaacagaaagaatgccacgcttcttagcatatgtaaggcaaaatggatttttgatctctcatgatgtaaaggagatacaaaggtaaggaagggaagatttctaagtgagactttttttgagtgtcaatcccgctggacacacatattacaaaataaagattttcttctgtaaagtgctgtttgctcagtgaatcatgcgccaccacagagcaccatggctccacctgctcaagagcatggaggaggcagcatcggcagagggcaggcaggagtctgtgtttgggggtctgtttcaataccatctcctggggttcgccgtgatgcagagggaatcttctcgtcatggctagacactccccaatgctctgctccaggctggggaccactgcaagctggaggcggctgggtatcagggcctgggcacccctgctcctcctcttcccttgggattggcattttattctctcattcagctcaagaccatgggcaggaactctgctggctccccatgatgtcatcatggggtcttccactttcccacagagctgccaggcagaggcaggacccaggcatgcctggcccacaggaaggttttctaggagactaaggagggtttagaaaaagagaagccactataaatagtcacctgtccagtctatgctattaaaggacataagaaaggtatacaattggcagtaaacaatttccttcagctcttcatggatgtccaggaaaatgacaacccgcacacaatcagacgtgaatgatttctgctccagtgtcttcaggctctgtgcaacaagaagagtttgtgtcggaatgacagattccatatccatgtttattttcaaagttgggctctgttagtggagatttttcaaaaatattctttttgcttgtttctggacagttttgaacatagatcactctattataggccttgagtctcttccacaattgcacatacactttacactgaacatacataaaaagaagtcctccggtgaagccgatggccacaaccaccaatttagtccaaaagggccattctaggattcctggaagggaaaaactcagcctattagattttatttaagatatgaagtaaagaaaaacacaacttctgaacttcccataatcaactgattctttgttgttgttgttgttttttaagagatggagtcttgctatgttgcccaggctggagtgcagtggctattcacaggtgtgatcatggcacactacagccttgaactcctgagcctcagcaatcctccatccctcagcctcaagtatctggggaccacaagcctgcaccactgaccaatggattcacaactcatccaatgttgctcagtcaaagaagagtggaagacagtgtccagctacttcctgcttttataggatgtagtttgcggagattctcatgctccagaatatgaactctcctgactgggtttcaaaaactaccaccacagcaaaagaaatgccaaaaaggaggctagtgcctcctaactgatgtccctcctccggaaacccagacgtttttggctaactggaaaatcctctgaccccaggactcctgtgagctatcccggcccccatgctgagcttgctccagcctgagaactcacctgttgcctgcccctgcttgatctcctcagcagtacggtcaatgagcacatacaaggaccagaccacacatgtgatggcaatgacgtggaatgtcactgagcacatgatcttcctgcgctcgctggacgtcatctgcaacttctcccactagaaagacaacacagagtgtgaggctcaggcttctggggaagggctccggtggggtgagagcattgtaggtaggtaagattggctttccaccccacttctcccttcccaaactagatgcattcccccaagtattgttctcctaaaaccacttggcttcaaccaggtaccaggtgcagccaactttctatgcaatgaaaagaagccaggatcaagatgaatgcagaactaccatcaaaaatccccttgtctgcttattcttgcaagcagacataagatggcctgataaagaattctatgatttcagtcctaatgaaaacagtatgttggcccaggacccaggtactacgttttaagtctccctgatgtgctgactggcatggacgagcggaagaagagggttgatgatgccacaacacactagcagatgggtcacactacattgtgaaggtgaatggcagaagacgctcactctttggtccttgctactttggcagcaacagctcgaaatcgacgctaagagttcctggtacaagcagactctgctagtcccatctcctctaggagctcattaatttactccaaatagccagactttctttttcatttactggtttccgaatcaggagaaaacacataaaggtagagagaaagaacaatgtgtaaacactctgcacatatcctttgccaaccctagtcacagcctctttccagatgagtctatgcagggtagttgaaaatagagcctcaaggacttcccatgttgagagattagcatagagtaggcacccaataaattacaaggtttctactgggcaaaacatttttttaagcagtttgcacaagccttctctaaatctggttgttttctgctgggattttatacactagcaagttccctggtcttcctacctataatacagagtcagtgcctcagtgccccatgctccctgctacttcctacaacgcacgtagcttgacaccctgtcaatgttcaccttcacctttctagggtatgctttactccacagacagcctgacctctctaaactccttgcactctgcctccaaatcctagtgatccttcaagaactgctctaaaacccaaacaccctatgaggctaccatcgctccacttccccagcactctagctcataatgagcatttccttttctgaatgactgttatgctctaccagcacaccatttagcatttaattggctagtatttgattatgtgacttatcttgcaatttatatattaatgttctgagataggaacagttttttattcttccagacaaaaccttttgtgctgggcatctagagagatatatgaaacagtcaaaatttaaacaggaagccagtgtggcggacaaagctcctctcagagggagcagtgacatgggcctccagacagctgcgtgtcatgcaatgcctgtgggtcctttctgaagacagttgcacatcacgcaacgtttgtgcttcctttcttttccctatccacctactcacactcccatccagcaaatagttatcatgggtgtatacaaataaatttactgtatgctacactgtgctgggtgctggggagatactaatctccaacagacagtcctaatcagagaagcaggacgtcaacagttaatatgtataaaattaggtgctaagatatgtcacaaacagtctgtagtcaaaggccagaggactgacaccgacaagcaagcagtcttactttgaagggaaaagaaggattatgaatggtcagaaagagcttcttcctgagaagagggacttgaaaatcagcaccagaaacaacaatctctacaatgcaaatgtaagcaccagccccagctttttaaggaaatgaacgcaggcaagccatgacctcatgatctgagacaccagctttctgggggtcactggtttcaggaagggtgaagcatcccttcctcccacgtacttttctcagtggcttcagcttggtctccatgatgaactcatacttgcagagctcgcagcagcgcgtgtcggagctcttgatccactgctgcaggcaggcctggtgcacgaagtggaggcttcctgtgcagtggcagggggtgatcagggggctctcatcatctccttcacagtggcagatcctatggtggaaggaaaacctgtcattccaaggacagtcccatgacagggaagctgacacttcagtggcaggttaatccccccaaaggaaactcagaaacgaacattacagaagtgactatgggcacaaaaacatacaaacacaaacgaaaacaatcactacaaactaaaaatgtctagcttaccgcaccaacatggaaagtctggagggcatttggcaacagaaaggaaaaaacgatgtaagaaatgacaaagctgtcattttttggtaagaaataagaacttcactgaaagatgaatttaaagcaacatggaatcattttccagaacataagatggtaaaataattagagggaaaatttctatgtaaaacaaaacctgcattccaacatccaaaaataccagtgaccttaaatgacgtttgctttttagctataatcactgactttaccttcataccccacaactacacatttctgtcgtctctcagcaagtaaacaaagatgacagtacctctctcctagacctaaaaaactcaccattacaagatgctgcaatttcatctctttttcttgggaccactaatagcaataagtgagaaattaatttgaaagcactctctatttccaaggaagtatgcaacaaggtgtagctactagcctgaaggaacttaacaggcttttaagaaacagaggggtcttttccagcagctagagaacaggttggggcactcgtcctggaaggagccaggctctcaggctgttttagtgaggggatctctgatccaaatgttagaaatgatgacagctggcactaaggagcggagactggagaaaggtcagaatgaggagggcacaagagtcatgacaaaaagtgaattatggaggccagacaaggatgctgcacaagggaagataaaggggggaaacagagttaggatgggacataggtggctacacctcagttaaaaagaaggaaggaaggagctactggagaacagccagtccccacacaccttttgggggtaggtagggagcaagggttaaaaaagaggctgggagatgcaacaatgcttaaaatctggaccatcaggctggaaaactgaagatactagtttctttcttccagtttctttatgcaaagtctacttatttttagtttagaagagtcagcttggcctttaatatgtgtagcttcttcctctttttttttttgttttgttttgtttttttttagacagagtttcactcttgttgcccaggctggagtgcaatggcgcaatcttggctcactgcaacctccgcctcccgggttcaagcaattctcctgcctcagcctcctgagtagctgggattacaggcgcccgccaccacgcccggctaatttttgtatttttagtagagacggggtttcgccacgttggccaagctggtctcaaactcctgacctcaggtgatccacccgcctcagcctcccaaagtgctgggattacaggcgtgagccactgcgcccagccagcttcttcctcttttatcatttgtaaaactatcttgggactcacatcataaaaattaagtttttcaaacgatattgatactccattcttctggagaaaaccatcaacccacaactggttacaacttcctattacttcattttcctgaaacttcacatactaaagcaagaggaggttcctgatgcgagcagagatggctagaatggcacttcctggcaaaccaacctgcagacatcccctgacgtggacacgggagatatggggggtaatttttcagagaagggagaaggacaatccaggtcgctgtccttttccgtggagcagaggggcgcccgcagaaccctactcttcagttttgcagatgtgctgtcctcaaagacatcgtcgtctcccatctcgtcagagcagaagcccatactccctgccagcccgctggaggacttggcagtgtgcaggcgagcagcgcagctctccagctcatggaacctgtgcaggctgctggcgctcaagccgtgcgagagtgagaacaggtactggagcagttgccggcttcgggacgtggcctcaccatccgccttctcttccagcagcaggccgggcctgccccccttgccagcttccacctctgaggcagttgagcgaccggcagaaaggcatgaaacacaagaatgtttggaattgccaagaggtttgtggttcagggttcttttttctttatgatgaaacctgttagttctgagacacgtatcttgagggagtattaatttcccttcagaacaagttctttccacataggcaaaactttctgaagtatcctgcgccttctcacccacatcattgagggaccttgagaactttagtgttcttctggctttggtattcttagcaggcttcaaggcctgggcccattctgaaccaaaggaatttctctttgacgcctgtaatgtgtccttacagataactgtcacagtgagcccttgtgtcagagaactctggcagtgaggagctttcgagacaacagcagactgcacggaactgtggtgacaacactcagaaaacactgcactggaactgcatgcagaacagtgggataaaagcacagaaagtaaaaacaattttaaaagagaatagacatcatagtgaagaaatgagactagcatgggtaacttggtgagcaaaccacacataaaactcgccaactgtttagaccaaaggcagattgattaagcaaatggaaattcaagaacctacagacactaatgcttatttctggctgcacactgatcatggcagcatctgaagcagagtgttacctgcagatgtcctggctggatggcgtgatagaagtgcgagagaaggaggacaccggagccggagctgatgctgacggaggactcccagcctgcaatgacagacctgtggtcagtgttcaggtaagagccaaggggattgtgtgcactgtctcctgaatggtgacagggagaaaccctagaaatgtctgctgcttcccgctgctcaacgagtaacacatattagatccttctaagccttggcaaaacaaatcaaatatcactatttttttcttatctgtggataaaagtgtaagaaatgtctaaggctatggaacaccactactaatctcttgcaggtccagtggccgtttattttctaagcatctaaattgagttagttcatatataagtcaaaaaacgaagtactagaaggtatcatacaaatgccaaagaaatatgaggctccaggcctgctggcactggcttccctagcactctctcctagttcccaagatcaacaaggctggtagatttaagagctctctcccacctcacaacctcatacatagtgccagatgctccctgagttccacaaaacctcactgccctgccacagctcttcacacaaaagggagtccagaccacgtcaccatgggggacaccaatccatagctcaaccaggggctgaggtagagcacagaatgctcccaacagatctaatcttgaaactgtaaattaagaaaaataatcaagaaaatttagatttgaaagaaagtacagcaagaggtcatgggatagaacagagtctctggggtggtgaatagtcaaacttagagaaaaaaatctaggaaggagaggaagcactgcagtgaggagagaaatggacagagagaaatagggacagtgagtggcactgagctgaggatgcaccaccaccgctagagggccccagactcccacgccagcctcggattccccaggctccacagccccacagacctatgcgtattcataaaaaagcattcttccctccttaagacagtaagcctgagtaagaatctgctccatgcaaccccaacagccccaggaaaacagtgccacgagtctgttatcaccagaaaggccatatcaccacccaccttctgcaggcccacctgcatggcccttggccctaactccttgatacaaaggagctccaccctggcccaccattccctggctgaggcctagtccccactctttctaagtaccatccccaagggtgcactctcatcctggaactccacctttgggacccccgacccttggtcaaccaccagaacagataaggccattgcctggaaactcctcctccccctacccctcacagcaaatgaagcagcctggagagagccaggatggcactcggattaaggcacccatcgcatggctgctcccactcccagtgcagagattcaacagcactttaatgcaagtccacctgaagaaacaagatccaagaagctctcatcagcatgcttcatgtgtacactgagatcacgctgtgccactccatgagcacatcttcgaattcaccaaagaatctacatttattttctaactgaatgtgcatatgggcatgaggtacacggtctttaaaagcattagaggtcaaagttcttaggaatcttaagtttacttggacacatgaaaatagcatccttgaaataaccctcccatcactacctttgtcaatattcttcctgaaacaaaatgaaagacatctagggatgcctgtggacactatgctgtgacatcccttgcatcttctaggcctgactgcataagccattgtcctttttctccaactgccttagacactgtcccctctccagcatcctcctctcggggcacccatcactggctccacctgccccagagacaagcactcaaggccttttagtacaatgggctttactgtttataccacaggggagcagattgagagggtatccatgctaaggtccccaaactcctacagtccccctgttctctgacatttagtcctaacactattctgggactgaaagccttcctgtacttattgctctcttcttttatttctgaggatgaccagctctgttcaacacacataggcaaggctaaaatgtgtcatgaagaccaaagcctgatcacggtgtattgcagagaagtaagcgtcttcatcacctgtccccaggtagactttgaggaagaaatacccagcaatatccacatgcttgcccctcattgctatgaggtcacttcttcctctgtgttgctgggtcaagcatactccctggaactgatgaggcattgaaggaagcccccttccttcaagggatggcagcagaggaaagtacctagtcaccctcctcccttttatcttagtaagagcatggtcctcttggaaccacgtgtactttcctgtattctgaagggaaggcaaaccctgttgggaggaggtaaggtcttatctggaaaatcgtgcccaatcaaggtcagtgtcctgggtccgggaggcaggtttctgatgggaaattaaagttctgaactccagtactaaactacaagtaatccaagtcaaaaagtgtactctggggtaacgattccatccttgcatgcccatgatgaggagcaaggcctgaaggtaggagggcagagcctcgtaacaaaacaaagcctggatcaaggaagcagccacaccaggcacacacacacgtcaggacatgtgttcacttccctgtgtggttccccatgtgtgtgcacttgtagcagatgtcaaggccagcatgacagtgacagcggacccaaggaggaagggagttctggcagggctggggagattctgccctgctcagttttacttaggaaataggaaacagcgttggcatcctctgcctacatttctgctctcatttcaccatttccaatcttatgaaaacattacaggatactctcagcaggtatgtccgatcctcatcaagcctcccaatgacagagaaagagtctctcttcttattagatcacagaatttaaagaaaaattttaaaatctacttattgttattttacataaatataaacttcaacaaatgctaactcttccaataaaagcaagaaaaccagtgagatctgtggggtcttcacagctcccagaagaggctccttctgtcacgatctaaaggacagcaaacatttcaaaggtcagaaccaatccataggcagaatggtcaagaaaataattttaaagagctttatttgttgctgctatagacctgagagaaatctatcaaccaacaaagacctaaaagactggcctgatcaacaacaaaatgaagctgacagcttcaaataatggttccatggtcagattctggaagccagtgtaatcaaaggccagcaatcccctcttaggagctctgcaggacagaaccttactagatgggacaggacctcactagatgggacaggaccagccgtcctgctctttctgaaagcagcaggcagtgtggcacgtgtgagccgggggcagtactagctccagagaacacctacactctcctctccataggatcagaccacacacgactcgacaattactaataaaagtgcaaatgttcatcatgcaaaaatccaaatgtgtcaagaaaacttaggccctctgttcctgaagttctttgcgggttgccaaatgacagactctccagtcatgaaaaggaatataaagcaatctcactacaaaaaaaaaaattcttgtaaaaatcctcccttcttcagatgttgtaattaattatgccaaaacaaacctctggatttctatccaagcctaaatcccagtttattttatttcttagaaatgataaatactttttgacaatttgttttgctacatccaagtcttttagtggctggctttgttatcaaattcaccattttaaatgattttaacaaggttgccaaagaacatacggggaaaaaaaacttttccatatatccttggcagaaactggcattccccttttctcagttcccttctgagagtgcctgctgtcgctggagcagctatagcagtgtgtttacccagttgatagtgcacacatccttctcactgcaggacaccagcgcaccttccttggcctctggcgccttctgccaggttactgcccagcctcctctattacccacgcccctcattttctgtgcaacccccaactgggcctccttttcactcatcagctaagctacttttaaacatttgggtctcaggcccctaacaaaagcaaatttgcccatctgatttatttcaaaagggagagggccacaggaatgatctgtttgagtgagcttgtttttaggcaaggaggaacgtgaagacaggctggataaggatggttaagaggccagaagagctcatgtttacaactcatcacaaattacagtactgcaaatcaatgacttaacagaaacaatgggaaaagatgcacagatggctctcaaaacatgaaaagatgcttcatttctctcacaatgagaaatacaaattaaaactacaatgagataccattatcagccaagaaaattaatcaaataatatgtgttggcggaagtgttgggaagcaggtatgcttatacattgctggtgggagagcaaatggtaaacctccacaggatgacaactgccctcaggatgacaaaggcacatatactttgtctcagcaattcttttaggaattcatcctcacacacctgcgggaagaggtttgtacactgcactagtttgtgacagcaaacggctggaatcaccctaaatgcccatcaccttggagctgaggcaacactgttccatctacagaaagaaatatcagcaatcattaaaaaaatgggaaaagttctcattatgtccagtaatgaacacacaaagtgaaacaagcagagagaggcaccactgccatctgtgctggtgctgcacagactactcaggagggagaccagggaacctggatggagggacatggacttgtcacagagacccacaaaaccataatgccactttacactgagcaacatttcccaaacagaaattcattcttaaaataacaggtgattgatgattttaaaaagtaaaacaaaactgcagaagcacaaccaactgcaacaactttccgactttgggatgacaggtaaagaaatcaatgtagtgggtgatgacctatgtttttaaaagtacaataaaatagaatatgtcagaatgtatctgacataaaaaggataaagtcttttgaggtaattttgtctctcagatgtgtatgcaaaagtgaactgggtttcaatataaaagctacttctggccaggcgcggtggctcacgcctgtaatcccagcactttggggggccgaggcgggcggatcacgaggtcaggagatcgagaccatcctggctaacacggtgaaaccccgtctctactaaaaatacaaaaaattagccaggcgtggtggcgggcgcctgtagtcccagctactcgggaggctgaggcaggtgaatggcgtgaacccgggaggcggagcttgcagtgagccgagatcgcgccactgcactccagcctgggcgacagagtgagactccgtctcaaaaaaaaaaaaaaaaaaaaaaaaaaaaagctacttcttactttggatcatggtcaaagtcacttgaaagtcactgcctgactgtatttctacaaagaaaataaaaattatcaaaaaaaaataaaagaagaagatggctaaatcaagagttcatgttggctgttggcccagaggctctagaagcaaatggctcttacagatctctagaaagaaggttttcctctacatggaaagcatttgccacccatataagaggtgtgttgctatgtaaacaaaacttagtggcttaaaactacacaaatgtatcacttcacagttcccacagactaggagtctacatgcgcatgctgagactctctgctctggtcagtctccctccttcctggaggcctggggaggactgcgtttacacattctctcaggttgttggcagaacacagctccctaaagcttgaggactgagggcccgtctgctggctgactccacctggggcaggccacatgcatctgcagtcacatgaccccttcccatcttcaaagcccacttgcggtatcaatctctctgacttccctttctgccaccagtcagagaacgttctctgctttttaagcacttgtgggattccattgggcctgtatttataaccccaaataatctcccttattttaaggtcaactgtgccacacaacacaacatgatcataggagtaataatagcaatgcattcccaggttccaggcaattgtggggacatttttgggggccgttttagaaatcttgctcaccagatcacttttttatttgtgcttcctgctcatgagattgctagcggttactgccctcccacttccaaactaagagatagggatctgctcctaacggtcaactcggcaggcctgacttcataccacagagccagataaactcacttggtgtttacatattgcaatgtgcagactgagattacatcttgacaaactttctgcttagcacagaagttactctgtcaaaccaatgcttcattatgagtaactctgctttcgataaatacccagttgtattcaacttcaaaaatgagccacaattaaaagaaaagaggccattctgtggcttttctgtggcttgctctgataaatacatgttgactcttatgaagggctgtgccaagaacaagctttcacaaaggcaattaattaaaactgaccattaaaaaagtaagtatatacaatatacttacagagaagcatgtacaattaaaaactactgaatgctaaaatgatatccattataaatgactctcattagcattgcttacgccaagtagcactaacatggaattcttttctacagtggccttttaaagggagtcggaattacttgagtagcaataaatccccagaacaatgaggggaatatattacagcactggtggaggggacagaaggccacagctgaagggactttttcaggactgtcttcctccatgctgcagctgaggatcttgcaaatataatttgttttcaataaattacattgaagacaatgatttctgagcaaaggtggcttcacagtcccagaaactaaagatgtaaccatataaaaatccaaaatcaccagaaataacacggtgaaaggggctgtgtttgtgagttacttatcactcacaaggaccctttaatactgttgatttcctttaaatattgaacttttcaaatatagtcgaaatacattttcattgccaagaggcaataaaatatttcctctgagagaattctggggcagtggccaaagcactggcttttgaccccaaagtcttccctctgtgttctggggccagtccactgagcacactaccgagcaggagtttaatcatttaaaaaatgaggtcaacaatctacagggctgctactaggatcaaataaagtcaagggagatgcagaaatgcagcacacaccactccaggcacacctccagtgtggaacaagacttccgtgtgactaccactcttgattcttgatgacctagagagtaaacctgcaggtctcatatctgctacaaaatgcctcattccaaccaaggtaaccaccgtccacccacctgggaagaaaacagcttctgctcaggctactcatctggccagccctggcccaagatgcacagaactctaagagcgaaccctgagccgcggagtatactactgacagaaacatggcaggcaggaaaaatgaccctcacttcctctaggcctaggccctcctttcccggcaactggtggcctttcccacccctcctcctcctcccaggaacactcccacattccaacccagcatgatggcccctcctcctttctgaggagaaagggcttttcatccctgttatcatatccttgtaccctattcatttctttcactgcacctatcaaggtttataagaagatgttactgggatatgttaacttagaagctgttgctgattggtctggtacacactaggtgtttagggaacatttgctcaatgaactaaacagctaccctctggggagactgtgcctctacaacagagattctcaaacttgttggccacaggacctccttaaactcttaaaaattactgaggccctcacaaaaagcttttgtttacacgggttccatctctccatctttgctatattagaacatcttaaaacacaggaacatattccaccagctaaggaagatgctatcctgcatgttgcttagcttctggaactccgctgtatacttgtggaagaatgagagtgaaaaatggaaataatcttggtattattgggaaattgttttaaacctgccccccttccaccttcaggagactgaaccaaacttcagccaaaaactaaactgtaacagtcagatgaaaaaatactgcaaagacagtcggttaaactttgcaaaaggggagctgaacggaaacactgcctcagtgctgtcaggattcgagtgaggctcagtggtgctgaggccacctgatgccatgaaactcctccaattcatcctttgtttttgtcacttaggaataaatatcctgttttgggacagctgttttcttcagaataaattaagaaagcacattttgccttatttgtaacccataagttttgagtaacctgagcgtgtcactggtcaactctgcattcagaaacagaaagaagcaaaccctggtcttgacaatcacatccaggtctgccctcgcgtaataaaagtgggtcagcaagaattccttgtaaggaatgtccctctgatacgtgacattctgctgtatctcatccctgtctaatggcaacaataaccggaaaatattcaggaggcctaggagggttagtgctcaaattcattgagatgtgcttgccaagcaatagagcaatcattgtaattgctcattaaacatgtccagtctgattctacccaggaatatttgattaacaagaggtacatatcacagtctgcaaggccccagccttgggcaactgccagagcctacagagccaggctggctagggggctggcagagagatactcgtgctacgggcttccactgccttctccctggggtaagtgctgccaatcatgaacttgctcaagaaattgtgtcacctggaccaagtttgattcccagggttgaatgagaaggcttccctggggataaaataacattgtgtctatgtactgccctttttgcaccacaatcttcctctgagaggcatcaagagaggctccaaaaagtccagcccctatgattagcctagcctaggccaattcctggtattaaagaaattccagctgaatagagtgggtttaagcctcctctgcgaatttcaatcagcctctataggattttaggccaaagtactcacatgaacagccacagtcaacacaatcttgtggttacagccacctgcaatagggtgccatgagagccatcacccccagccactgaagatgcctttcattgtccatctaaagtactggactttccaagcaggtgacaaatgatctttctactacagtttaacctcatcctggttggctcctttccacctctcacatctgctttacatgtctctcctgagccacatcttctctgagcagtccttcaacttgggttccctgtaattctctacctaagctccttactgttccctttgtaggaattctctccatccgtggtatcgtatagaggtctgcgtacttccctctgctgtttggttcagcattcaaagcacaatttctggcacacagttaggtgctggacaaaatctcaatgtgtgcaatcctcgtaaactctgcatggcctccttgtctccatgttagagatgagacatattgtcaaatggtaagacagcctgcaggtgggggcagtggtggcacaggacacaacgtcctgaacaggcagtcacctcacgtcacctgagtccaccctgaggccatgcccagtacactgtgcatcgcccctgccagccatactctatggcttcctggtaccccgagacaatggccccttgacaggcagaggctcacagcagagatggaaagttggcttgccccatccccacccctcccttctctctaccacacagcctcctgaatacccatctgtcagagctctatctcacaaagggccatcacaatgagtttaggtgatataatgaagaacatgctttttaatagttatattttcacattaaaaagttaaccaatcaaaatctagaggaggggcttcaagatggctgactagaggcatctggtacttacctcctctacaaagaagaaccaaaatagcgaggaagaatcagactttgaatagatcatctaacagagaacacgaattcaacagagaagtgacagaaaacacctagagcaggcaaggagagggcagtcaggcaaggcagccaagaggttccccagtgtggggaaaggggaagcgagcgatccccagcggtccacattcctaccatgcacttctgcaattccagccatgacagagccctagaccctcacaggccttgaggctaacagagggagctgcctggagatggcgagaaggcattgctccagggagggagctcgtgatgggtcccacacacccctggagtccaaggcagctacaagaagacaccatactgagagcccagtcctcaggagactgcatcctgctgggggcccaacagtccctgcttcttcacatccctggaaccccactgatattcctcaccacagccattgcagcagctagctgctgctgccagggatgaagtgcaaaccatttggcaaagaccctgctgcttccagcagtgaagccactgcacgttttcacaagcgccaaggacaaagtgagcaaagtgtgcactccctagccgctggcatacctattgccactgaaagcaaccccactctccccagtagtagggctgcagtatagccactgctgcctccaccagagcattctgccagggccttggaatcacccagcccctacctaagactgttagagcctgaatgcatccccggggggggctgaagtatgtcctacccagttcctgagtaaaccatcctgaggcctggggactgcgcagcccattccaccactattggaacctgagcatactgcctgggcatctgaggtcaggcccacccaacctgccattaccgccacatctagcactcaattgcgtacacatttgggcctgaagactggttcaaccagcccatcacagccgcaaactgcttgggagccagagggttgtcctgccactgctgctgccatcacccatatcatgcctgctgcccaggagcccaagaattcacccacccacccagttcgccactgccactaccagcgtttgagcaagctacaaggaggtcccccaaaaataacccacctgacctgctaacactggtgccagcatatactgcactgaggcccaagggcaggcatactcaccccactactgccaccactgggaccaaggacaggccaacctggtatccctgtccccagcaaaacctcactacagcctccaccataccctaagatactgaggaaatcacagacaccacaaacatgacttatagccaaagaaatcatacagagactatactactgcacacaatgagaatcaaagctaaagtgccctgcacaaccaacaccatagacacaccctcaggaaaaactcctctcctacaacagcaaattaagaaaactagaagagactgttacaccagacgtgcagagattaacataaggacacaagaaatgaaaaatcaaggaaatatgacacccacaaaggaacccaataattctccagcaataaattccaatcaaaaagaaatttatgaaatcccaaaaaaagaattcaaaataatgatattaaaactcagtgaacactgggcatggtgactctcacctgtaatcccagtactttgggagccccaggcatgaggattgcttgaggctaggagttcgagaccagtctgagcaacatagtgagacctcgtctctataaaaaatacaaataaaaattagctgggcatggtgatgtgtgcctgtaggcccagctactcaggaggctgaggtgggagaattgcttgagcacaggagttggaagctgcagttagctatgatcgcaccactgtactcctgcctgggcaacagaccaagatccggaagctcagtgagatacacaggaatacagacaaacaatacaaagaaatgagaaatgcaattcaggatatgaatgaaacattttccaaaaatacattataaaaaaaaaaacaaacagaaattctggaactgaaaaattcattacatgaaatacaaaatacacttgaaatattcaacaaatagatcaagtagaagaaataatttcagaacttgaagacaggtcttttgaaataatccagtaagacaaaaaaatttaaaaaaggaatagaaaagaaagaacaaagcatacatgacatatgggacaccatgaaatgaccaaatattcaaattttcagtgtctcagaagacaaacagaaaacaaaaaagatggaatatctaacaaaataatagctgcaaacttcccaagtcttgcaaaagatttagacatctagatataagaagctcagagatatccaaatataattcaaggtctcctccacagcacattatatagtcaaacagtcaaaagttgaagcctaaaaatagcaagaaaaaagcatctagtcatttataagtggacccccatcgaaccaacagcagacttgtcagcagaagccttatagaccaggagagaatgggatgatatattcaaagtgctaaaagaaaaaaaaaaggccagccaaagatactatatccatccaagttatcactcataaatgagaagaaataaagtccttcccagacaagcaaaagctgagggaattcaccaccagattggtcctataagaaatgcttaagggaatcctacacatggaagcacaaggacagtatttgccatcatgaaaacataccaaagtataaaacctactggtagagcaagcacacaaataagcaaaaaaaaggactcaaacgttaccactacagaaacccaccaaaccacaattataaacaataagaaagaaggaaacaaaggatatacaaaaccagaaattatttaataaagtgacaggaataagccctcacatatcaatagcaaccctgaatgtaaatgaattaaactttccactggaaagacagagactggctgaatggatttaaaaaaacattactcaactatatgctgtgtacaagaagctcatcgcacctgtacagacacatatagacttaaagtacagggatgaaaaaagatattccatgcaaataaaaaccaaaagcaagcaggactagctatacctatatcagataaaacagactttaagtcaaaaacagtaaaagacaaagagagtcattatataataacaaagggattaattcatcaagaggctataacacttctacatacatctgcaccctacaccagagcactcagatgtataaagcaaatattattaaatctaaagggagagacagacttcagtataataatagctgaggacttcaacaccccactcccatcgttagacagatcatctaggcagaaaatgaacaaacattacatttaaactgcacgttaggacaatggactaaacagacagttacagaacgtttcatccaacaactacagaatacacatttctcagcacacagaccattcttcaggataggccacaggttaggacacaaaacaagtctcaacaaagtttttaaaaattgaaatcatgtcaagtatctttctcagaccacaatgtttaaaactagaaatcaactagaaactgtacaattacatggaaattaaacaacatgctcctcaatgaccactgggtgaaggaagaaattaaggagaaaacataaaaatgccttaaataaaaatcgaaatacaacataccaaaacctgtgggatagagcaaaagtagtgctaacagggaagtccagagcaataaacacctacatcaaaagagtagaaagatttcaaacaaacaatcgaaggatgcacctcaaggatctagaaatccaagtaaaaaccaaatccaaaattagtaaaagaaaagaaataataaacattagaggagaactaaactaaataggagctaaaaaaaaaaaagatcaatgaaacaaaaaattaattttttgaaaaactaaaattgatagactagctagactaaccaagaaaaaaagatagaagacctaaataaaatctgaaatgaaaaaggagacattacaaataacacagaaatacaaaagatcatcagagactattacgaactacatgctatcaaactggaaaacctagaggaaatggatagacacataacctaccatgattgatcagaaagagacagaaaacttggacagatcaataagaagtaatgagatttaaagagtaataaaaagtctcctaacaacgaaaggtccaggattggatgacttcactgccaaattctaccaaactttcaaagaagaacaattcttctctattccaaaaaactgaagaagagagaattctccttaactcattctactagaccagcattatgctgacaccaaaaccagacaaggacacaacaaaaaataaaactacaggccaatatccctgataggcatagatgcaaaaaatccttaacaaaatacgaataaagcaaatccaattgcacatcaaaaagacagtacacgattaagggaatttatccctaggatgcaagggtctttcatcacatgcaaatcaataaatgtgacacatcatgtaaacagaatgaaggataaaaccatatgatcatctcaatagaagcagaaaaggcatttggtaaaattcaacattccttcatgataaaaattctcaacaaactaggcaaagaaagaaatactgcaatattaataaaggctatatatgacaaacccacagctaacataaatctgaatgggggaaaagtgaaagaaagccttccctctaagaactggaacaagataagaatgcccgctgatatgatttggctgtgtccccacccaaatctcatcttcaattgtggctcccataattcccacaggttgtgggagggactcagtgggagataactgaatcataggtgcagtttcccccatactgttcttgtggtagtgaataagtctcatgaaatctcattttgtaagggaagcccctttcacttggttctcatttctcccttgtctgccgccatgtaagtaagatatgcctttcatcttcccccatgattgtgaggcctccccagccatgtggaactgtgagtccattaaacctcttttactttaaaaattatccagtcttgggtatgtctttatcagcagtgtgaaaacagaccaatacagtaaattggtaccagtaagtggggtgctgctataaagatacctgaaaatgtggaagtgactttggatctgggtaacaggcagaggctggaatggtctggagggctcagaagaagacaggaaaatgtgggcaagtttggaacttcctagacatttgttgaatggctttgaccaaaatactgatcatgatatggacaatgaaatccaggctgaggtggtctcagatggagatgagaaacttgttgcaaactggagtaaaggtgactcttgctatgttttagcaaagagactggcagcattttgcccctgatgtgtggaactttgaacttgagggagatgatttatggtatctggaggaaaaaatttctaagcaccaaagcattcaggaagtgacttggatgctgttaaaaacattcagttttaaaaagttttaaaagcattctcagagaaacagaaaataaaagcagaaaatttgtggcctcctgatgccattgaaaagaaaaacccattttctgaggagaaattcaagctgggtgtggaaatttgcctaagtaacgaagagccaaatgttaatcaccaactcaatgggggaaaatgtctcaagggcatgtcagagatctttgctggcagcccctcccatcacaggcccagaggactaggaggaaaaaaaaatggtttcaagggctggtgcccagggcccccttgctgtgtgcagcctagagactccatgccctgcatcccagccactctaaccaaaggatacaagcagccagggtatagttcaggtcatggcttcagagggtgcaagccccaagccttggcagcttccatgtggtgttgagcctgcgggtacacaaatgtcaagaattgagatttgggaacctctgcctagatttcagagaatgtatagaaatgcctggatgttcaggcactggtatgctgcaaggatggagccctcatggagaacctctgctagggcagtgtgaaagggaaatgtgggttgcaagcccccacacagagtccccactggggcactgcctagtggagctgtgagaagagggccaccatcctcccaactccagaatggtgtatctactaacagcttgcaccatgcacctggaaaagctacagacactcaatgacagctcgtgaaagcagccaggaggtgggctataccctgcaaagctacaggggcagagctgccaaaggccgtgggagcccacctcttgcattagcatgacctggatgtgagacatggagtcaaaggagatcactttggagctttaagaatggactgacccattggattgtggacttacatggggcctttagccccttcattttggccagtttctcccatttggaatgagtgtatttatccagtgcctgtgcccccattgtatctagaaactaactaacttgattttgattttacaggctcacaggtggaagggagttgccttgtctgagatgagactttggactgtggacttttgagttaatgctgaaatgcgttaagactttgggggactgttgggaaggcatgggtggttttgaaatgtgaggacatgagatttgggaggggccgagggcggaatgatatggtttggctgtgtccccaccaaatctcattttgaattgtagctcccataattcccatgtgtcgtgggagggacccagtgggggataactgaatcataggggtggtttcccccatactgttcttgtggtagtgaataagtctcatgagatctgatggttttataaggggaaacctctttcgcttggttctcatttctcccttgtctgctgccatgtaagacatgcctttcgccttctgccatcattgtgaggcctccccagccacatggaactgtgagttcattaaacctctttttctttaaaaattacccagtctcaggtatgtgtttatcagcagcatgaaaacagactaatacacccactttcaccactcctgttcaacacagtactggaagtcctagttagagcaatcaggcaagagaaagaaataaaaggcattcaaattggaaaaagtaagttaatttgtccctttttgcagatgatatgattttatacctagaaaaacctaaaggctccattagaaaacttagatctgataaatttggaaaagttataggatacaaaaataaacatacaaaagttgatagtgtttctatacaccaataatgaactagcggagaaagaaatcaaaaaggcaatcccatttacaatagctatacaaaataaaatacctagaaataaatttaatcaaagaggtgaaaggcgttgcaaggaaaactacaaaacactgataaaagaagctgaagaggacacgaacaaattgaaagatatcccacgtccacggatcaaaagaattagtgtcattaaaatgaccatactacccaaagcaatctacagattcaatgcaattgctatcaaaatgtcaatgtcattttacacagaaacagaaaaaacaatcctaaaaccatatggaaccaaaaaagagcacaaatagccaaaacaatcctaagaaaaacaaacaaagctgcagggatcacactgcctgacttcaaaggatattacacaaggctacagaaaccaaaataagcatggtgttgttataaaaacagatacaggccaggagtggtggctcacacctgtaatcccagcactttgggaggccaaggcaggtggatcatctgacatcaggagttcaagaccagcctggccaacttggtgaaaccccatcactactaaaaatacaaaaattagccaggtttggtggtatgcacctgtaatctcagctaatcagggggctgaggcagggagaattgcttgaacccaggaggcagaggttgcagtgagcctagatagtgccactgcactccagcctgggcgacagagcaagactctatctcaaaaaacaaacaaacaacaacaacaaaacaaacccagatacacagaacaatagaacaaaatcaacaacacagaaataaatccacgtacttactgcgaactgattttcaacaaaggtaccaaaaacatgcgttagggaaaggataccctctcaataaatggtgctgggaaaatgagagatccatacgcagatgaatgaaactgaagccctctctctcatcgcatacaaaaatcaactcaagatggactaaacactcaaacataagacctgaaactatataactattagaagaaaacacagggattacacttcaagacattgatctaggcaatgattttatggctaagaccccaaagcataggcaacaaaaccaaaaaccgacaaaagggactatattaaactgaaaagcttctgcacagcataggaaacaatcaacagagtgaagacacaacctgttgaatgacagaaaacatgtgaaaactacccatcgaacaaggaactaacatacagaatatgtaagaaactcaaacaacattaaaaacacaaacaatcccattaaaaagtgggcaaaggacatgactagacatttctcaaaaaaagacatgtaaatgaccgacagctgcatgaaaaactgctcagcatccctaatcatcagggaataacagatgttggtgaggatgcagagaaaagggaactcttatgtattgttggtgggaatgcaaattagtacaaccagtatgaaaaatagtatgggaattcctcaaaaaactaaaaatagaactactatataatccagcaatctcactacagagtatttccccagaggaaaacaaattagtattatcaaagagatatctgtactcccatgtttattgtagcactgttcgcaaaagatatggaatcagcctaagtgtccacatcaatggacaaacaggtaaagaattcgtgacacatatacacaatgaaatactattcagccatacaaaaagaatgaaatcatgtcatctgcagcaacatggatggaggtcattagccagacacagaaagacaaatattacatgttctcactcacatgtgggagctataaaaatttgatctcatggaggtagaaagtagaattataggtactagaggctgggaagggtgtgcatggaggcaggagtgggggataaagagagattggttaatgggtacaaaaatacagttagatagtcacaataagttctaatgttcaataacaacagagtagggtgactacagttaacaatatattatatacttcaaaataactagaagagaggtttaaattgtttctgacacatagacatgataaatattcacagtgagggacaccccaaataccctgacttgatcattacatagtctatgcatgtaacaaaatatcagaggtaccccataaatatgtacaaataaactaaaaaaagaaaaccaatcaaatgtgatttcagatactacacaatgatataaaactttgagtttgttctttagaaaatgattaagcaaacagcagcaagggaagtacatagggtgaggactgagtgtggatggggcatctggggaacatcctccaggatggctcgtgggcccacatggtcaaggaccctgcggtgaggtgaaggtctgggcaagatgcatggcgatttcatgggggctgcattccagtgcccgtctttgtataaagcatgtcacctgtgggactcaaactgcctcaaacttctccaagcacccagtcaattaaacagatttttttccaaggggggacattctgctgcttctaaaaatataagattttctacacactgctatcattacaaactgtgataggtgctatgaagaaagagtaacaaaacccaaatgggtgataaaatttagactaaggggagggtgtcaagggtaagtgcctctaaagaagctaagaactgaaagagaaatgagttaggaattttagccattcatgcaaaaaaggggtaagattgggagaggcctctcggacagaacaaaaggtgcgcaaataggaatttggcttgtttgaaaatcatcaaggtagacaccatacctagatcatcatgaccaaggggatattgcacaggatcaggttccaagtggccaggcccaggtcaccttagatgtgacagctcaaggtagtgtaatcagaaacactgaagaattgaaaagagaagcattaggaattctacttactggctactgggtgctagatggtttgggatagattcttgagaagctactgcaggagtttaggaggcctgggcctgggaagtggctgggatgatgaagagggatgaaccaatgggctgggtatcaagtgtctagcagaacagcatgcaaacattgactcagcatgtactgacaacctccagggctccatcccatcactggttctgcagatttaggggtaaacaaagcatggctctacactcatgaaggttacatgtggggtgaaggtgcaatggaaaaaaattcatgaaaacccaggcagtgataagtgcgatcctgaaaaataaaaggaaaaggtgactttggaccccttaggatgttaattggaggtgacaaatttcatgaaatcccttggtaacagaggctcaacaaatgatatccattaacattgtactatcaatacaaaataagtattgggtgaagactttgccattgtaattgcttaaatatcccaatatgcttcttctattaactccttaaggggatcaaatccagctgcccactttgaagagaggcaagccaccacagacctagcagcctcataaacatctcatccaacctacctgcttccttctttgaaaatggagcctggtttttaaagtcaatatgcttccaatacacactgagacactttgtaataaaatctagatggaatactaggaggcatgattaaaggtttattttttacctcttttcaacctctaaatttacgccagcaagaggtgaactgcagaagcataaagcagactgcagtgactggctcatgtgctgaccccagctggggtctaaaagtcagcagaaagtctcctgacagagacaacggggatttcaggtagcatacagtatgtccacattgtggcctcctttaatctcaagagtatgtctgctatactgaagatacgattttacatgtcacggcctaaaactggcttcaaacagcaggttcatttaataaatactccaataaaaaaactgtcttctcaaaaacagttatcttccacagggggcctgccctcccttccttggtcccactgaactggttcatgtctaaccaccttatacagcatgctaactatcttcgttacaaaagggtacactttgcaacagaatttcacgttgacaggttaaccaggaagttctgtgagtaatcaaatgttctaaaggctcactccactcagatactctccaatgaccatagtaagcatcccggaactcactggacacactaagtgtccagtcgcaaacagcacacagtaaaaatgtattcaagaaggggccgggcacggtggctcacgcctgtaatcctagcactttgggaggccaaggcgggtggatcaggaggtcaggagtttgaggccagcctgatcaacatagtgaaaccctgtctctactaaaaatacaaaaattagctgggcgtggtggcacgcacctgtaatcccagctactcaggaggctgaggcaggagaattgcttaaatccaggaggcggaggttgcagtgagccaagattgcaccacggcactccagcctgggctacggagcgagactctgtctaaaaaaaaatgtatgcaagaaggaaaaaataatgtatggttctccattgttcagcaataaataataaagctaccattaaatgaactgtcctggcccaatcaacctaaggtcaccaggattcaacgaactttgacaagagtcaggtttgttggctcagtgtaatgggtgagctgccccatggttccatgcaaatgttaatcccaagactcggaacaaccctgaaggttgtattattaccctacttttttttttttttttttttttgagacggagttttgctcttgttgcctaagctggagtgcaatggtgtgatcttagctcactgcaacctccgcctcccaggttcaagcgattctcctgcctcagcctcccaagcagctgggactgcaggtgtgcaccaccacgcctggctatttttttggaattttagtaaagatggggtttcatcatgttggccaggctggtctcaaactcctgacctcaggtgatccgcccgcttcagcctcccaaattgctgcgattacaggtgtgagccaccacgcctggcttaccctacttttactgataactaaattaaagctcagagagatgtcctttttcaaaatcacatggctagtaaaccatcatccatgttaattccaaaacccttacaaagctcaaaatacccacaacccaagccaggacaatagcctttcctctagactttttaagatggtggtttgcaaacagttttttttaactataggaagaagtttcctttaaataaaatgtgactgaaatccatgaatgaacaggtacatatttaaagcataggatgtcctccttcagaactgcccttggctactagggcaaggcgacatacatgtgttactgagcgttttttaacacatttaattcaacttaagcaaacaggccatctgcagctgcaccttctcacttttctccgtgcttagacactgattagctcctttaaaaggtgcaaaaatgggcagcaatggtttaccactgcatagttctagcactgcagcattcctggccaaagggacagcaaaagaaaagaaatggaggttggatgggaaaaaatattttgtgaaaggcattcctatttttaacgcaaaattaagcggaagaataatataattagattacaaatatgcctaagaacagacaaatgtcttaagaaggtttgccagagtttacttttagtcttaaaaaaataaggtgacctgaatgaaaacatatatgtagtcagcacattaaaatggcatataatgtaactgttcatttcagagtatctaggaggcctgagacagcagatagactttgtcacttgttcaaatcctcccagctgaatctgtggtgtgtttggccatatgccaaaaacatggggaaaaggtccacccttacaaagaactttcatggccttaactgtatggcgaaggggttggccagagtcaatgtgtgggctgagagaggagcactgcctggaagcaagctcactgcatcagatacactctgctggttcccaggccataccctagcagccagtgtgctcctggtgcgctaaaaagaccacaccacaggtgaggagatgctgttggatggctgattcacttcccaagccctcctttccctagctgccttccagctagaggtggcctgtgatccagttctggccagggagatgtaagcagatttcaggcggccaggtgggacttgtgggacaacttttgccttcctgctgaaaatggtgactctcagctaacagacctgttaatccttgatcagtcctctaattcctgccaaggccacaaccgcaatgcctgaaggtccagctctcatcgtgagaccatgtgtcaagtaggagatagcacagagaggaaagagcctgggtccctggcaacatctgttacagggagccgaagacccatgggacgtgaccaactcagcattcccctggagactatatgatcaaacagcaaaccgttcatcatgaatgcaggatatgagcaaactcacgactgctccggccgactgctcctgccaacagaaggtttgctggaggcaatcactccctggcgccaaggttctctactgcaacatctagaaccttttgttcaaggaatgcagtcttgcaagcctactctagactgagcagctgaccccttcttccacccgccttctcactatctcttttgcctaataaatatggagggctgtgtaaagctcagggcccttgtccactagagccaagatgcctccttcttccaaatatactcttttgtctcttgtcttttattcccgccttcaccccttgttcagttcccctaggtccatgcgggttacacagtggcaccccgaacagccacagaatcgggtgcactacaatctgtgatcaactctgccctggatcacctgcttccagacaccttgtcaaatgaaccatataaatccataattatgtaagtcatcatagttagctttctgttactttcagtcaaatatattcctaattgtggcaacagactctcctgtgcctgagatttcttctgccttaaagtatatggttttctggaaaaaatggaattttctcccagaagtcacttcccccaacacacactcaaaattgccttaccagaaaaatgtaactgccacatacctcttatggtcccagaacagattacagaaatgtatcaagaactctaacgtcttttcaaaaaaaaaaaaaagagtataaacacatgtaaggcataagaacagaaaagactcaaggtaataaataacatttttcagtggcactctaccttagaaatgttgcttgaatgactcatgaaatgtcccaaagtcttctcattctgcaagaaaatcaaacaggttttaattatcaatctttgattaaaatatgcaaagaacaagtaattgatcacaacaaccctactgacaaatcattccctgaactagaatttgcaaagcacaacctactatatactagatgtatgtagccaggcagtaaatattgcacatttgggcaaaatgaatacacaatagtccctgtcctaaaggatttaacattttatttaagagatttaattttttattatcaggaaaaaataagagtttagaattcactgtcaaaataagatggtaataagtgtcttaagtcacatttcacgtgaaagttcagatggtgataagtgtcttaagacacatttcaagtggagaggctgcatgctcagttgtatgtgacacagtccacattatgaggagtcacggcgaaagagtgaagaaagtaggacagctgaccagtcctggggtgtctggctaacaaagtgctgaatactcaatcgggatatcacacagctcacatctccttcaactcagtttctcctcctggagcagggaaatctgggagccatgccagcctccttcctctcatgcccctccacattcagtcacatagtcttgtatcaaattcttcctcctctcaatcacaactcattttcatttttattgacaatgctttagtttagattctcttcatttctcagctagaattcttgaagaataacatcccacctggcctttttgcctttaggttgacctccctgatacacaactatcatgggctaaactgtgtattcccctcccttctgtgaaaatttagatgttgatgtcctaaactccttcttcctcagaatataactatttggaatagggactttaaagatgtaattaagtttacatgaggtcaatagtagtcccggctactcaggaggtgactctaatcctagtggactctaatccaataggattggtgtccttgtaataagaggagtttgtgacacagacacacacagataaaagacaatgtgaacacagagggagaagatggccatctacaagccaaggagaaaccagccctgctgccaccttcatcttggacttccagcctccagactatgagaaaataaatttctgttgtttaagccaccttccgtatggcaatttgttatggcaaccctcaaacaactacgatcatcttccatcctatgactttctttaaaaaaaaaaagtgaacactctaaacataaatctgatttttaaaaataaagtcattttcctgaatctactcattcttgctctaaacccaaatgagtaacaaaaactattgcctaaggaagagaagatcttagttgtatttccttgctctgtcacctaggctgggagtgcagtggcatgatcatggttcatggcagccttgacctcttgggctcaagtgatcctcctgcctcagccttctgaggaattgggactacagggatgtgccaacatgtctgactaaatactttttgtggagacagggatcactctgtcacccaggctagagtgcagtggcacaatcacaatcatgcttcactgaagcctcaacctcctgggttcaagtgatcctcccgcctcagcctcccgagcagctaggactacagacatgtgccaccatgtctgactaagtattttttatagagacagggtcttgctatgctgcccaggctcaactcctggcctcaagtaattctcccatctgagcttctcaaaggactggaattacaggcatgagtcaccatacctgacctgtttcttcatcttaaggcagtcaattagtaaattataaagtatgctcaaagtgttgggagaatgttaccaaagaatgtttctaaaagatcaagtttcactttgggaggctgaggcgggcagattgcctgaggtcagtagtttgagacccgcctgaccaacatggtgaaacaccgtctctactaaaaatacaaaaattagccgggcatggtggcacgtgcctataatcccaactactccggaggctgagggaaggagaatcgcttgaaactgggaggcagaggttgcagtgagctgagatcacaccactgcactgcattccagcctgggcaacagagcaagactccgtatcaacaacaacaaaaaaagaccaagtttaactagcaatttaattcaatcatattattcacacattcattcactgggaatgaaagccctctgtccagagaacaagtaatctgagtttcattcattagtcaagaatgtacttataggtaaacacagggcactgctgtgagtcccaattttaaggccaagctactggtgacttactattaaattttagtgtagtctactaagttcaaacaaagacaccataggccttggattatctgtacagaaagccaattataaccactgctacattacttactacctcacaaggaatggctggtttgacaccatctggaaatctacagagaagttcacaagtactaagagaagccaataaatcatatcctcagacctttttgacattaattattcaacagagaatggatattggggtgagggagaactacctgctaacttaacattataaacccagattgagagctaaagctgttccttaccctttaagaaataaatttgataatgcaagcttttattttgttttcttgttagaacaattcatattttacattggtaaaaccaaacaaataacaagccctagaaaacacaggggttttaaagcctgaaacctgtcaatatttagggttgcttctccactacttggtaggatcttaacagttcagttccagcagaccagatcatcttttattttcccccaataaacactgctctttttcttcttcttcttcttcttctttttttttttcttttttgatacgtagtctcgctctgtcgcccaggctggagtgcactggtgcaatctcggctcactgcacgctccgcctcccaggttcatgccactctcctgcctcagcctcccaagtagctgggactacaggcgcccaccaccatgtccggctcagtttttgtatttttagtagagacggggtttcactgtgttagccaggatggtctcgatctcctgacctcgtgatctgcccgcctcggcctcccaaagtgctgggattacaggcgtgagccactgcgcccagcctaaacactgctctttagatgtccatttatttggacttaaaatatatagtgcaggacaacatcagagatattttccagaaagcaagtcccaaaactcattcaaatcagtcattctttccacacttatttactatgcaactactatgtgtgaacaactgtgtcaggcatagaatatggaccaaaatctcactcctaaccatatgccaatgataatattgagaatcccttatttgaaatgcttgggaccagaactgtttcatatttctgagttttttggactttggaatatttgcattatacttacaggtggagcatcccaaatctgagaattcaaaatctgaaaggtgacaatgagcacttactttgagtgtcatgctgacattccaaagtttcagattttgaagcatgctggatttcgagtttgtggattagggacgctcaacgtgtattaccactgaactcctctgaaaaagtgttttggtgagaaatgtccaaactagggaagagcttaagaatgacataaaagaagcacatacataaagtatatcaaggtggaagtgtgacaccactctgccctgtagtcagaatggcatcttggttctgaatgagaagtaaagtttgccaagcatcaatgtaaagaagtggaattagacataccaaggagaaaaaagttccagttcaagcccaaactaagcttcaatgcccaagtaataaaaaccctggcaaattatttacagctctttaacacattcagtcactgcttactggataccaccaccttgtgaccccaggagagatggaagcctcgctgcatcttccttccttcctcagagaaggtactaagagatgccacacactaccctggctttcatctccacatctctctggtgggctcttttcatctacattcaacatgagagctcctcagaacacagcctcatgccctctagatttcatttgttttctcctttagccagtgcttttccaactctggacacctaatcatttagggatcttgctaaaatgtagattgtggtttgttaggtctaggggggactcagatttctgcatttccaaaaagctcccaggtgactcccatgctgctgtccccagaccacagtttgaggtgcaagttttcattccaaatcttgaaccagaaaaatcaataaagtctatgagttttgtttgtttgtttttaagacagggttttgccatgttgtccaggctggaggacagtagctattcacgagtaccatcatgtcatactacagtctctaattcctgggctcaagtgatcctcccacctcaacctcccaagtagctgagattacaggcatactactgcacccaatttatgactcatgttttaaaaagcaaatcatgaccattttaaaagtaaattcctatgtaaaagatggctgtgagcccacaattgagttaatacaaatcaatcaatcaggaaacacaatggtacagattgggaaagactgagtctgagggtgtgagaaaacaaagttttcttaatgtgagaagctaccagatcacaaagataaagagaagctctgctgaagaataaggcacattttacaatttaatcagtgctgtcaatgatgtttttcacaagtccacatgtggctcccaacagaatgtacttgtgggtagagccaaggcataaaactcacatagaccaaatacaccctggaaagtagaaaccaataattatcaagaagacaacgaggtgagatgcctaagcgagtttttgggattctgtatgaaagagtcaaacaataggacttcatcatgtggggttttcctgaaactctgaccaggactggtccttaaaaaaaaagacaaaatatgtgggcaatgaacaccgctaactacatactcaatacctatctccctttgtccccaccaaaagaaccctgactttgtcctgagcagcaacaaacccagctaaaagttctcacttttccacactactttgcagttaaggaaaactattaaatatataaaaagttcttttgaaagaaattaactaaagatttcctgggaaaacattttgctttcctgatattgccattgcccatttctctggaattcctcctccctcatccagcctggaatatagacgtaataccacgaagtaaagcagttcactttgggactatgaagaagatagttactagaagtctgaaactttttggtctcaggacccctttatcctgtaaaaaatgattaagggccaagcgtggtgactcacacctgtaatcccagcacttgggaggccgaggtgggaggatcacctgaggtcaggagttcgagaccagcctggccaacatggtgaaaccccatctctactagaaatacaaaaattagctgggcgtggtggcacatgcctgtaatgccagctacttgggaggctgaggcaggagaactgcttgaacctgaaaggcagaggttgcagtgagccgagatcgcgcgactgaactccagcctgggcaacaaaagcaaaactccatctcaaaaaaaaaaaaagaaaagaaaaagattaaggactcccaaaacctttggattatgtagggttttatctatgggtatttgcaatattagacattaaaactgacagcgtaaaaactatatctcttaattcatttagcattagtaataaacccagttaacataaataacatttcaatgaagtttaactattttctcaaaaaaaaaaaaattagtgagcagagtggcactcctgtacatttttataaatctcattgtttaatagaagacagctagattcctgcatctgtttatgtattaaatctcttctgatctgatgcttttgtgaggacccattcaaaactcagagttgacataatcatgattttaagctgaagacatctgatattcaatgaatgcaggaagaagccctctccatacttcccttatatgattaaaagcagaaactgtgacaaatgaggctgccataaattccctcttcaacggtttactcccaggaaggagatcaagagtaaacgtaccataattcccctgtctaggaggagttttatggccatgaagaagaggaaaagacactcccatctacacaaacattatcacaagctttcttatctcttaatttgttaggaggggaggggaggggaggggaggggatgctaggggaggggagggagacaggcaggaaggtggggaggggagaaaggaaaggaagaaaagagaaaagagaaaaaagaaaagagaagaagagaagagagaaaagaaaagaaaagaaaggagaaaggaaaagaaaaactaaaagcagcaggaaataaatgactcatcatattctccatggtacatgggaaccacaaaaagattaacagctgacttatcctcagaaaccagggaggccagagacagtggaaggacataaagaactcaaagaaaaaaaatgtgaaccaagataattatattcagcaaaactatcttcaaaaatgaagatgaaaaatacattcatagataaacagaaactcagagaattcattgcaagtggatgcacctgaaaagaaatactaaaggaagttctttgagttgaaagcatgtactgccaaacagtagtcaaaagtaactgtgtaactataagacaatataaatgcatatatattttgcatatatattttcctttcttaaataatttaaaaaggaattatataaaaactatgtttataattgtattgttaaacctataacataaagaaatgtaatgtatttaatagtaatacaagataagtgggtacaaagttgtcatcattatactaatatcagacgaaacagaattcagaaaattttaccagagataaagagggacttctactatgaaaggttggcataaggaaatgatatcacatggaaactctacactgaaacaaatgaagataataaggagtgctaactttaaaataacaaactgtataaacatataatgctctcctttcctttatgtctttaaaagacagttaaataaactaataactgctacaatgtattgttgggtttgtaacataaatagatatgtataaacaataattagtaaagaaatagaggtacataggaggaatcattctatgtcttacaggaattaaatcaatatgaatctgaagaagattctgttagaaaaatatatatatatatagtaaaccctcaaccattaagaaaataattttttaaatagcattagaaatcttttttaaaaatcatttaaggaattaaaatattacaatacaaaataatgcaaaagaaagcaataaaggaagaacacaggaacaaaaatggcaagacacatagaaaacaaaaagtaaaatggcaaacaagcaaaccatatcattaatagcatgaactgcaaatggattaacaaatcaacaggaagggttgtcaggatgtacaataacacaaaatccagttgtattctaagttcaggagatacaattagactcaaaattataaacaggattacagtaaaagaagcaaaaagatacatagcacaaaaacaaccaccataaaaaggggtagtcattatattaatatcagataaaaaagacttaggaaaattttactagagctaaagagggacttttactatgataaggtcaaccatcatgaaggtataataattataaatatataagcacctaatatgaaaaccacaaaatacataaagcaagaactgacagagctgactgaaaaacagataatacttgcagacttcaaaatcctgctttcaacaatgaacagccgagctatgtaaaagacttgaacagcactaaaccaacttgacctaacagacatccacagaatacaaaacccaacaacaacaacagaatatacattcttctcaagtgcacaacaacagactatagagtagtccacaaaacaaacatcagtaaatgtaaaaggactcaaatcatatacagtatgattctggctacaacagagttaaactttagagttaaatgttattgtttatcaacagcagagagaaactaccaaattcacaaatgcggaaattaaacaacaaaatctgaaataaccagtaaatcaaaaaagaactcaccaaaaaaaaactagaaaatttatttgagattcataaaaatgaagtcacaaaataccacacttacacaatgcaactaaaatagtgcttagggggatatttatagctgtaaatgacaagattaaagaaaggtacagagaaaacgcagtcatatgtaagtcagaaagaaaggcctaccagaaaccaaattttctggcaacgtgattttggacttcttgtctccaaaaatgtgagaaattaaatttctgttacttaagccacccagtctgtggtattttgttatggcagcctgaacagactaatacaaacatctactaaaaaactacaggtaacattatacttaatggtgaaagattgaatgcttactccctaaattttaacagcaattctatctgctttcaccatttctttttaacattttaattgtggcaaaatacacacaatgtaaacacaccatcatataaagtatgcataatataaaattcaccatcttaaccattttaagtgtacagttcagtattaagtatattcacattgttgcacaatctacagaactttttcatcttgcaaaaactgaaactctatactcattaaacaattccctatatcttcctacccccgaaatatttttaaaaatttttactttctgtttctatgattctgactactctagatactttatacaagtggaatcataacagtatttttctttttgcgattagctcacttcacttggcataatgtcctcaagattcctccgtgttgtagcatgtgtcagaagcctttttttttttgagaagtctcgctctgtcacccaggctggagtgcagtggcatgatctcggctcactgcaacctctacctcctgggttcaagcaattctcctgactcagcctcccaagtagctgggattacaggtatacaccactacatccagctaatttttgtatttttagtagagatggcatttcaccatgttggccaggctggtctcaaactcctgacctcaggtgatcctccctcctcggcctcccaaagtgctagaataacaggcgtgagccgctgtgcccagccagaatccttttctttttaaaacaaatgtgaaactatatgcaataaatgtaccatattttatttattcattcaccctttgatggacacttgtattgcttccaccctttggcactgtaaataatgttgctatgaacacaggtatacaaatatctctttgagacctggcttttaattctttggggtatatacccagaagtggatttcctgggtcatacagtaataattatcttttactttttaaggaactcctatactgttttccattgtggttgcactattttacattcctattagcagtgcacaatcagcgttccactttgttcggatcctcatcaacacatttttaaaatatatataacagccatccttgatggttgtaaagtggtatctcactgtggttttgatttgcgtttccctaattatcaatgatgttgaccatcttttcatatgcctactagccatttgtatatcctctttggaaaagtgtctattcaagcattttagaatcagattatttgttgctgttgagatgtaggagttctttatatattctagatattatccctttatcagatatatgatttgtaaatatctcccattccctaagtggcctttccaccctgtccactgtttcctttgatgcccagaagttttaaattttgatgtaatctaatttctgtatttttacttctgttgcctttgcttttggtgtcatatccaaaaaatttttgccaaatccaaagtcaagaagcttctttccctaggttttcttttaagaattttatagttttaagtcttagatccattttgagctaatctttctacatggtgtaaagtaagggtccaattgtattcttttgcctcttaatatccagacccctgccacccccaccaatatcatttgttgaaaagactgtcctttcctcactgactagtctcggcgccattgtgggaaatcatttggccaaatatgtgaggctttatttctgggactctctattctattccattggtttctatgtctatcttatgccagtaccacactaacttgtttactgtagctttgtaataagttttgaagtcagggagcatcacaccatcactttgttctttttgttcaaattgttctggctattcaggatcccttgtgattccatataaattacaggacagatttatctatttctgtaaaacaaaagtcactgagattttgagaaggattataccgaatatacagattgatttgggcagtactgtcatcttaacaatattaagttttccaataaacacaggatgtcttcccatttattttatgtcttctttaatttctttcatcaatatatagtagttttctgtgtataagtctttaccactttggttaagtttattcctattttatgcatttttgatgccattgtaaataggactgttttctcaatatcctttttagattgttcattattagtatatagaaacacagctgatttgtgtgtgtgtgttgattttataacttgaaactttgctgaattcatttagtctgattttttgtttgttttgcatggaaactttagggttttctatataaaaaattttgtcatatgtaaagagataattttactcctttccaattttgatgctttttacctctttttcttgcctaattgctcagctaggatttccagtaatgtgttgtacagcagtggcaaaaccaggcaaccttatcttgctcctgatcttagaggaaaaattttcagactttcgccaatgactataatgtcagctgcagacttttcatatatggcctttattatgttgaggtagtttccctctattcccagtttcttgaatgttttctactattctgatgcatcatagtgccaaaagttctagccaccacaattaggaaaataaacaaaataaaaggcatatatatcagaatgaaagacataaaaatctctatctgcacatgacatgaatgcttatgtagaaaatcctaaggtattaacaatagcaacaacaaagtcctcgaaggagtccagcaaagtcagaggatacaaaatagacatacaaaaattaactgcattgctatatatatatatacatatatataacacacatatagcaatgaacaaaagaactcacaattactattatagagccactctaaaaaaactgaagtatttaggtgcacatcaagtaaaacatgaatctgattgctgatgctgcaaaaaaaattgatcaaaaatgatctcaacatataaaaatacatactgttcctggaatgaaaaattcaatataatgtaagctgacaactcttccccaaattgataaacagcttaaacataattcctatcaaaattctagcaagttttttttttagatatagacaggttattctaagatttatatggataggcaaaggaactagaatacttaaaacaatcctaaagaatcctaaaagaataaaaaaactgggagaaatccatccatccaatttcaagaactaatatacagccagagtaatcactactgtgtggtactagtgaagaaccagacataaccatcaatggaacaagacagagaatccagaaatcaacccatacaatatgcccaactgatttttaagaaagcaattcaatagaggaaagagaattttcaacaaatgatgctggaacaaagcaatgaactttgacttgagtctcaaacttatacaaaaattaactcaaaatagttcatggacttcatgtataatctaaaaccataaaacattttaaaaaataggagaaaatcttcaggatttaaggttgggcaaagagttcctatactacacacccaaagcaggatccatttaagaaactgatcaattaaacttcatcaaaatcagaaacgtttgctccatgaaagaccccgctaaaaggctgaagataaaagctatagcctgggggaaaatatttgcaaatgaatatccaattaaggactagtatttagaatacagaaagaattcttagacctgaacatttttaaaaatccaattagaaaataggcaaaacatgtgaagggacatcttaatgaataggatactcagatggcaaataagcacatgagaagatgttcaacatcactggccattagataaatgaaagtaaaatcacaatgagatattactacacacctatcagaatggctaaaaatttttttttaaataatgacatcaccaaatgttgaggatataaagaaactagatcacttatatattgcttgcaggaaaataaaatgacagttatcctggaaaaaactttggaagtttctttaaaaattaaacatgaaatagctattgctctcctgaagatttaccttggagaaatgaaaacacatgttcacataaaaacctataggtgtctatagcagctttgttcaaacaaatgtccttcaacaggtaaacggttagaaaactgtggtccgtgcataacatggaaaactactccactagtaaaaaggaacaaactattgataaacacaaacctggaagaaatctccagagaattacacttaatttaaaaagccaatcccaaatggctacaaattattccaaacagtaaacgagaaagtacggtgctggcaaatatttgaagaaatttgttaaaattttcccaagtttggagaaggacataaacctatgcattcaaaaaactgaatgaactacaagaaacctatgcccaggcataccatagtcaaattaatgaagacaagaagaaatctggaaagcagagagaaaaaaaggatgcattacttatagaggaacaatgattcaaatgactgtgtcttgctcatcaggaaaccctcaaggccagtagtcagaagtaacatcatttttcaaatattgacaaaagagacctgtttacctaaaactaagtatgtggtgaaaatatatttcaggaatgaagggaaataaaaacagtcacagacaaagagtaacaacaagattagcaaccaacagaactgcttaaaagaaattcatcacatggaaggaaaatgataccagaaaacaatgtgtatatcagcaataaagaaagagcaacagaaaggctaagcattcagacaaaaacaattgactattctttttctcttgattctttacatttgacggctgaaagcaaataataataataataatacattctatgaggggctctgaaggtatgcaatgtagaatgtaagataactgtaacagaaagggggaaagtgaaagttgtgatatattttctatattttagcgaagtttctacactacaattgaagtagcaaaatactgattctaaatagactctgagaagtatgtattttgtaactcattttttaaaaagcaaagagatagtcaaactccaaatagataaatatagcaacaattaagtgtacataaacactgcaattacaggacacaaatgtggagaactgactttttaaaaaaacaaccaattatggccgggcacggtggctcacacctgtaatcccagcacttcaggaggctgaggcgggcagatcacgaggtcaagggatcaagaccatcctggccaacacggtaaaaccccgtctctactaaaaatacaaaaattagctaggcatggtgacgtatgcctgtaatcccagctactcaggatgctgaggcaggagaattgcttgagcccgggaggcagaggttgcagtgagccgagatatcgtgccactgcattccagcctggcgacagaacgagactccgtctcaaataaataaataaataaataaataaataaataaaataaaaactaaaaataaataaaaaacaaccaattatatgctatctataggaaactcgtttcattgatacaggtagtgtaaaataaaggaatgggaaaatatataccaagcaaacacaaataaaaatttccaaaaggtagaaacaactcaaatgtccatcaacacataaatggagagacaaaatgtggtattatccatacaatggaatattattcagtcattaaaaggatataaatactgacacatactacaatatgaaccctgaaaacattatgctatgtatgtaaaagaagccagtagcaaaagatcatatattatatgattccatctatataaaatgtcaaaaataggcaaatccacaaagacaaaaagtaaattcgcagttaccaaggattgtggggatgggagaatggggagtgactgctaatgggtagagggtttcattttcgggtgatgaaaatgttctggactggcacagtggtggcagctgtacaaccttatgaatacactaaaaatctactaattgggcactttaaaagggtgatttaatggtatgaaagctgtatctcaacttttaaaatatactaaggtctggcctggcacagtggctcacgcctataatgccagcactttgggaggccgagacgggcagatcacctgaggctgggagttcaagaccagcctgaccaacatgtagaaaccccgtctctactaaaaatacaaaattagtgggcaaggtggcacatgcctgtaatccaagctacttgggaggctgagacaggagaatcgcttgaacctgggaggcggaggttgcggtgagccgagatcgcgccattgcactccagcgtgggaaacaagagcgaaactccgtctcgaaaaaaactaagatccaaaaaataacctatgatgtataaaacactgtgctatacaccttgttttttctccagtgttttttctgtataagctaatcaatacaggacaccagctatctaattacaagccattagcacaaagctagcactggatattggaaatttaagtgaatggacactcactcagaatctaacaacaaaacaccatacagtatgaatttcattcttatactgtaaacatggtgaataaatatagccaattttctttctagatggtgtttcctaaatttaaagaggatactaatgactataatcagagctaaggatgtcaagattcatgttcgcgtatctggcatgtttaaaagaaaaatatgccaatttgctgaaaatactgtcacttttagcactagtatttcccttactgcgtccctcttcctcctgagtaggggcttatactgagtggccagagatcattaacaattccgacattctacaaaggtggccctacattctgcatttctacttttataagagacataaatttcattttattgctcatttcgagctgttaattatatatacaattaagcacttatgccttcttgcctttaatcaagatctcactgttcaaaaaacaagacatattattaatccagctactcctgaataagaaagaaggattgcctacttcacagcacaggatcaagacccgccttgatggctccctccatggctcagtttgtccctatcacaaatcagagtttccaacactattctctcctttaccttcccctgaagagccctaaacttctcagcattgactttcagtaggattgggtccccactcccagtcctaggggtagacactatcctaaaacaatccctgtggcaagagactgcctgacttcacttgtatctattaagccaatttcacatattagggtctgttacttgcaactacccagttgctatcgccaaattctgttacagttaagttgctatccatttatttgtttttaatcaataccacaggcttgtaattaatgccagatgtgatctagttactgtttaagccagaaaacttctgtttcccagcaacattctacccctactttttcccacagtgactggttgaagaacaagataacattaattgctttaggccaattagagccatctggagctacaggtgattctatcctattcaaaccacatggctgtgaaatttgggacctccaacaaattatttcccaatggggattcggttttatggtctggccattttataaaaatctctaatctttgtgaatggtttaatgggtgagcaactataaatagtctggtttgttagtttttttctgtttgtctatttgtctgttctcaccacgaatcaattaagaattcatgctcactgggaagagagcaactctttgacacggactgatgagttttataattctgtatttgccatggccccatagttgaaatttcagaattgaagtcataaactctttccgcatctgcgtgtctatgtgtaattcagaaaggctgttgtctttcaatgtgtgaaggtgcaataattttctacctcagaatgggattaacaaattagattataaaatctactacattatgaaatctcttaaagtaatatattctgatttactcatagaggtaaataagtacatatataaacagaatattcctaaatttcccagaaaataaggaggttgaagatctaacactttcaagaaaccaattattgagctgtattaagaaatcaagttcacataaaaaaagcaaatctttggaaatgggaccagtttaatatttatggtttaaaagaaacagttgtatctttactgatttatcaatattaagtataagcatagacttttattctatttgggtacgtcattcataaacctatacaggtttactgattgaataaactagcgttacttctacttaatgtctaagattatggaaaaggtaaatttgtgttcaaccaaacaaaatcattattctgatgaccttgtatttcaacagtaattatgtcttgcaatatatcagcttgaagacaaatttccaagatctttaggaaacttaaaaactcgaactggtatcaatttgaattaactaatgaatatgcactcaatactgatctcatttctaagtaagactgaatattgagacatttataactaagcataaatttaatattgtcacgcacgtccatgtgaagagaccaccaaacaggctttgtgtgagcaagaaagctttttaatcacctgggtgcagatgggctgagtctgaaaatagagtcagcaaggggagttggggtggggcagttttataggatttgggtaggtagtggaaaattttcacttcttttgtgattcttcagttgcttcaggcgatctggatgtatacatgcaggcttgggctcagaggcctgacaaatatacttgtttcttatttttatatgctacaaagaggctatgtctttggctcttttaatcagttaaatgtgttcatttttgccactcttgagacttgtacacaatgaaagtgtacacacagttaaagttgtgttagctctggatgttagctctgctagtttgctaaaacagtggcatgcaacagctcacaattatccactccctagttttctctgtgtaataaaagttactttggctaaaagttatcaataacatgtgaatgagactactagaacaatggtggcaggcaggtacaacactacgtgtgaggtagtaggatgggttttgtttattaaggaaaaaaaaatagttttgtcctaaaataaaagggctggttgttccagaacgagaaagagggttgtctcagtctgttcgcattactataaaggaatacctgaggctgggtaatttataaagaaaagaggattatttggctcatggttctgcagactatacaagaagcatggtgccaggatctgcttccagagagacactcaagaagcttcccattcatgatacagggagaaggagaacagagattacaaggtgagaggaaggacgacaggtcaagagagcaaggagggaggtgtcaggctcttcttaatatgatctcagaggaactaagtgagaatttatgcattacccagaggagggcattaagccattcatgagggatccgcctctatgacccaaacccctctcagaagaccctacatccaacattggggataacatttcaatatgaaatttggaggggacaaatatccaaactacatcagctgtaaaggacaaaaattgatatagaaagttgtagaagatttgagaaaagataattttacttgccttggccaaagttagctcagttttgaaaaaaaaaaaaaaagattttataaaagtgcttgtagttcctgtagtatcaaatattacactgatacaatactggagtttggttttctctgttgaaattagaaaattttcttggattattgatctgcccttagtaagagattgtaagatatctgctgtataaataacaaagattctgttttaccaaaatagttttctgtgcttttcatgttgattgtacaatgtccttgattaaatatttctcacttatgaaagagccaaatgctttacaatcatgtaaccttcactttattttcaaatgtttggatgtcactttgaaatgagtaggaaagtatttctcaggcacctatgatctgattcctaagtgttgaaatctcctggtaacttttcatttatgtctttacaaattcaaatcctaaatgtaaaataaaataaaaaatttgagatacttttgggactaaaactgtctctgagatttataagagggcccatgaaagaggacaaaaatttattctttcacagtaaaaaaaaaaaaaaaaaaaagtactggaaacaattgtgtttgttactattgatgaaactgcatgggaggaattagcaaatcagaagagatttgtcaatgctctcactgtcatgattagtttctatttatcaaagtcctgatactctgcactgtatagctgttatcactcttatgttttaaaatgttaacttggttacaacttcacttttcaaatgtgaatgcagcatcttctgggccagtggttttcaattaaggattcacataatttactatggagatggagtttcattaatatacagaagcttaggacccactccagacttactagatcttttcacttgatattctggatacattattggtacataatatctaggattattgctatatttcaagattcatttctctgtaaagtttatgctcatctgcttttataaatcagatataatattacatcctttaactatagagttcattattacattttaaattgtttaaaatttttttattgactttattatcttgttttgcatgtcacagaaaccagatttccttgtcagttatatttttctcaaactctcatcagatccttcattttttgaaaatgatcagtaaaaaattaactgcagccattttaaatgtttttatctgcagacatctatttgttgctgttttattctgatgtttccctcagagccttttcaatcagctacaggccagaaggaatcagaaccccatggaaaagggctatgccaggtactttggggcacaggcttctaaatgacattgcttaaacaactttcagaccataccagtggcctaagtcagaatttccaggactcttatgaggaagccgatgggttgataatactactaaccccacatccagtggaacaaaaattaactagatatggctgaatgagctaatgagggatgactgtagtttttgtctggaatattgttgatgctgtttgaatgtattttccagacatataaggaagccttttctctttcttcttaaagctatctataactcataacttagtagactctgcttttgtatactgaaatgaaacacttgtaaacatcttattctccctgcttgagccctccaaagttcagaaacgtaataaatattctattttcagggcaataaagttatttgcatagattaaataagaatctgtcctcttttttactaggacataagtggaaatattggttttgcaactaaactcacatttgaaaatgatgctcattcaatcaaatatgactaaacacttttaagtgttctggaactaaggaactaagactgcctttacagagtcatccttacaaagccttctttggaaaaactggcttacagagttcccagccttgcaggtgagtaagaaaagccacttcctgggaggcccatgagtcttaggatattttagggacctcaagaaatgaggaattcttataaataaaacaggtgaaatctgatatagagttattggcatagcttcctagccttaagatcactagtaacaagaggctttaaaaaatccaatctgagattcctaaagaaaacgtgcagcagagcaaacttaagaactttaaggaacttttaacactcttgctgtgcccagctgaacaacgcctgtaatctggggaaagaagactaaacatctcatacgtgcctgacttgaagagtagcgtagggagaagacagaatgggatagagtagtacagtctctcaaatttttaaacaaattctaacatcgggaggttggaaactagaattattcagcttacagatgctttcagcttgtgcacagagagaaggccatgtcaagacatggagagaaggccagcaagagaggccacaccagaaactgcacactgcgagaccctgatcttaagactttcctacctccagaactttgagaaaatgaattctattatttaagccatgcagtctatggtattttcttatggcagcccaagcagactaatacagttagtaaaatagatttgggaaaattatgacataatctacatctatctcaaacataaaaggaaaagccaagtcgtcttaaggaataacaaaaatggcataaagtaccattttacaagaagttcaattttgaaataaaatttagtacatattttagtcactaaaattttaactcaggaaaaaaacaattacatcacagaagtcaagacaggaaaatttatttcttataaaactatatttcaacaaactaaggtaatttatttaaagtaacgtcaaaatgcatcaatatttgtcttcagtataataatatagtccaaatttctagtaatgtgattatctgtttccaccactgctttcttttttaaacctcattgtggcaataatgaagttaacaagcaactagaaaatatgaaacaaccaagcacaagaccataacagccacacatttgttctaagccattcatctagggtctctggatttcagctttctcctctataaagtggactatgtggaagtggaaggaggaggagagtagagttaatgaagatgacccctttggttcctctgagagtcaaatatctatggggaatatgttgccctgcttagcgctgctcagcaccacacactgcagctgaaaattcacccttaaagttatgaaaaaatggatttatagttccccaagcctttctaatatagactgataaattaaatgctttttaaaagttacatataacatatgattagaatcataatattttagtaatgtactgaagaatacaatcttttccaaatgctttctccattaagtatttttcattttcattttctgaatatgaagtaagggtttgctaaaaacaaaggtctttgtattcattgctgactttttaaaaatcttaattatacattagtaaaatgaacagataaatttctgccattttaaaataatgtatccaataaatacacgaaaaccttgaaataatctatgtcaatataagtcagaattcatttgctgtaaaggttgttatagaaattataacactgtgccctctccctctccctctccctctccccacggcccacggtctccctctccctctctttccacggtctccctctgatgccgagccgaagctggactgtactgctgccatctcggctcactgcaacctccctgcctgattctcctgcctcagcctgccgagtgcctgcgattacaggcgcgcgccgccacacctgactggttttcttacttttttggtggagacggggtttcgctgtgttggccgggctggtctccagctcctaaccgcgagtgatccgccagcctcggcctcccgaggtgctgggattgcagacggagtctggttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgcctcttcctggccgccatcccgtctaggaagtgaggagcgtctctgcccggccgccatcccatctaggaagtgaggagcgcctcttcccggccgtcatcccatctaggaagtaaggagcgtctctgcccggccgcccatcgcctgagatgtggggagcgcctctgccccgccgccccgtctgggatgtgagagcgcccagccgcgaccccgtctgggaggtgaggagcgtctctgcctggccgccccatctgagaagtgaggagaccctccgcctggcaaccgccccgtctgagaagtgacgagcccctccgcccggcagccgccccgtctgagaagtgaggagcccctacgcccggcagccaccccgtctgggaagtgaggagcgtctccgcccggcagccaccccgtccgggagggaggtgggggtcagcccccgccaggccagccgccccgtccaggagggaggtcggggggtcagccccccgcccggccagccaccccgtccgggaggtgaggggcacctctgcccggccgcccctactgggaagtgaggagcccctctgcccggccagccgcccagtccgggaggtgaggggcgcctctgcccggccgctcctactgggaagtgaggagcccctctgcccggccagccgcccagtccgggagggaggtgggggggtcagccccccgcccggccagccgccccgtccgggaggtgaggggcgcctctgcccggccgtccctactgggatgtgaggagcccctctgcccggccaccaccccgtctgggaggtgtacccaacagctcattgagaacgggccgggacgacaatggcggttttgtggaatagaaaggggggaaaggtggggaaaagattgggaaatcggatggttgccgtgtctgtgtagaaagaagtagacatgggagacttttcattttgttctgtaccaagaaaaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggctgcagggtcctctgcctaggaaaaccagagacctttgttcacttgtttatctgctgaccttccctccactattgtcctatgaccctgccaactccccctctgcgagaaacacccaagaatgatcaattaaaaaaaaataaataaaataaaataaaaaagaaattataacactgtaactgcttcctacagtgctatatgagcaagtaacctttctagaaagacagttaatggtctttagtgcagaatgtactcattcagaaacacgtttattaaccacctactatgagccaggtacaggtccagcccctgcgaatgatgagtgaacaaaacaaagatccctgctgttgtagagcttatgaaaacagtgtagaaagagattgtccattttctctggttgtctcagagctcagggcttgtgttcaggggatgtttgttagagttttaaaactataaatgatatatttactgatgaaatagtgtattcaatttggcctggattccttaatactctggctcttttcatctttgctatttgcatgtccccacagctcaagaacatctcatagcctcagcaaagttaacagagacggcatccacaaaaaatcagacagagggagcaaatggcaacactggaacagccctgccaaatgaaattacatgtctggcttacacacacacgtgggaaataataccacaaaacagaacaaagaccctttgttctgtcttctatgcatttttccaccctatgagaagctaaaagatcttcccagaatgaatgctccagcagaaagaattggagtggcttctgaaaacaacacttcctctagaaaatagcaatagagcctgaaggtgcgttcattaaaattatgaactcagttgtctttctcagggtttttcaaagccataactccataatttaagtgggcaatattatatcaataaaaaagatttttttacatcaagaataagacgatacatttaaaaatgctataatctatatgtttaaatgcttactggcttaagaatacttttcgcaatttcaagaaacagttttgttagaaacaaagtacatcattgaaaatgaaattaaaattaaactgctaagtttttctggctgggaacctcaagagtgaggcatccttgagcaactctgggttctacacgtctgttccataaagcctaatggcatccctgaatcagtgagaaaccaggcacagctgacagggcacgtctcctacctgaagcttcattttccaacaagaatgcattggtgtgcgctcagtgcagcgcttccccgcaacatggtccctgtgcttgatgccggggaacaggcgctgcctgcacagcagctgccaccctacagctgccagcagcagcacatggctggctgtcgcagctggacttgtgagggcttgctgaagccctcagcataccactcctgccatcaaactggactacttcctccagctgattttcaaggaacgaggcagtgaatgaataattcatgacaagtccattctagcaaccaatttcacctctgcctatagtctccccatagcaatctgcaatgtaacgattctaagacttacttggtgccatacaaggaatgaaagctcagtttcccgtcaatgacagtaaatgttacaggatctgtttgctcttcctgtgtgccaacctgtcacccagacttacttgaaatattttttttaatgtagaaaagctaaatgattaaccacagatgtctgacagaacaaaacaaaatttttttccccacaaaacccaccctacataatgagttctggatgcagaaaaagcagcaaaatgcttgccctgtgatcagcaggtcagtatttacatttagtaaaagatcagttcctgcagaccatcatcacagggtgggggaggggagctctgcgtatcaatgccaggaaacaaactgcttcaaggaggaattttcctggtttcaggctataaataaatcgtccatctcattggtattcttctaggaagtacatgaatattcattttcaccaatttgtccatgcttacatatttccaaatgagtcatatctaaagaagtcaattttctgcaacttaaaatcatcattccaagacaaacttgaaccagagaagggaaggccaataatggtatcatctcaactgcacctgtaggcagtccaatcacctgtaatgttctccacctgtttcccatagccgtccttttttctcactgctgcaatgttttctcttctgaactcactgtaaacatctcaagcttttgctgtcactaaggtaatttttcagccatgagtattctgttcctcgctgcttctaatttatttgttgttctgcaacaaacaagttccccaagtgtttcttgcccttgtattttcccttttcaccttcttcttttcacctattttatcacttctgaacttatgttttataaacttctagttcctattatactattccacagtagataggaattctcttccttttttgcagggaaataatgatttcttccagtacagactctgcatcattccacaagcactgagcctttcactgtccggacatgtgtacagaggcctcaccaagtcccctcattgccttccacttcacaaggacattcgatctggcttgtgtgtgtgtgatgccgtgttgtctaggggaacccttcctcttccagctattgggagctgatgccgcattcaagcagctttctgcaggcatgctgcggagagggcagttcatggtgtgtggtaaagagacaaaggaaccagtctctattgaaagccctaactctgttctcttctcccagggatatccttttcctcaacattctgtaatcccctcaatgtcttacgagatttcatgtccaccagaaagtgtctagcccaagttgttctcttccccttttgaagtgacattcctttttctccaaatcctgaccacccactcccctaccccatcccatgaatgagaggataagagggcctatcacctgaggctcacaatgtgtcccttcttccacttcctgttctctacagagacttatttccttgatgttctcttttgccctgcgttctgctaactcccagtttcctgatgaagataatcagttctaaggttgatcactatgcttcttgtcttctctacttcattcccagcctagacacaagagatcactaaaacagtgatctccagtatgtttcattttgctaattattttttgtagagacagggtcttactatattgcccaggctggtctcaaactcctggcctcaagagatcttcctgcctcggctcccaaaatggtaggattataggtgtgagccactgtgcctggctcaaactgattgattattaagaatcaagtgtgggccaggcacggtggctcacgcctgttaatcccggcactttgggaggccaaggtgggtggatcacctgaggtcaggagttcgagaccagcctggacaatacagcgaaaccctatttctactaaaaatacaaaaataagctgggcgtggtggcacgtgcctgtaatcccagctacttaggaagttgatgcaggagaatcgcttgaacctgggaggcggaggttgcagtgagctgagactgcgccactgtgctccagcctgggtaacagaacaagactttgtctcaaaaaaaaaagaatcaagtgtggctaagagtgctcaaaaaaatcctcagaattaacagcgacataaagatcatttagtccaacccaatccagagcctcaatcctataaaatggcaaccccagctgtttctctcaacactcccagacagctctccagtcacctgccaaggcagctaaatctattcactctgctaaaatatatgtatgtacctccttattaacagccaggctcaccctttggcctgcagtatgtatgggaacactggattgtaaaagcaaattaaaaggacagacagtttggcacaatggtggcaacagtggtgagtagcacaacaagaagtcaaaacatggacaccaaatttccctggagtatcagctagttgacagtagagttgtgaatccactagcacttaaccaagttattaaaaacttttcttatggactatacacgtgaacaattctaccgatgttttagggcctccttccattccccatcccaagaatagtaatatgaatataatgtaaaaagagaacctcttaagaagggctcaaaatagtttggatatttgtctccaccaaatctcatgttgaaatttaattgccaatgttggaggtgtgacctggtgggaggtcgactggatcatgggggctgatccctcaggaatggtttttaccaccatccccttggtgctgtcctcatgatagagtgatttctcagaagatctggtcatttaagaatgtgtggcacctccccagacctcttgctcctgctctcgccatatgagacaacactctccctctgccttctgtaagcagcccaaggcctcaccagaagctgaacagatgccggtgtcaggcttcctgtacagcctacagaaccacgaggcaattaaacctctttatgaattactcagtctcaggtatttctttacagcaacaagacagcctaacataagggcttagaactgctataactaaaacttcacacaaaaagactctggaatacagtgcccttcacattttcttgtataccttcatgaaagtctatattctccatgtcctccttagcagactgatgtctgggtgaacaaatatataacacaggcaaggatttgcaatgttttttcatgacaaatgtcaaacaagcataagagactgctaggcactattaattgtaagtgataaactaaccctccaattttaagatgatcgtgatcttagcaatctatgtttcttgaatattttaagttaaaacttaatttttttgcattatcaggtacttctctcagagactaggcttcctggcagctaatacaagaggtgatgagtgcacatcgtatctcaggtgtctcataaagaattctggttgctcttggttgtctgagataaaaggcctgatgactatggaggggcaggctttcataagaattatcaatgaaggcaaggtgatggttatcaggcaagtccttccaaccttcagaagaactctgaattaaagttggactgacccctgagtatctgtgattctaccatcacagtgccacatcagtacagaaaagagagctccgatgacacagaacgcagtttgcagcttgatgacatgtgtattctcgcactgctgacattacaaccaagacctcagaactcttaagacaacagcaatggtatgtccttgaggcagcaggaaagtatcaacaacctacctgcctgcagttcacccattcatggattttccctgcctagactactgctctaaagactctgatctgaagaacttttgctttccatgatcttcaaaacctgcctcctcaaacactgcccaatactctagacgagatatccagtttgctctgacctttactgtacatgtttggtccttccagaatattaggagcttcctcaactcctaacagattgcccaagggagcatcctgtggaatggaaatccgtttccacattatctctgtaatgccaatcctgctgatctcagttcagcagcaaactgtaacccctggacactggtatggttctagagccctcttgtaactttcaagagcattcccaaagctaccagcatcctatcattgctcttggccagaatggctctaataaagcatgtatcatacactaatcaaaatggcttagcttttaaaccactgtacttgtgagaggacctagtaacaccttcgtaacacttcctttgtcagtgttacaaaagaagtaacaaggatcccaccaccttgtaaaagctctaaaagatatgctggaagggagtctacacacacaaaaaaacttctgacagatttcaccaactgctgtctttttcaatttgatcttaaaatgaaaatataaaatatgtgagtaaaaatttaaagtgccattcgtaaaggattgaatatatcttcattcaagcatgggtatcatgtggataccatccctttgttcatgagtaaggtatcatctgtacaataaggagttcctactctattacatgagataaacaggtaaacaactaacagatatgactatgtggcaaaactaaataaacgccatatcagagatacagatgctagtttcttgtatcctcccactaccacccatccatccacaatgagaacagaaaggaaggagacataagggaaggtttgggaagtcagtaagtagactactgcaataatctagatcaagggtcagcaaactttttctgtaaagagccagagaggaaatattttatgctttgcaagtcatattctctattacacctactcaattctgccattgtcagacaaaagtagtcacaaggaaatgagcatggctctactccaataaaactatatttatgaaaactgaaattttgatttcatatcattttcatgcatcgtaaaatattaatctcttgacttttctccaaccatttaaaaatgtaaaaaccgtttttagctggcaagtcataaaaaacagcagtggctggatttggaccatgggctatgatttgccagcccctgacctacacggctgcctgaaatacagcagtagcaccagggcagagaggaaggacaaagaaaacatttcagaggtggaatcagtaaaacttattgatgagtggcgcattaagagcaaagtcggcaaaaggagctccctagtttctagcccaggtgactcagagggaatgtcatgaacaaataagagcagcagctctccttcacctgaggaggacaacagcacctggagtgcaccactcactgcccaggtgatgagaactacgcactcagcagcagtgacccaagactcaaatcccacctccatcagttatcacatacccaacctttttgattctcagcttccaaatcaatccataaagtgatcatgaccacaacagtaatgcctacttcaaagggttgctgtaaggattcaatttagtgagttaacatatggaaagtccttgggacagtgcctggctcacagtaaatgatatgtaagtgttagccattattcgaaatataaaaattttaatccataaatgttatagaggcaatttataaataccatatgttggcctacttaaatacagtaaaaaacagtattcacagtaataaacattcttaagcatttaaaccatctgtgaatacttgacatagtatacagcattatttaagctaaataatatcaaattaagttcctttcatactggggaaaaaaatcaatgctgaagtagtgctggccaggataaactgtacaaaggtatgtgtggttcagggtaaagcaaagtcagtcttgagagttagaatgggacgagggtctaaaacaggtgacaagtacaactgtggcctgggctagtcaccagatttctgggggactccatcaggcgcttttcttatgttctaagaatttacctagtctacaagttccattctaccacacgagggggcgtgaagcaaataccaatgtgagattaaaacctgctgcaattactgtacttctaaaaacaaatcagtctgacagcaagaatgtaattacattttttattaggagatagaaaatacaaaatattttatgaggattaaatataattggaatattttctatgatttgataaaaagaagcattaactactttgttgaatgatacacatttcaactgaaagaaatcacaaaatacttttaactttgttctttatctgtaatatcttgaaaagttgctgttcaaaggtatattgctttctagttaattacccatcgtagcaactaaacctgtgaacagctaaaaaaaataatcaacttatctttaattacgttacattttttagaaaactattttcatcacttgaaactcactctgctttgcttttaagggtcttttccccaaaagttcttcattgaagaacaattgatggggaatgaagtcacttttataaatctacctatgatatatctgaatccagaatgtgcccaaataccttcattttgaagcctcttgaataagacaggaaaagataaactgcctaggcaggtataccatgatttgattaagcagtaaaaaagattacccaaaaccagtaattccaagtattcctttgtttgatgacctgatttttattccctagaacaatgcagcatagcaaaattaagagacatagtaaaatgtaggggcctttccttcttcagagtcgaaaactagctgctcagaaatgtgggtgcatgaacagttttaggctcaagtgtatgtggaaggtaaagatctgaaaatggagtcgttaaaactgcccatgcttctgctccttttggaaagtctgcctgtgcctcccagacatggtgcaaaccaatgtttacataagataacaaaaaatttggaattagatttaaaattatatgaatacctaggaagtgtgagataacttgcccattggcctttaaattatttcgtataatttactatttattattgtctactgcgacgctttcttcagctcactttcggcaagcataatcttttatttcccaaaacttttgatttgaaaaactttaaatctacagaaaagctaaaagaatagtacaatgaatacctgtctgtccttcacctagatgcatcaactgttataaaatctgcccatttactttttctttctctgatatacatattctgatgcataaaattaactgtaattctatcattattatctaatatatagaaaatattcagctttcccagttgtccaaaaaacacaccttacaggtatttatgtttttaacatgttccaccaaggtacacatattacactggttgtctttttagttttttataatctaagacagtcctcccacatttttctgtttttaatgataaacaactttttaaagtcaggggttcaaggttcaaatttcccccaaaaaactctgcatattaatttaataaaataattttttcagttattatcaaagttttgttggtaaaagatgctagccttgtgactgttagatttggggtgacaactctcagtggattggtatgggagggccactgaggcctgaaggacactatctgggagtggacacactgtgggagtgactatctcccacaaagtaaccatttcatctccaccactttccagaaaataagcagtctcctccaagttcagtaagaacccaaggtcacactgctaattagatgaaaagacctttgctctcagggaacagacatctacacaccttgggtaacaatcctggggtgtaatacaaatcagttgagcacatctttcccaatttgggtgtatgactgcttagaagtgctaattacgtacacagctagtaatacataaacactaccttaatcatcctaagcctaactcaaaaccaaagccctgaggcaaaagatgctattaagatgtccttgtaattctaccactgttcatgtattacctgaacagtgtgaatccaacagcagtgccctgctctgctttttaaaaaacaggcttctgaaatgtggtaaattgagttcttcagaaacaaacatgaaaaacacacaaattcggcattaggatgactggatgaaagggatgacagttcattccctatgcaaaagtggtatggaagatataaaacattccaagccaggtgtgatggctcgtgtctataataccaacacgtggccccccaagtgagctataattgcacccctgcacctcaacgtgggcaacagaatgagacccctgtctcttaaaaacacaaaactatttgatgcacaaatgaatgaaaaaatatgtgtgtgcagtctatattcatgtgcaagcatttttttagaggaaacaaaacaatatggaaaaaaatatacagtcaggcatttatctttggtgctgttttattcatgtgtaaaataaggaagtcatctcaataacatcacatatcaaaagccattaacaacgattacaggacactaggactgtagtattatttactgcaatctctgcattaaaaaataaattaggggcccaatagggtggctcacacctataatcccaacactttggaaagccaaggtgggaggatggcttgaggccaggagtttgaggccagccttggcaacatagcaagatctcatctcttcaaaataaaaaatttagccacatgtgatggtgtatgcctatagtcccagctattcaggaggctgggatgggaggatcacttgagcccagcagttcaaggctgcagtgagctatgatcatgccactgcactccagcctgtgagagtgagacccaatctctaaactaaataaataaaaacaaagagtgaaaaataaataaatatatttgagtggttttcttattttcaagttactgacagaaaatctgaaaaattatctgccacctagttgtccaattcacacaggacagctataagagagtagtgacaaccaagaaatcataatcatcaagtcctacagtgatacctagacaaacgtattcatacaccaccttgactcaacttatatgcaacacactgaaaccaactgcaaatgcttcacttaccgcacaaccagacaagactcttggttttacctagattatgtacactcttaactagcaaactctcactagaccaacatccacagaggtcagctacagttattctgtgcattccttccatctctaaactctaaataaataaacagcaaaccattaccagttctcaagttttacgtgagaattggctgatataggtaagctgctaatatataaaatagctggaatcgatattgttggctttttactaagaatatttaaaattgcaggacctcaaagttgcacataattttatctgcatttaagcttcaaaaatctatatatgcaaaagaaaatgtagatgtagccgttcaaatgggtcaacctgaatttaatgttttataacagcatactcttttttaatctctagaaaaacatcaaaacttctctttattctcaaagaaaacaagcctacaaagcagaaaatgaccatttagtaaagaagtcatctttggttcttaaatgttaagcatgctacaactttctatacatgtttgagccaactaggagatacttccaaggggtttcagagatcgctgtgattaccaaataggaaaaacacgcttggaagcagaagtgaaagactccagggagcaagaacaggtaaacaggtgacaaagaaattctggtttccaggtatgagaaaattaatctcttgtggcccttgcaggtaaggtagatggatgattcaagaagccacgcaaatgatctcacagatggtgatgcctaaccagacagtaatctgcaacaggtttattttaaagatgcatattcatctcttcatgaaaacatacttctataaaaaagctagaaatggtctaaaagacagtaactagaatgctgagagacccaactaataatacgtgattataagggatttttatcctgcagaataagactggcagttcctggaagcaaaaagtaaaagtgtcagtaagagaaagctacagacagtttggtcttatactgtatctcaaatctctggtagcccaaaaaaaaaagcacaaaacaaccgcctttcgaagtagtgggttagcatcagggctgatgccctaatggtgccctaaaaacaaactggccatgataatacagagtaggttcaagcattaaactgggagtttgcccacatggctctggagatactgcaatgttaaaattcaagaggttttctccaagttccttatattaggtttttattatttaaaagggaagaatttatctaatagagaaaagagaataatttttaagtagtaaaagtgtggtgattctgtctaaagatattgttatcacttgaacattgtgaggtcattttttcaaaagatgttaggtacaaatgaatacagtatgatctatcaatactcatgtgtttttagagcaaatacgaaattgtgtttactgaccatcatcctgatgctgcatggtaaaatcctccttttgacctcagtagcaggacaacagggccaaaactaggactgtttataaatatataaaataccacttttattttctgtgtagcttactttaaatataagttgatcattgaattaccttcttacttatcacctttcaggaatcctgggatacagatcatttctttcaggatccctttatcaaggaggacagggcagaaaattgaaaaatgtattttttggacaatcttgcaatttgggttccagacatgtagaagaattccagataattcatgtaaagactccaccttcaaggagggggagcacaactccccattctttaaagtgggctatgcctagtgacttccttccaaagaatgaagtacaaaaggggagaaaaagagtaactttatagtggagagacctgatagtcactatatcagccaggtggtcaagaaaatcagtcataaatcatgttgatagtatactcgatctgttgtgatgaactggtacattgtatctgtggacttccatcccaaaacctataaccctagtctagtcatgagaaaaatatcagacaattcccatagaaggacattccacaaaatacctgatcagtattcttcaaaactgtcaaggtaatctaaaacaagggaagtctgagaaactgtcatagccaagaggagcctaaggagatacaacaacaaaatgtaatatgctacatcctagagatgagatcctggaacacaaaaaggacattagttaaaaagtagggaaatctgaataaagcatggactttaaaactataatgtattcatattagttcactaactatgatgaatgcagcacactattttaagatgttaataatatgagaaactggaagcttggttcaagatggctaactagatgcagctagtacatgcctcttccatggaaagctccaaaacggcgagtagatattcacccttcaaataggtcatctaaaacagaacactggaattcaactgaaaagcaacaggaatcactgatcacaaaggagaaggaagcaaggcacgtgctcagccaggattgctgagagatgaaagaagcttctagatgctgggaaagggtagatgagagactcccagggctccacattcccaccatggacttttgcaacgctagctgtgggagacccccttgaccctcgcaggtctccagcctaatagagtgagttgcctggagattgacagaggcattgctcaaactcacatgggagtacacaggcttccgagccctgagcagctgctgctaccagccaacaagccaggctgaagagaggaggccaggcacttttacacaaccactgtgcttcttgtacagtctgcagaatagtgagccaaataaaatctcttatttataaattacccagccttgggcattcctttatagcacaagaggggacttcaacaccccactgacagcactagacagaccactgagacagaaaaaaaaagaaaaaaaaaaccccactggatttaaattggactgtagaacaaatagacctaacagatgtttatataacaagctacccaacaatcacagaatatacattcttcttattagcatgtggaacattttccaagacagaccttatcttaaggaatgaagcaagtctcaataaatttttaaaaaactgaaatcatttcaagttgtcttctcagactacagtggaaaaaacctaaagtcaattccaagaaggactctcaaatctatacaaatacatggaaattaacctgctcttgaatgatttttgggtcagtgatgaaattaagatggaagtttaaaaattttttaaacaaaagtagagacacaacataccaaaacctctggaatacagcaaaagcttatagtgttgactgtaaatggattcaagaaagaaaagtttatagcgttaaatgcctaaatcgaaaaaaatagaaagaccacaagttaacctgacatagtacctcaaggaactagaaaaacaagaacaaaccaaacccagaagaaaagaaatgatgaagagcagaactaaatgaaatccagatcataaaaacccaaaagataaagaaacaaaaagttgcttcactgaaaagataaacaaaattgacagcctactagctacattaaccaagaagaaagaaaattcaaataagcacaatcagaaatgaaaaagacactacaaatgataccacagaaatacaaaagatcatcagagtctaccatgaacatctctacactaacgaactagaaaacctagatgaaacaggtaaattcctaaagacacacaacctctcaagaatgaactaagaaagagaaagcctgaagagaccaataaccagtaagacttaaccagtaataaaaataaaaaaaaatctcccaacaacaaaaaaccccagaagcagatgaattcacagccaaattctaccagacatagaagaataggtaccaatcctattgacaacactgttcccccaaattgaagaaaatcctctctaactgaagccagtatcaccctaacaccaaatccaagcaaggacacacaaaaacagaaacagaatcaatcagtacccctaatgaacacagatgcaaaaacgctcaagaaaatactagcaaaccaaatccaacagcacatcaaaaaacatggtacaccacaatcaagtgggttatattccagggatacaagtagggtttaacatacaaaaatcaataaatgtgatctgccacataaacaggattaaaaacaaaaaccatattatctcgatagatacagaaaaagcatttgataaaattcagcattctttcatgataaaaaccactcaacaacttggtgtagtaggaacatacctcaaaataataaaacccatatacaagaatcccacagccaacatcatactgaatggggaaaggttgaaagcattccccttaagaaatggaagaagacaaggatccccactcttaccactcctactcaacacagtactaaaagtcctatcgggccagagcagtaatgcaatagaaagaaagaaaagacatctaaattgtaaaagaggaagttaaactatctctgtttgctgatataattttatacctggaaaaccctaagactcctccaaaacactcgtaaatttgataaattaattcagtagagtttcaggatacaaaatcgacctacaaaatcagtagtatttcttttgtttagttggggtttgtttctttgtttgtttttgaaacggtctcactctgttacccaggctggagcacagtggcgcagtcatagcttagcgcagcctcgacctcctgggctcaagtgatcctcccacctcagcatcccaagtcgctgggacttacaggcacgtgccaccacacccagctaatttttgtattttttgttgtgaggaggaatcagtagcatttctatacaacaatgatataatcaagctgagaaccaaatcaagaaccaaaccaagaagtcaatcccatttacaatagctacaaaaaaataataaaatactcagaaatacactcaaccaaggatgtgaaagatctctacaagaaaaactacaaaacgctgacgaaagaaatcacatatgacacaaacatgatcatgggttagaagaatcagtatcattaaaatgaccatactactcaaagaaatctgcagatgcaattcctataaaaatactaacattgtttttcacaatattagaaaaaacaatcctaaaatacccaaggaaccagaaaagagcctgaatggccaaagcaatggtaagcaaaaagaacaatacttgaggcatcaaattacttgacttcaaattgtactataaggctataacaaccaaaactattataaaaagagacacacaggtcaatgaaacagcttacagaacccaaattaaagacacatgcctacaggcaaatgatcttcttcaaagtcaacaaaaacatacactagtggaagaacaccctattctatacatgatacttgggagaattgggtaaccatatacagtagaatgacactggacccatatctctcaccatatacaaaaatcaacttaagatggattaaagacctgaaagtataaagacctgaaagatctgaaactataaagattctagaagaaaacctaggaaaaactcttctggacattggcctaaggcaaagaattcatgcctaggacctcaaaaggaaagctacaaaaatgaaaatagacaaatgggacttaattaaaataaaaagcttctacacagcaaataaataatcaacagagaaaacagacaatctacagaacaggagaaaatatctgcagactatgcatcttacaaaaagctaatttgtagactctacaaagaactcaacaagaaaaaaataacctttttaaaaaatgggcaaagggcatgaacacatattttgcaaaagatgacatacaaatggccaagaaacatttaaaaagttagaaatgcaaataaaagcgatgaaataccatttcacaccagtcagaatggctattactcaggtgtcaaaaaaatcaataacagatgttggcaaggatgcagataaaagggaatgctcacagactgttgttgggagtgtaaactagtacagctgctatggaaaacaatatggagacttctcaaagaactaatagaaataccatttgatccagtgatcccactactggggatctacgcaaagggaaagaaatcattatatcaaaaagatacctgtactcaaatatttattgcaggactactcacaatagcaaagacataaaatcaatctaagtgcccatcaacggatgattggataaagtaatccacatcatggaatactactcagctataaaaaaagaatgaattcatgtttttttgtagcaacatggatagaactggaggtaactatcttaagtgaaataactcagaaagagcaagtcaaatatcacatattctcacttacaggtgggagctgaaaaatatgtacacaggggcatagagagtggaataataacattggagactcagaaaggtgggaggatgggagtgggtgagggatgagaaattacctcatgggtgcttatgtgcactattcaggtggtgtaacaacactgcacttgtactaaatctataaataataacaatatgagaaactgggtgtcaggtatatgaaaatactccatcctagcttaacaatttttctgtaaatctaaaactagtctgaaataaacttttacttaaaaatgaaactgggccaggtgcagtggctcacacttgcagtcccagcaatttgggaggccaagatgggaggattgcttaagcccaggagtttgagaccagcctgggcaatagcaagaccccgactctacaaaatgaaagaaaaacttatccaggcatggtctatagtgccagctacttgggaggttgaggcaggaggatcatttgagcccaggagttcgtggctgcggtatgctgtgatcacgccactgtatgctagcctgggcaacagagcaagatctgtactcaaaaataagtaaaaaataataacaaaaatgaaaataaaactgaccgaagtgagggagaaaagcaaactcagaatagtcacacatgccaacaatgacagaaaagaggactaaaactgtcattatagctgttatttcatatactaaaaaagttgcatagagacatggaagatataaaaaagatccaaaacaaatgtctagtgataaaacatgtctgagatgaaaaacacactagacggaattactggcagattagatattgaaaaagaaaatattaatgaaattataaacaaagtaattggaatatccaaaataaaatgcagaaagaaaaaataaccttaaaaaattaaaagtgcagcagtggacaactttaagccagtcaatgtgtatactggagtccccaaagaaagaatggggggacagaaaaagtatctgaagaatagccaaaaagctccaaattctatgaaaattgtaaacccactgatccacaagcacaacttcagaatacaagaaacaaataaaaaatattttttaaataaagctgaaagaagtcattgtcagccaactcacattataagaaatgctaaagtcctttagacaaaagaaaaatgatagatggaaatacaccagaaatggtaattatctgagtaaacagatctttattattatttaaaagaaaagtatttaaagagaaagtatttttttaaatatattctagggtttaaaatttattaaaagacaataatgaaaaggccagaaggaaagaaatgaaagtatactattgtaaggttctcatactgtatttgaaataaaagatcatctccacagtgacatgacccatatcactgaaactgaattcatattcactcattcattcattcatcaactgtattgagtactgtataaaagtcattaaccctctgtagaagttatgggcttcagcgagggtgtgttaacagattagactaagcaaacaggtggattatttgagtctaggtaaaatgcaagggttcactcttcttatgggactcagtaggaataatatctcccaagcacaggaggatcagaaatcatagcaaaagattttgggttgaacctgtgccaggaaaaactgcataaataaaaatgggctccactggacaaaaatttacctttcaaatcaaacctgataccacaattgagaccctagaaacacaaccactattttcatcctgtgccattgctgctgaagctctcacggggccctgcaagttcctggttcaactgctcttccactactgccacctcatctgggctccacgacaccctgaactgtcaggctgccactgggtgttcaaaccatccccacactaaggtaagacagaatggtttctctttcttcccaataccaataaaaatccccattctacaaataattgattaatgctatttatttagaccttaaaaatcccatcaaatagataaattcaataaggctttattaaataaccacctacagtaaacctgcagtgagggtgtatatcaaaaagaatctcccttcctggcctaactgttggacattttcctttttctattccaaacaagtttgtatagcttccccatgtacacactattatggactaaatgtttatgtttcccacaaaacttttatgccagaactctaatccataatgtaatggtatttggaggtggggccttggggagacaattaggtcctaggggtggaaccctctccatgggatcagtccttctatatgaacagccacatgacagcttgcttccttcctccctctatgccatgtgaggacacagcaagaaggcagctgtttataagtcaggaagtaagacctcaccagaatccaaccatgctggcaccctgatctcagatttccagcctccagaactgtgagaaataaatgcttgttatttaaaccacccaggctatggcattttgttacagcagctagggcagactaagacacatattaagaaattccagccatctggtgtccaaatttcacactacgatgaataggaaactagcagcatcatgttctgagaatccaaagaacttagtcacagtgattaaccaaaaataatcaggtagatttaaccaatgaagataagtcatttataaccatttataaacagtagtttacaccaaaatctgaaaacctagaaatctacaaaaagacaattccttctgagtacaactatttgtgtgcttgtcagtatattatcagagaaaacctgacctttagagtttaagcactgttctaggtcatctttaataaaaatttaataaaaataatgaaactaaaaaagatactctcccagtacctgttcttccctctccttttctttggtcttacttctgtagactctagcagagatggcatcctgggatggaatggcagagatctgatgcagtggcatgctcatcccaacctcttatctggtcgtcttcttcacagaagagagtctccactggtagagtcattttgggccatggatttcaagctgagagaaaatgaagagagaataaacataactcagctaaaacactttaaatttccaagagtgagcttaacattttatacttatattcatatgtatatttaaataagttacggcaacataaatgtttggtcttcaaaaacaatagaagatgaatgtctaaggggaaaattctaacatttctcataataagatgggagcacctgaaagaggcaggtggatcacgtacatgtataatcagagatataatcttccattggctacttaggattaaaacaaagcagtgccaccatttattttaagaatatttttgaagttaaacttttttttttatcatgaccaagcatttgtcctgaaataagcagtgatctttccttaaaaccactgtctgtgagtccacataatggtgagatcagaggttaggaagtccaaattaaactcaaggtatctatgatccatacttaaccttccaaaagtagagactctacacgagctgttggcaaactattcctataaagggcaagatacatattttaggcactgtggtccaagtgtgttccagctaattaactctgccactgtagcatgaaagcacccatagagagcatgtaaatgggccgggtgcggtggctcatgcctgtaatcccagcactttgggaggccaaggcgggcaaatcacgaggtcaggagatcgagaccaccctggctaacacggtgaaaccctgtctctactaaaaatacaaaaaattagccaggcatggtggcgggcgcctgtagtcgcagctactcaggaggctgaggcaggagaatggcacaaacccaggaggcggagctcgcagtgagccaagatcgcaccactgcactccagcctgggtaacacagcgagactccaaccccccaacctcccccccaccaaaaaaaaaagagtatgtacatgaatgagcatagttatgttccaataaaactttatttacaaaaataggcagcaggctagatttggcccaccagactatagtttgccaaacactgccgtaaagggtttcctagggaatatgaagggtcaccatgacatgcctaagaaccatgagaaaggctgcctttaggtaaaataacagtgtatgcataaactgtcttcagtgattccaggtactcctgccctgtttctggttttctcttacgcatcccccaaaatgtctaataattgaattgtgtgttgttctttctccccacttacccactgagatctatcccactctgtatacaaaaccaattaaacgtaaattatccagaaggtttaatgtagtaaaatgtttcatgttgttcaaattttaacagaaaatggaagccttcaaccaaaagaatgaatctcgaatttggagattttcatttattaaccatgtgctggggtagggggtggggacaggtgaggcagtaggaaaaggtagggtaaacaacagggcctgacaaccccaaggtcacatttgataagcagtcacttactctacctctccccaaactctactctggatcaaaggcaggtgtttgtaaggctggtgccaattcttagtagtgtcactaagcaagcagaggagcaccaggaatcacgaaatggcttccttcacacaactctagaatcaatgaacaacaaaaaggaacaaaaactgggagggatcaacacatagaagaaaattagctaaaataataatctgtttataaagtctagttttacagtaagtgagtgaccattgataataacaacaaaaaaaggaaaatagaataggggatgttagtgtctaggtatcacacaccacctactctatttcaagcctttgatgaggctggcataagatggagcactactgtgcccaagaaacagtctgaatgtttgtattcaagcacgtcacacaaaacaagaggcacttactgcggagctgccttatactccctgggagatcacaatagtcagtggtaagcagttttttcatcactaatgcactaacgtcctctattacagatgacaaactccatggggcctcttggaatacttggtcaaactgacgatatccacagccctatacctaccatgccaaaagctacctgtggtgcttctgatataatcatcattattacatcattggtacatgcccatgacaagcctgagaagggctatttatggcacagaaacacagatgcaagagggtctcaaattttttacagttttgaaggacatccctcctcactgtcattgaagttagtcttttgatatgtaccaccacaacaaagcaacagacctataagtttgcctgaaacaatctccctcctatgccacacatatttaggataaaaatgagtttacaaacaaacgataaaacaggccatgccattttttatgtgaagatttacatgaaaaatacaaatcatatattacattattttctttgcataatttccaaacatcttttatatcaactaaattaatctttacacagaataacagttaaacctcagcactatgcctcacaatccaggcatgagggcttcaatttgactaatgctaacttgcaaaatacagcccacctaacatgaacattcacatctagaagagatactgccaaagctggttgttgaagaaattggaaatggatgtccatgttcatggatcagaagatttaatattgttaaaatggcaattcttcccaagttgacatagagagtcaaagcaatctctatcaaaaactgagctgacttctttacagaaatttgacaagctgatctgaaaatttatataaaattcaagggactcagatctgccaaaacaaccttgaaaaagaacaaagttggagagctcacatttccagattgcaaaacttacaacaaaggaacagtaatcaagactgtgtcatactggaatatgaatagatatatcaatggaatagaatttagggcccagaaataaacccacgtatctatagtcagctgattttcaagaagggtgccaagatcacttcttggggaaagagtactgttttcaacaaatggtgctgggacaactagatagccacatgcaaaagaaatttggatctcttcctcacacaaaaggaaaaacagacaaactacacatcatcagaataaaaacttttgtgcttcaaaagacaccactgagaaagggaaaacacagccagtcataatggttcacacctataatcccagaactttgggaggccaaggcaagagaatctcttgaggccagaactcaagaaaggcctgggcaatatagcaatactctacctctatttataaatgttaaaaaaaaaaaagtctaaagacaactgacagaagaaaaagtttgcaaatcatatatgtaataagggacttgtatctagaatatataaacaactctcttacaactcagtaacataagggcaaggccaggtgcaagtagctcacgcctatcatctcagcattttcggaggctgaggtgggaggactgcttcaggccaggagttcaaaaccagtgtgtgaaacatagcgaggccccatctctaccaaaataataataataataataataataataataataataataataataaagacaaataacccaatgaaaaatgggttaatcaacatcattagccatcatggaaatacaaatcaaaactattagatattactttaattatgttcataataaaagacaaacaagtgttagcaaggatgttgtgacactgaaaccctcatatactgctagtgaggatctatgcagtcgttttgaaaaatagtctggctctttctcaaaaggttaaacatgttatcatatgacccaacaacttcaatcctagggtatatacaccaaagagaaatgcaaacatctcctcatatgaaaacttgtccatgaatgtttctatcacattactcatgatagccaaaaggtggaaataacctaaacgtccatcaaatgataaacggataaatcaaataagctatatccattcaacggaatcatattcagcaataaaaagaaataaagtactgacacatgccacaatatggacgaacctttaaaaagttatgctaagtaggccaggtgtggtggttcgcgcctataacaccagcactttggggggccaaggtgggtgaatcgcttgagcccaggagttccagaccagcctgggcaacatggcaaaaccacatccctacaaaaaactcaaaacttagccgggtgtggtggctcatgcctgtggtcccagctactcaggaggctgagttgggaggatcgcttgagcccagaaggttgaggctacagtgagccggtatggcgccactgcactccagcctaggtgatacagtgagaccttgtctcaaaaaaaaaaaaaaagaaaagaaaaaaattatactaagaagccagtcacaaagaaccatatattacatgatgacagttgtatggaatgcccagaggagataaatctatagagacagaaagtagagcagtgcatgccaagagctggggtaggaatgggtaaacgggaggaagcagtggattcaatgatttatttttaggataatgaaaatattctaaaattgactatggtgctggttgcagaactttcgagtatattaaagccatagaaatagtaaaaggactaagatagatagagaaaattttaatttttcctttgtgttatccctaatctaactaatctagatgacatggagatggctactgttgccctatctcactcacccttccagttttaagaaggcgatagaaagagtacaaaggttgggttacccacaaagggaagcccatcagactaacagctgatctctcggcagaaactctacaagccagaaaagagtgggggccaatattcaacattcttaaagaaaagaattttcaacccagaatttcatatccagccaaactaagctttgtaagtgaaggagaaataaaatcctttacagacaagcaaatgctgagagattttgtcaccaccaggcctgccctaaaagagctcctgaaggaagcactaaacatggaaaggaacaactggcaccagccactcaaaaacatgccaaattgtaaagaccatcaaggctaggaagaaactacatcaactaacgtgcaaaataaccagctaacatcataatgacaggatcaaattcacacataacaatattaaccttaaaagtaaatggactaaatgctccaattaaaagacacagactggcaaattggataaagagtcaagacccattactgtgctgtattcaggaaacccatctcacgtgtagagacacacataggctcaaaataaagggatggaggaagatctaccaagcaaacggaaaacaaaaaaaggcagaggttgcaatcctagtctctgataaaacagattttaaaccaacaaagatcaaaggagacaaagaaggccattacataatggtaaagggatcaattcaacaagaagagctaactatcctaaatatatatgcacccaatacaggagcacccagattcataaaacaagtccttagtgacctacaaagagacttagacacccacacagtaataatgggaaagttttaacaccccactgtcaacattagacagatcaacgagacagaaagttaacaaggatatccaggaattgaactcagctctgcaccaagcggacctaatagacatctacagaactctccaacccaaatcaacagaatatacattcttttcagcaccacacctcacctattccaaaattgaccacatagttggaagtaaagctctcctcagcaaatgtgaaagaacagaaattataacaaactgtctctcagaccacagtgcaatcaaactagaactcaggattaagaaactcactcaaaaccactcaactacatggaaactgaacaacctgcccctgaatgactactgggtacataaagaaatgaaggcagaaataaagatgttctttgaaaccaatgagaacaaacacacaacataccagaatctctgggacacactcaaagcagtgtgtagagggaaatttatagcactaaatgcccacaagagaaagcaggaaagatctaaaattgacaccttaacatcacaattaaacgaattagagaagcaagagcaaacacattcaaaagctagcagaaggcaagaaataactaagagcaaagcagaagtgaaggaaatagagacacaaaagacccttcaaaataatcaatgaacccaggagctggttttttgaaaagatcaacaaaattgatagaccgctagcaagactaataaagaagaaaagacagaagaatcaaatagaagcaataaagaatgacaaaggggatatcaccactgatcccacagaaataccaactaccatcaaagaatactataaacacctctatgcaaataaactagaaaatctagaagaaatggataaagtcaattaggaaaagaggaagtcaaattgttcctgtttgcagatgatatgattgtatatctagaaaaccccatcgtctcagcccaaaatctccttaagctgataagcaacttcagcaaagtctcaggatacaaaatcaatgtgcaaaaatcacaagcattcttacactccaataacagacagagagccaaatcatgagtgaactcccattcacaattgtttcaaggagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccccatcaagctaccaatgactttcttcacagaattggaaaaagctactttaaagttcatatggaaccaaaaaagagcctgcattgccaagtcaatcctaagccaaaagaacaaagctggaggcatcacactacctgacttcaaagtataccataaggcttagccacagtaaccaaaacagcatggtactggtaccaaaacagagatatagaccaatggaacagaacagagccctcagaaataatgccttatacaaaaattaattcaagatggattaaagacttacatgttagacctaaaaccataaaaaccctagaagaaaacctaggcaataccattcaggacataggcatgggcaaggacttcatgtctaaaacaccaaaaggaatggcaacaaaagccaaaattgacaaatgggatctaattaaactaaagagcttctgcacagcaaaagaaactaccatcaaagtgaacaggcaacctacagaatgggagaaaatttttgcaatctactcagctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcatcactggccatcaaagaaatgcaaatcaaaaccacaatgagataccatctcacaccagttacaatggcgatcattaaaaagtcaggaaacaacaggtgctggagaggatgtggagaaataggaacacttttacactgttggtgggacagtaaactagttcaaccattgtggaagtcagtgtggcgattccccagggatctagaactagaaataccatttgacccagtgatcccattacttggtatatactcaaaggattataaatcatgctgttataaaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgaattcatgtcctttgtagggacatggatgaagctggaaaccatcattctcagcaaactattgcaaggacaaaaaaccaaacaccacatgttctcactcataggtgggaattgaacaatgagaacacatggacacaggaagcggaacatcacacaccggggcctgttgcggggtggggggctaggggagggatagcattaggagatatacctaatgtaaatgaagagttaatgggtgcagcacaccaacatggcacatgtatacatatgtaacaaacctgcacgttgtgcacatgtaccctaaaacttaaagtataataataataaaattttaaaaaaatgcaagtgaaaatataaagcaattactaacaacaacaaaaactatagaagaaagaaaatgtaataatttggctttaaaatgaaacaaatttcaacacggacaatggtataaacattacaatcatataagcaacacagatataaccaaattgggaggatgggaagagggaacgttgggtaagaaaaggaagtcaacagataatagctaatgtttatgaacatattatttgaaaacatggaagcaactctcagaagatacatgcggctgcctatggggaagattctgtccattccaacaacaaggctttggactgtgccagagcaaaggactactgtttttcattctaggacattgggtacaccaagctcctaaccatagttctaaaattcagaaaactaccaaaattaaaattttttaaaaaccactctaccctttctttacttatttaacactaaaacttgattgaactcctaggccgggcgcagtggctcatgccggtaatcccagcactctgggaggctgaggcaggcagatcacgaggtcaggaaattgagaccatcctggctaacacggtgaaaccccatctctactaaaaatacaaaaaattagccggggcatggtggcgggcacctgtagtccccagctacttggtaggctgaggcaggagaatggtgtgaacctgggaggcgaagcttgtagtgagccgagaccgtcctaccgcactccagcctggtgacagagcaggacttcgtctcaaaaaaaaaaaaaaaaaaaaaaaaaagacttgattgaacaccctggggccaaaacctgacctgaactaacaggaagctattcaaaactatacttatgctacttagtgtaaatattatatatacttcaatgcagaaatagcgcatttgagtaagggatcttactccaagcctcgatgggagtatctgataatttatagtatatgtagcagagtactgtagcagactactttcctaaaaacctgagaatttctaaattctaaaatatttctgatccaagagttttgaataagagagtatgggcttacaattcatttttcaaaatgaaatgtattacttttattacatgtattttagtacacgtattacttttattttttagattttgaaggtattctgaagaattcaatggagagaaagtataaaaagaataacaggtatgagactcatgtgaccttaaacagatcaacatctaatgccacacactttccaaaagtggcattattcctggatcattatttaagataataaataaagaggttacattgtctaattagaaatttgaaaaagaaggcaagaaaacttcacttgactcctcattcatatcccactactgtcccatctatcctactcttctaggaaaaggtggtctacactcacattcaacatttcttcactttctatacacatttcaactaactacaatctggcttcagtacagtaaggtctacaatgctctctatattaagcctaaaaattgttttgcagccctcatgttatttgacttgatacttttactctcttcctagtcttaaaatactcttttctttgacttaaatgacataacaccgtcctagtgttcctcctgctccatctccacctctgcagatctatcccctatagcatgacattgtacacagatattcctcaaagttccatttaaccctctctgattctcattctgtgctcccttttcctgggtgatttaatccataactttggcttgaatgcccacctttgcagatgttatttaaaaagaaaatattgataaatcagactttattgaatttaaaacttttgcactttaaaagataccattaataaaactcaagataagccaccgactgggggaaaaatacttgacaatcatatatctgataaaagacttgtatctggccgggcacggtggctcatgcctgtaatcctagcactttgggaggccgaggcaggcggatcacaaggtcaggagatcgagaccatcctggtcaacatggtgaaaccctgtctttactaaaaatacaaaaaattagccgggcacggtggcgggcgcctgtagtctcagctactcaggaggctgaggccggagaatggcgtgaacccgggaggcggagcttgcagtgagccaagatcgtgccactgcactccagcctgggtgacagagtgagactccgtctcaaaaaaaaaaaaaaaaaaaaaaagacttgtatctagaataaagaactcctacgttaagacaaacaacataattttaaaataagcaaaatacattaacagacatttcatcaaagaaaatatatgagagccaggctctcatatgtgcctgtagtcctagctattcgggaagctgaggcaagagggtcgtttgagcccatgtgttcgaggctacagtgagctatgatcacaacactgtactccattctgggcaacagcatgagaccccgtctctaaaaaataaaataaaataatgaagacatatgaatagctaataaactcatgaaaagatgctaaaaattaaaaccacaatgatataccactatacccccactagaatggctacaaccaaaaacactagaatggctccaatcaaaaagacagtcaatactaattgtttgatatagaaaaaattagatctctcatgtattgctggtgagaatataaattggtatagatacttggaaaatagtctggcagtttcctaaaaagttaaacataaacttatcctatgacccaggaactgcagtccttggaattcatccaagagatatgaaaacatacgtccacacaaagacacatacatgaatgtgcatagcagcattcctcataatagcccaaaactggaaatattccaaatgtccaccaactaaagaatagataaaaatgtggcttatctatacaatgaaattctattcagcaattaaaaggaaaaaaccaatcatatacactacaacatggatgaacctcaaagattatgcaaattgaaacaagtcagacacaaaagtctatatattatacaattccgtttttataaagtgtcttgagaaggcagatcagtgattgcctcatgttgggtgtagttgtgggtactatctgcaaatgggcaagagggaactttgggggcaaaggaaatgtctctaactggattacaatgacactgcactacttcaaatttattaatcactgaattgtacacttataataggtgaattttatggtgcctaaattacacctcaagatgctcatttaatacagcttacaaggccctatgttatctatcccacctcattttgtactacccctctctctatagtccagcaacagcagtgttccttcagtcccctcagacctcccagcaccttaccatcacagcctatatatatggtattctctgcctgcaacactcttccttccccttttgggctaactaactcttcctcaaccatctgaccatcctgacagaggaaattccacattcatagttctttataggatcaatgaagaacctctacttcattaacaatgttcacagaatgttacatttattgagttctttaattaatgactttctcccctactcagccgtaagctccccaaaggcagcatatctcattttgctcacctttgtatctctctttctgtggcccaatgcctatcacataagatctattaaataaatgctggttggatcaatctccctgagacagcaggcaaaaatggctgagaatttcatttgtaactcaaactattaagcaacactgttctctgtctcaaatcctgatcaagtaccctagtggagatttggaaaaactaacaaaaattcatgtttgtcaacctggtacaattcatttcagatgggaagaaacccactgatctttaaatatctgcagcagattgaccacatcagacttagttgaaaattgaaatggatttcaaatatagtggaatgtaatctaagtatctttaagaataattttagaagatgacaagtataagtagttaagaattactgatcaaagcattttaagacagaggaaaacttgagtttcctaagttacagataagaaatttcaacctttgagtcaaaaacgcaatgctggatagatagcaagttatggaagcttgctatccaacagctgaacgagagcccaaatatgctactgcactagtatcacctcaaagccttcttcccttcactcagccaggaaagaaggctccccctgccacatcacatctcgccctctgtctcactctcacttaaccactggttagcaaggctaaccttaagctataaagctataaagattgccctgctcctgccttttactgaaacgaagaccaaaattaaacttgaaagctctgagaaatttcagggaagatgacagagaaacaccacaaggtctccatatgttacccactaaaaaacagtctgatgcaaattttgttatttgggcttggcctgttaaaactattagctttaaaaacagcgagttcattttaaaatataaaaatgagctgaatttttatttatttatttatttatttatttatttatttattttgagacagggtctcgctctgttgcccaggctggagtgcagtggtgcaatctcggctcactgaaacctccaccttcctggttcaagcgattgcgctgcctcagcctcccgagtagctgggattacaggtgcacgccaccactcctgtctaatttttttgtatttttagtagagacagggtttcaccatgttggccagagtgatctcaaactcctgacctcaggcaatccgcccgccttggccttccaaagtgctgagattacaggcgtgagccacagcgcccggtcatgagctgaaattttttaatgcaacaagaataaagcaggccaggagtggtggctcacacctgtaatcctggcactttaggaagccaaggcgagtggatcacttaagctccggagtttgagaccagcctgggccacatggtgagaccccatctctcctaaaaatataaaaaaaattgctgggcgtggtggtgcatgcctgtggtatcagctacttggtcgacagatgggaggatcacttgagcccaggggacagaggttgcagtgagccaagattgtaccactacactccagcctgggtgacaggaggagaacctgtctcaaaaaaaaaaaaaaagttaactaccagaaaatatatatgcaattaccaatagtgaagaaatcataagacatacaaacatatcccacagactaaagtttatccagaaacaaaagactgaagtttgttagtttttaaatctcctagagtaatttagagcattgccagttgcagtggcttgtatctgtagtcccagctacttgggaggctgaggtgggaggaccactttaggccaggagttctagactggcctgggcaacatagaaagaccttgtctccccaccaaaaaaattcagatcattactagaggtaataaagggtacaataaatgttaaataaaacaatagtaaataagcaatgctgaaaataagtggaaaataaaatccaaagcataaataatttaaacagataaagtatatgaagaaactaaaaagtataaaaatactgcctgtcaataataatggaggaaaaaactagatgaaagcatttgtaaatcttaagtattttacatgcatatttcatttaaatctcacagcagtgccaggagggagagaaacttttatctccctttcatgcatggcttagagaaattaatcaacttgcccaagctttcacagccatatttcaaggactctcagctgccagcatttgcttgaccttacagaaggtgtcaacaaaaagtttttatgcaactagaccataattatccctgactaagcggggattccaaggtgccaatttcagagatgttagaatggataaaaatgcacaacttatgcttgactaaatgtgatagtgtgcagcaaccgatcaggtgaacctaaaatatgtagcggtttttttgttttttgtttttttaatttcacagtggcactgctacgggaaggactaagataaaacataatatgttcctgtctttgttgtagtaaagaagagctattataatccctatggatatagaagacaacatggaattcacatttgaagtattaaatagtgacaggccttttgttgtcttttttgtctatagagggacaacttaaccaaagcaatggttatatctgcctaaaatttggcaaagataataaattagatatttcaaaagtgggttactttaaggcactaagatacccctcaaatagttaggtcgaattcatggcagatatttaactgtagcattttgagttcacttgcaaatttgtatcacaagccacagaaaagaaacactgcatttaaaaactatagcccacatccttatgttctttcatctttattctagtagaagatgcaaggtaattttccaacacataacctcagaggttgaagccaagagcggcagaatggatggattcaaggtgtgccaacaatgctacccagtaggaaaaaattccataaaaactgggcccctaaggaaaacaacaaagcctaatgctgaagtcctgtccaaatgcaagtgcttggctaagagagagcagtcaggctgtagactgaaaggcagtgtatgcaatttagaatccccagaagtagagtaacagagagacaccacagctgcatgagagtgagatgctaatgtggggcaggcaggactcggctccagacagtgcatgctatcaggacaccttccatgactcgggaagacctcagtacaaccaccggggcaggtacgtgaattaggtaaaccaggtgcaattaactggaaaaagggcctggactaatgtctgggctttctgaaagattttgcatctcagggaaattatggaatagccacagtattcccttggtaatagaatgcaaaaatactgaaaacactcaaagttaagaaaagggaaaagagaagatttgttagggttcttttagcatttcacgtctgagaaacagaacaggtgttttcaacacttggaaaacaccttcaatccatcaagcacagaaatagtctgcgtttggccaggcacggtggctcatgcctgtaatcttcgggaggccgaggcggtggatcgcctgaggtcaggagttcgtgaccagcctggccaacatggtgaaaccctgtctctactaaaaatgcagaaattagccgagagtagtggcaggcgcctgtaatcccagctactcaggaggctgaggcaagagaactgcttgaacctgggaagtggaggttgcagtgacccaagatcatgccattgcactccagcctgggtgacaagagcaagactccatctcaaaaaaaaaaaaaaagaaagaaaagaaatagtctaccttcttgagctcctacaagagctcttcagtgcttgccctgcagagaacagtgtctgatccctatagataacgaaagggggatgaaggagaggtcaaggctccagcagcccagcgttctccctgggtattcagcacatcattagagaataaacctgtttactttgctgcctccttgaaggctcagtaatgaagccatgattagaattgcagtcatggattccagccacttatcacaagatgttccattttctcttgctatgtaacaaactacccaaaactttgttgcttgaacagccatgatttcctatttctcataattccatgggttggctgggcagctcttctgctgcccttacctgacttacaaaggctgcttcgctgggctcagcagggaaggcagggccttctccatgtggccttttcttctaggcttcttcacatgttggcagcagcatcccaagacagttcacccactacacatggtgcctctgcttgcactgtgtctgctgattgagaccaaagtcaagaagggggaaaagagactctaccacttgatgggtcctgtggtttgaatgtgtcccccaagttcatgtattggaaacttaatccccaatgcaacagtgttgacaggtgggacttgtaagacgtgatcaagccatgagggctctgccctcactaatggattaatgctgttattgaggaagtaggttagttatcatgggagtgggttcctaacagaagaataagttcagcctccttcccttctctccatcccaggcacatgctctcttgcccatctgccttccaccatgggatgatgcagcaagaaagccctcaccagatgtgagcccctcaaccttggacttcccaggctgcagaactgtaagaactaaatctctgtactttattaattaccccatctcaggtactctgttacagcagcacaacacagactaagacaatgggagaaacaagtgaagtcatactgcaaacaggcagagctgggagcggggacagggggcagtgattcattaggagccgttttgtaacaatttaccacatgttgttttcgctgctttttcctctgataataatagtttttatcagtagagtgtttttataaggtgttttcacacctattataaattcaaagctaattatgatctttataatacggggaaaaaggtgctcaactctatttctactacagaataacattaataaagatccaaaaatattcccaaggtttagatacttgaattccttctagcaatccataccgcttgaagatctcacgttccttaacaaacacatggatcttgtgaagcatctttagtaggctgacagaggaagaaactgtggccaaagtttgtaacagaaaaatcgaaggcaattatacttcatttgaagtgcttcctgcagaaagaattctcagcatgtcattgtacaatgcagcatgtaaggacagtggcacacactgctctgcaccagtcagctgtcatctcaggccagaacaagcatattctccacatactgcagtaaaccagaaaaaccagagcagaatttgcctcactactcaccttaccccctgaccatccgagatatgtctgcccaggcaggacaaatcttctcaaggacccctgtacatgccatgtacaaccttacccttgttcattctgtcccaccttcttgggatgctctttcctctttgcccatcaggcccaaaattccctggccttcagaccacacctcaaagcatttcttctctacaagcaaaacatgttcccctttcccttctttacaacccatagcagttacccaatttctttacaggtggacattagtcacattaaaaacagtccttcaatataagtgatggttaatttcacatgtcaacttgactaggccacaatatgcagatatttggtcaaacattattctgaatgtttctgtgaaggtatttttaagataagactgacatttaaattggcagacttttttttaaggcaagaccggatttattcccattttatagacgaggaaacactcagagaggtcaagtgatccacctgctctaggtcaatacatgactcagctgaaacttcctctcctagatatacaatgagagtaatgccagacctgcttctcaaaacagatatgcacaagaaaactgttttagtctcattcttctgacaactagaaagtaaatattcaccaggccctccctgtgcacataacattatcataagtcagaagtctgtcattaagaacataaaatcacagtgcagattgggagtgggaagatacacagaaaggataccaagagtttctgtcaactgcccctggtttgagttcaacattttttttagagatgcaatttttttttttaggagatggggtttcactatgttgcctaggctggacttaactcctaggctcaagtgatcctcttgcctcagcctcccaagtatctgggactataggtgcctgtcaccacacccagcttctaaattggtggattctgagtaaaatatcctgctttccataatgtgcgtgggcctcaaccaatcagttgaaggccttaatataaaaatgactgacctcccctagaagaagagggaattctgccagcagactgccttcagccttgaactccagaatcaactcttccctgagcctccagcctgccagcccaccctacagattttggacttgttagtctccacaatcatatgaaccaattccttaaaataaatctctctctcccaatctcatctagctatctatctatatatataggtatatctgtacacacacacacacacacacacacagacacacacaccctattggttttgtttctttgcagaactctgactgatacaatatatcacatagtttagatcattccttgcagggtacaaagcctggcctacttaaaaggctatatgatccctggagtgttgcatattttttggcaattcctacagtcttctgtaccatcatgtttctttagtattccctacggtgttccatacagagcaggggtaaaaatattccaggaacttgaatttgtgcttccttatgactaaactttgtatccttccagtttcctaacctttctgcaccattgactgtgatatgtatacatactaaagaaggtgaaagaaagaaaaggaatactgctcccattttcccatggtgaaatcccaaaggtggttaatgtctattaaaaactagtagttttattactaactggcacacaggtggtagaatttaaaaaaaaaaaaaaacactataaactattatttgctttatgatcctggaatccattcttttcaattttctccacctagaaaacatcttttagtgaaaaaactataataaaagcaaaaaaatgttttagtcaatcatcaaaataataacccaagaccaaatttaaagtaatataaacgtaaatcaggaatagtttttaaagtcagctatcacgtcttagagatttttagtttattttaaatccctttgggaagacctagaatatttcattcatttaacctaagcaaacaaatggacaaggacgtattctcatagtctgacccaattttccgagcatcttccaagtgccaggctcctactaggaactggaaaattttagaagtgaactggtgctatcattcgtccctaaaatagattagtgaatgcccagaaaataaagaatgctcacatttaagctactctctaacaatgtgcatatttctgctactaccagttgaattgtgcacattatcaaaaacctattgtttcatctccaaacctgtttatgtcagttgtactcattctgcaatggtataatttaattgaatactatataaactgatcacaaatggacaaacatgtggctacaaaagtaagaagttactatttctataaaacctatgttgaatactttggaaagcatccatacaggcatattactttccttaaaattttttgacaaattgagtatatataaaacaactataaaagactagaaaacaacactaaaataccagaatcctggctaggtgcaatggctcatacctgtaatcccagtactttgggaagctgaggcagaaggatcacttgaggccaggagtttgagaccagtctgggcaacacagcaagaccccatctctacaaaaaaaatttacatttaaaaaaaaagatagaattctatgctctgactgcttcagatgttcctaaagtctcaatctactttaaacagagtgaaactagaaaacacagaagctactctataaatgtggtttttacaagaacaataatacagaactgagaggacccataatactcaaagaaagattactaccctagatcacaagactggccttttgcatcctccactattcccagaacaatccatcagtagcagtaacattacgcttgaatacttcctgaagtcaagttgttttatttaaaactgaaatatccctctaaaagacaacaacaacaacaaaaaataagtatgtatatacaaggtattcactgcagcactatttctaacagcaagacactaaagacaatccaaatgtccattaatatgggactgacaataaactggtaaattcacacaatgaaatagacaaaaaggcatgacaaatgtctctatatacttctatggagtgatcagcaggaaaaataggaagacaaaaaagcaagaagaaaattatacatagtgtgctaccattcacctaagacgggattaggaggcagaaactatacgtgtgtgcacatgcatggacatgcacacacacacacacacactcttgctcatgttttaaatggaatgcaggaaaaaaaatagagggaaccacaatcagagatggatttctctgattctgccttgttttacacatttagctctggaaccatgtatatgttttccataattgtttaaaaaataattgaaaaactgtcatctctaaaattcaaaagcaaaatgaaatgaccctaaatatttgttgaattggtggtataatcatgcaaaaaggaattatttcaaatgatttaaaacagttttaccagacatccctataggaatctatcctaaaaatgaaaagaatttgggaaagtgcttttaattcttaaactattttcagtaatcatattgttagcagtaacactgacaagtaatggtatcaatatgattatgatcaagaaccaaaatttttagcatgagacaaagataaaattaaagaaattcaacaaaatcatctgttcctaagtttataatggaaaaatcagtatgaaactcataaaatattttaccttaaaaataacgtatttcctagccccattcactgaaaaggcctagaagtaacaaccaatctgtagtttccagactgtggtcactaaatacaatttccctctgaaaggaaccagggctggttaaagaaagggataattccagatctatggctgttaatgtacaagatgagcctggacatcttgtcacacaagaaagcaagaagccatcagaagcacccatgccaaaatgacccaggagctaatgtgaaggcactcccattggccaaagaagagacaatgtggaccaggtgcagtggctcatgcctgtaatcttagctctttgggagactgaggcagggggatcaccggaggtcgggaattcgagaccagcctgaccaaaatggagaatcccatctctagtaaaaatataaaattagggccgggcgtggttgcccacacctgtaatcccagtactttggaaggccaagactagcggattgcctgaggtcaagcgttcaagaccagcctggccgatgtgataaaaccccgtctctactaaaaatacaaaaattagccaggcgtagtggtgcgcacctgttgtcccagctacttgggaggctgaggcagaagaattgcttgaacccggaggcagaggctgaagtgagctgagattgcgccactgcattccagcctgggcgacagagtgagactctgtctccaaaaataaaaataagaaataaaacattagccgggcgtagtggtgcatgcctgtaatcacagctactcaggaggccaagggaagagaatcgcttgaacctagaaggtagaggttgcagtgagctgagatcatgccattgcactccagcctgggcaacaaaagcaacactcttgtctcaagaaaaaaagaagggacaatttgatcattaataagaataactgtggctgggtaaactggtttgtgccttatagtcccagctacctgggagggtaaggagagaggatcacttgagaccagcctgggcaacatagtgagatctatcattaattaatgtaattaactcattaaagaataactgcaatgaacttaagaaatcatcaaacatattaaattcacatgctggctgggcgtgatggctcacacctgtaatctcagtactttgtgaggccgaggtaggaaaatctcttgagggccaagagttcaagaccagcctgggcaacacagtgagatcccatctctccaaaaacgatttcttttttaattagctgtgtttggtggtgcatgcctgtggtcccagctacttgggaggctgaggcaggaggatcgcttgagcccaggaggttgaggctgcaatgagccatgattacaccactgcactccagcctgagcgacattgtaagaccctgtctcaaaaaaaaaaaaaaagaaaaagaaaaagaaaagagtatgtgtttataatgatactttttaaataaaggaaaaagcactggccatttttggaaatgctagggaccctccaagagttgtaagtaaagagaaagagtcactcatttaacctgacttccctgtataagctatacctctgggtaactgaacagtctgtaaaaagagtcttctctgtactagtattccagcgaataaatgaaaaaggaatgatgaaattagaattgcaacatcttgcatgcccatgattaagtaatggatctatgtgaagaataagtggtcactactgtttcaaagcaaaaaaatcatttcgcaaaattcatatataatagtatgagcaagtgcacaagataaacggcatgattttttcagtaaataacatttcaataagacagaaaataaggaaaacctatagcttaaaagatattgaagaaaacctatcaaccgaatgtaatgtgtagaccttgtttacatcctgatgcaaacaaatcacagtacacacaaacacacacacaaaactgtgaaataactttgggatgatagtggtattgtgtgattcattctaagaaaaacagcccttatctttcagtgaaagtactaaaatatttacagataaaatgaaaagaacaagaatgtacccccaaaaatggactgggagagggatataaagaaacaaaagacgctatgagtggatgccagctagagccaggcacaaggcggttcacggtattcttcctttacttctgtgtatgttttaaattctccataataaaagttttgaaactttgatgtatgactgtatgtctgtatgctttaataataaaatgttaatggcatataaaatttttcaggatttcctgctttatgttaaaacggcttctccggttctttccacaaaagaggcatctgggggtcaagtcccttatttctctgaattatcaacttaaagcatagggcctgctacccaggaagtgctcaataaatgttaaatgaacgaattctgtttgctatacttctctgctctgctaaaccttccaaaaccctaatctagtgatccaacttgtagtaaaggatgagtaaatagaatcaagtattaaaaagacaaaaaatccaaaaccctgtatgtacttaaccttttaagtctatgttccataaaaaaatggttgtttttttcttgtggtaaaaaacacaaaacataaaatttatcaaattaactatctgtaagtgtacagcattcaacagtgttaagcatattcacatggttgtgaaacagatatccagaattttttcatcttgcaaaactgaaactatacccattgaacaacaaaaggtgcctattctttttttttttttttttttttttttttgagacgggagtttcgctcttgttgcctggactggagtgcaatggaacaatctcggctcactgcaacctccgcctccctgggtcaagcgattctccttgcttcagcctcccgagtagctgagattacaggtgtgcgccatcacgcctggctaacttttctatttttagtagagacggggttttgccacgttggccaggctggtcttgaactcctgacctcaggtgatccacctgcctcagcctcccaatgtgctgggattacagacgtgagacaccacgcctggcccaaaaggtgcttattcttaatacttcctacccattgtctattctatcctacacagacctctagctaccacagctttcaaagtattattttctgacaatatacattgtggatcaccagcacaataacatcaaatagaaaacaaccagtccttaaagaaaataggaagggtcttaagtctgactgtgaacagaagaccatacgacctcctgtgcagaggaaatgaagatagggctggaatgtggtttcagggtcactctaaacggaagtgaggaaccaaaacaggaagaggcaggcccacagctaagaggaggccacacgggctgcagaaggactcattccatgtctgcatttaacaaaggcttaccactgcttaggcagccccataacaatgatggaaaggcccctggtaagcacacagactcacaggtgccttaggtcaggtacctggggaagcactatgcaagtctcattcaacagacttttagttaaatatgcttatgcaggcctgcaaaaaaaatgacttagctataaatttggtaataataacttagtatattatgtaagaaatgtcaatgatcagtatcagtgaccagtgatcactgatatttttccatgtgttactatagttctaattatctttggtaatagatgaacgcttagtcaatcactcctttttcaaaatcattttcatacattattcttcagaagcatgactcctagcctgagtctgcactgggacaactccaggaaagatagagattttgtacatgactgaggataatagcagagtcaaggcagacaaggacctgtttaccaaaagcacctagaaatctccagggggcagggatcttggggaacggacattcattctacagcaagagttcaggttaatccaaagaaagccacagaccatgagaagagagtagtggcttggaggacaacatggtatctgtcattcacactatcctacataaaagcaagggatgatagtggtattgtgtgatttgttctaagaagaacaatcaaattaaaggcattctcaaaaggctctgaagaacagtaacacttcaaggaatcagcagcacggaaagcagcagctgttgccacaggactgacagcagcgtgggtaacaaggaacatcctgatggccacagccatgacagttgacctatcaaccaaacgatctttgcactgacaacagtggctgcacttctggtgccaggcgcacggtggtggctctcagttctgcctccagcactagcaggctgtgtgtacatacaaacatacatatgtgtatgtatgtataacacccagctactgacagtgagaccggagagcatgcggggagaaaatgggagcagaggtacaaaggatctttcacctcttcaatattaactgttttataattatgtagtaccacaaataaaacttctattttgaataaatagaacagaacacattgaggcctaaagggaagaaatatgtagtaaaatcagaaaaaagaatttataataaagtcccacttgtgctttgacaattcttgccttttaaaccaagtaatattccaagtaaatacatctttaaagaaagaaaaggtatagtttaagatgtagtaatttatggcaatttcaattattcaggaggaatatgtattttaggaaaggaatgaataactttagccctgtcatcatctggaaattagaagttggtaaacataccgtaaatctaacctgcctgtatgcttttcaccttacggctctgggtaagaatgaatgccataacatatgtgaaaatcacttgcaaactatacggtggtatgtacatagatgatagttaagtttctaccatcacaaatgtgctataatttttttatctgactttatattacagaacacagtataatgaatttttaagaaatacaatggtccctaaggctacttccttcttttttgagacggagtctcactctgttgcccaggctggagggcagtggcacaatctcggctcactgcaacctctgcctcccaggttcaagcaattctcctgcctcagcctcagctgagattacgggcatgcgccaccacgcccagctaatgtttgtattttttagtagagacgggatttcattggccatttcttatattactaattcatacacataagaatttgttttcatttaattgaagatgctcttatgtatactgatatttaaataaacatgaacattaaatctttgagattaaaacctgtataaatataactggaaacctgcaattccttcttggctagaaacccataaaaaaaattccaagtgtgcattagactcacaatagttttcatacaagtatgaatggcataaaaatttttaattcaccaaatatatttctgcaactgggtcattcattttctaagttagaggccttttatttttatatcctttgtggcttcaaaaagaattttaaataccttgtaagtatacacactaagtatacatcacggcacccttccaagggagcgggcctcggcagtgagatttgaacacagaatccttcctccccgcaacacacagacaggcagctgctccaaggacagccaatctgctggctgggaagaggctaattaggtaagctggcaaattaggcactaaaagggaggtgaggctgaaagaatatataaaggaagatcctcaaagattcacaagcaaagatgaggtgagagggagctgagaaccagaaaaacgagatatgaaatagagaaaagataatgttgtagatgaggaagccttctggctgtaggagatccatcagggtggtaggaacaattgcagaacgatgcaaaccttcttggaaggccaagaggttttataaaagctttggaaaacgatttggctgaaggcagctagactctcttatctggtgcctgaaagcttaggttagataacaaggggatgtaaaaaaactgatctagataagttagtttacttaggcctccgaacctggcctttcatcatccgcacacaggactgctcactccggggagggcgaccatgttgattacccacaagtgtgttgactcaaagccattgtcattaaatccgtgctgaataaatgcccacagtgccagcttgtcaaggccgcagctgctgactctttacagcaccctcctcggggtctgtgagcagcccggtcccctagcccgctcccctagctcactgtttcattggatacctgcatgtgagtgcattttttctcctgtcgttcagccagggtctgcgggtcggaccccacatctgtcctcgtgggaagagtgtagcagacatgaagagaacagcagaaatgcaataagcagtaagtgtagctgctccctagaactgtgttggatcctgaaagccattcagctccagtttccttgtgatctgaaaataaacactttattcttaaagaacactgatgtgagtttctgttccttaaaatcaaaaaagcctcgtataagatacatacaaggataagatatgtttaaacatgcaagggaaataaggcaaagagagaaaggagtacaaaaaaggtaacagtcctttcccagttctttatgataaaactatgtcatctctatacacaggaaaagaatttcagttctctatgatggcagggcacctgtctagtgcattcaaatatggtaataatgaaatctgtcaaaaagggaataaaaataaatctggaaaaataagctcacaataaaaaaattactatatacatagagaagtaaatatgagtgagagcaagcagaaagaacaaacatcagatactgccttcactatcatttcagataatgtaattatgaaacagaatttttttttttttttttgagacagactctccatctgtcacccaggctggagtgcagtggcatgatctcggctcactgcaacctccatctcctgagctcaagcaattcttctgcctgagcctcccaagtagctgggattacaggcgtgtgccaccacatccggctaatttttgtatttttagtggagacggggtttcaccatgttggccaggctggtcttgaactcctgacctcagtaatctgcccacctcagcctcccaaagtgctggcattacaggcgtgagccaccacgcccagccgaaacagattattaaatagcgaattatgtaaataaagaaattttaggccaggcgtggtggctcaagtctgtaatcccagcactttgggaggctgaggcgggcagatcacaaggtcaggagatcgagaccatcctggctaacacggtgaaaccctgtctctactaaaaaatacaaaaaattagcagggcgtggtggcaggtgcctgtagttccagctactcaggaggctgaggcaagagaatggcgtgaacccaggaagcagagcttgcagtgagccaagatggagcctctgcactccagcctgggcaacggagcaagactccgtctcaaaaaaaaaaaaaaaaaaaaagaaattttaaaatgagcaaacaacaaagtactaaaaacagccagtttcaaacaataaaacattgctttcacaaattaaaaatctaagtattaaaatgaaaaccaaatgagttaattaaatagcatattagtcacagctaaggagagattaccaaactacatgccaaattggaataaattactcagagttagggaaatgaaaaacactaaagagattaagggacataaagaatagactgagatggactcacacatgactaatttaagtcctagtgggaaacaatacagagaatagaagagaagcaatacatgaagaggttaagggctgagaattttcaaaaacagataaaagacttaaatctagatttaagaagcacaacatacacctaccaatataaacaaaaagaaatccacccctagactcacaggcattgtggtaaatcgcaaaataaagccaaagaaaagattttaaaacacagagagtaaagacagaagacagactactacaattagctcagactatagaattctcaccagtaacaagccagcagacagtagaatattatcttcgaagtatcaaggaaacttgtcaactgtcatcatatgcacaacaaaactatccttcaagaacaaagatgaaatcaagatattcccagctaaagtaacagagtttatgaccagcagatgatcactaaagaaacctcgtccttagataagcttattttttttaaaaaaaagaaacttcaaaagaatatactgtagcaaaacagaaaatgagctcagaatagagatctgagatgtcagatgaaatgacattcaagtattaaacacgcaagtatgtgtcagcaaacattccccatgctaaaaataataataattagcaacaggatttaaacaacagtgagaaaataaaaatctcaaaaatcagtgtttaaggtaagggcatgaggaaggggaggtcattaaagtacagttgaccctttgaatagtacgggtttccactgtgcaggttgacttatatgtgggttttttttttttaaaccaaacatagatgagggatgcaaaacccacatatatacagtctctctccctccctcccttcctctctccttcccctcccttccaagacagagtctcactctgtcacccaggctggagtgcagtggcaccatcatagctcactgcagcctccaactcctgggctcaagtgatcctactgcctcagctttcggggtagctgggactacaggcctgcaccaccatacctgggtaatttttttattttttgtagagacactgtctcactttgttgtccaggctggtctcaagctcctggcctcaagcaatcctcctgcctcggcctcccaaagtgctggaattacagccgtgagccactgcgcccagccccgatttttcttaaagacaggttctgctgggtcaacagcatgatatgagtatatgcaggctgtagtatacgcaagggttctggaaccaatcctctgtatatatgagagatgataaagtctttgtcttagcaggcaattaagatattgataaggttcattcagctttgttaacgtaagtctatgataatatctcaagaataaaccacaaaaatacttccaaaccaattcagaggaaaaataccataagaaaaaaatcaagtgaaaaaaccttaattgtatttttaaaaggaacaaaaaagaaaagagcacggaaagtgtcaacagaaagcaaaaagtaaaatggcaaatattcattacaaatatatcaataaccataatctatgtaaatgaattaaacttgccaattaaaagacaaataagattattttataaaacataaattaatttcagttacatattatttacataagacatacccaatgaatagcacaaaaagtttaaagtgaggactaaaaaggttaagtaagcaccagtcaaaagttaacaagaattaccatatcagaataaggcttatttcagctattacccaccaaaagtaagagaaagttgacaacacatggtcttattgagcaaacaggtaggaaatctcagcaaagaaataaaaagtggctaggcgtggtgtctcacgcctgtaatcccagcactttgggaggccgtggcaggtggatcacctgaggtcaggagttcgaaaccagcctggccaacatggtgaaacactgtctctactaaaaatacaaaaatcagccagatgtggtggcaggcacctgtaatcccaactactcaggaggctgaggcaggagaatcgcttgaacctgggaagcggaagctgcagtgagcagattgtgccactgcactccagcctgggcaacagagtgagactccgtctcaaaaaatataaataagaagtataaaacagaaccaaatagaaattcaaaaacagaaaagactgaaaattaaaacaaaaaatgcactttatgatcttaacagtagactgaatatgacacagtcactgaactggaaaacaaaccaataggaattacccacactgaaaaacagaaaaaaagactggagaaaaatgaacaaactctcacaaacttctgagataatatcaatcattatgacatgtacataatcagaaatgcaggtggaggggaagaaagtgaaactggaccagagaaaataattgaagatgcaataaccaaaaacttcccaaatttagcaaaaaatactgacttataaatccaaaagactcagagaacactaagtaggattaatacaaatagaaatacaactgagcacactgtagataaactgctgaaaaccaaaaggagaaaaatattgacagtaactaagaataaacaacaacaacgacgacaataacagtaatatgacggccagctgattttttttttaatcagaaaaagaagccaggaagtaatgcaacaacatctataatgctcaaagagaactatcagcccagaactccacatgcagcaaaaacatccttcaacagtgaagacaaaataaagacatggtctgataaacaaaaactaaggaaattaatccccagcaaataacatataaaaactaggatccactaaaaaaaaaaaaaaaaaaaatactggaagtgttaaatgtgtggataaatataaagaactatttttcaatttattctcttaatttctttagaagacacacgctggctgttgaaagcaataacaacactgtatcatggggcttataacataggtgtacataaaatacatgacagtaggctgtcatctctgtaatcccagcactttaggaggccaaggggggtgaatcacttgagcccaggagttcaagaccagcctgggcaacatggtgaaatcccaactctacaaaaagtacaaaaattaaccgggcctagtggtgcatgcctgtagtcccagctacttaggaaactgagataggaggatcgcttgaacccaggaggcagaggatacagtgtgccaagattgtgactgcactccagcctgggcgagagagtaagaccctgcatcataaaaataaaaataaatataaacatatatgacaacaatagcacaatgactgggtagggaatggaactgtgttattgcaattcttaattttatgagaagtggtatgttaattctaagtaggcaaggataaggatgcaactgcaaaaaaataaaaaaaaaaagtcattacatggaatactaaaaaatattcaattagccctaaagtagaaaaagagtagcaggaaaaaaaaaggacaccagaagacaaacagcaaactagtagacctaaacccaactacagtgaattctccttattcatagtagttatgctctataaagtcatcatgaacactgagttaccaaatatggaaccactgctcttgggaaaatagtattaagtccgtgcaagcctctggtcctgctaccttagtcagctgagcaatacataatcttgttttatatgtgtttttgtttaaaacacctcatttaatatctattgttaatttacttatattaaacccatggccaacagcactacaattcttgtctgagtgaagcttatctaatacatgtattttctccattggcacatcacagcctcttgcacttgggatcaccaggtggcacatcggccctacacttgagggtcattttaaacagcaaagtcaccccaaaagaagtataaaaatgtggaaaatgtggcactgaacagactggaaaagaaccctttcttagatttctgtgggcacacagtaggtgtatatatttatgaggtacattagatgttttcatacaggtaagcaatgtgaagtaagtacatcatgaagaatagggtatccataccctaaagcgtttatcctctgagtttcaaacaatccaattatactctaagttattttaaaatgtgcaattattattgactataaccactttattgtgctatcaaacagtaagtcttatccattctatttttttttgtacccattaacaatcctactttcccttcagcaccccactacccttcctagcctctggtaaccacccttttactctctacgtccatgagttcaattgtcttgatttttagatcccacaaataagtgagaacacgcaaggcttgtctttctgtgcctggcttatttcacttaacataatgatctccagttccatccatattgctgcaaatgactggatctcattatttttgacagctgaatagtaagtactccactgtgtatcacattttctttatccattcatctgctgatgaacacttaggttgctggcaaatcttagctattgtaaacagtgctgcaacaaaaacaggagtgcaggtatctctttgatatattgatttctttctggcggggggagggggggagggtatatacctagcagtgggattgccagatcatacgataggtcaatttttagttttttgaggaacctccaaactgttctccatagtggttatactaatttccattcctaccaacagtgtatgagggtttccttttctccacatcctcaccagcatttattattgcctgtcttttggatatgacatattaattaggtgagatatctcattgtagttttgatttgcatttctctgatgattgatgttgagcaccttttcatatacctgtttgccacttgtacatcttcttttgagaatgtctactagaatcttttgcccatttttaattggattattacattattttttcctatagagttagtagaactccttatatactctggttattaagcccttgccagctgggtagtttgcaaatattttctcccattctgtacgttgtctcttccttttgttgactgtatccttcgctgtgcagaagctttttaacttgatgtgaccccatttgtccatttttgctttggttgcctgtacttgtgggttattgctcaaggcatttttgcccagaacaatgtcttgaagattttcctaatgtttccttgtagtagtttcatagtttgaggtcttagctttaagcctttaacccattatgatttgattttttatacagtaagagataggggtctagtttaattcttctgcatatggatatccagttttctcagcacgatttattgaagagactgtcttttccccagagtatgttcttggctcctttgtcaaaaatgagctcactgtacgtgtgtggatttatttctgggttctcggttctctattctgttccattggtctatggatctgttttcatgccagtaccatgctgttttggttactgtatctccatagtataatttgaagtcaggtaatgtaattcctccagtcttgttcttttgcttagaacggctttggctattctgggtcttctgttgttccataaaaattttgggattgttttttctgtttctgtgaagaatgtcattgatattttggtagggtttgcatttaatctgtagactgctttgggtagtatggacattttaacaatactgattcttccaatccatgaacatgtaatatttttccattttttggtgtcctcttcaatttcttgcatcagtgttttatagttttcattatagagacctttcatttatttgggtaattcctaggtgctttattttatgtgtggcttccaaatgggatacttttttatttctttttcacattgttcactgttgacaaatagaaatgctactgattttggtacgttaattttgtatcctgcagcttcactgaatttaccagttctaataattttcttgtggagtctttaggtttttccaaatataaaattacaccatctgtaaacaacgataatttgacttcttcctttccaatctggataccctttatatccttgtcttgtctgactgctctagctaggacttctagtactgcattgaataacagtggtgacagtgggcatccttgtcatattccagatcttggagcaagggtgtccaattttcggtttccctggaccacactggaagaactgtcttgaaccacacataaaatacactaacactaagccaggtgcagtggctcacacccgtaatctcagcactttgggaggccgagacgggcagatcacgaggtcaagagatcatgaccatcctggccaacgtggtgaaaccccatgcctactaaaaatacaaaaattagctgggtgtggtggcacgtgcctgtaatcccagctactcgggagactgaggcaagagaatcacttgaacccaggaggcggaggttgcagtgagttgagatggcaccactgcactccagcctggtgacagagcgagactgtttcaaaaaaaaaaaaaaaaaaaaaaaccactaacactaatgatagctggtgagctttaaaaaaattgcaaaacaagccgggtgtgctggcttacacctgtaatcccaacactttgggagcccaaggcaggtggatcacgaggtcaggagatcgagaccatcttggctaacacggtaaaaccctgtctctactaaaaatacaaaaaagccgggtgtggtagtgggcgcctgtagtccgagctactcgggaggctgaggcaggagaatggcatgaacccgggaggcggagcttgcagtgagccgagatggcgccactgcactccagccggggcgacagagcaagactccatctcaaaaaaaaaaaaaaaaaaaaaattgcaaaaaaaaaccacatcataatgttttaagaaagtttacaaatttgtattggactgaatgcagcccttaagccatggattgaacaaacctgccttagacaaaaggctttcagtttttccccatgcagtgtgatattagctgtgagtctgtcatatatggctttaattacgttgaggtatgttccctctatccccagttttttgagggtttttcaacataaagagatgttaaatttcatcaaatttttttcagcactaattgaaatgattatatggtttttatccttcattctgttgatatcatgtaccatacagactgatctgcatatgctgaagcatccttgcatcccagggataaatcccacttggtcatgttgaatgatctttctaatgtattgctcaatttagtttactagtattttgttgaggatttttgcctcaatattcatcagagatattggcctgcagttttctttttttgatgtgtggaaaaggacccttgtttttcaaagtatgagagctgaaacaggagggcagagcgtcaccttatttgacctcagttgggaaaaaatgtgtgaagatgactcaaatttttcgctactctgtacatgtctatgaatgaccacgggaacacttcaagtattgatttaggggttacaaataaaatttgcaattttcacatgtatggaatcctcaaataatgaggatcaattgtgtatcaaggagactaaatattccaattaaaatgtagctttttttcagattggggagaagaaaaaaacaagacccaattatgtctacaagagataccttttgaatataaagacacgggttaaaataaagaggatggaaagataaaccacacagcactaataatagagtgaaaagcacaacactttccacaactgacacaagataaaacttttaaaatctaaacagccatgtatttattaagttaaaatactcagcctacccttttacaaaaagaagactcaaaactcagatggtttcactggtgaagtctatcagacacatgtggaagaaaataaaggagtaaacaattcccaattcattttagaaggtttgcataaacccattaccaaaatatttttcatttataaaaaaactataaaacatgaccataggtgattaacacagatgaaaacatcctcagcaaaacaatggaaagatcaaaatcagtaacttacaaaaagaataatatatcatgatactgcagtatttatcccaggaatataaaatttggattcacatataaaaggcaatttcatttactataataccagatgcaatgaaagcatttgacgaagttccatatccattccgggttaaaaaaaataaaaattttagcacacctacaaacagaaagaaacttcctctatcatataaaccttcagcaaataatgaaattctgaggactttccctcaaagattggcaacatggcaaagatagtgatagaaatcgcagcaagtctactcaacattatattatatagaagatcctagccaatgtaataggcaaggaaaagaaatactacgcataaatatttgaaacgaagttataaaactttcttttcagaggcaatataattgttaacaaacaaatttttaagaattatgtcaatctaacaagattcatttaagtaagtttggcaaagttgcaggatggcaggtcaataaacaattgtatttctatattccaccaacaaaatgaaattttaaaaacgtttctcaataccaaaaagcagattacttaagaataaacttaacaaaagatatggaagccccatatactgaaaaccacaaaacactgctgaaagaaatacctaagtaaatgaagatatataccatgtttgtaattcgaaaatttcaacactgtcaagatgttgattctgcccaaatcacaattccaaccatattcccaccaggcacttttatagaaattaggcttttgattctaaaagcctatgaaatataaaagtatatgaaatatgaaagtatatgaaaattcaaaagacctagaacggccaaaacaatcttaaaaaagaacaaagttgaaggagttaatgtcaggcctctgagcccaagctaaactatcatatcccctgtgacctgcacctatacatcaagatggcctgaagtaactaaagaatcacaaaagaagtgaaaatagcctgtttctgccttaactgatgacattaccttgtgaaattccttctcctggctcatcctggctcaaaagctcccccactgagcaccttgtgaccccgacccctgcccaccaaagaacaaccccctttaactgtaattttcctttacccacccaaatcctataaaatggccccaccctttctccctttgctgactctctttttggactcagcccacctgcacccaggtgattaaaaagctttattgctcacacaaagcctgtttggtggtctcttcacagacgtgagtgaaatttggtgccgtgactcggatcggcggacctcccttgggagatcaatcccctgtcctcctgctctttgctctgtgagaaaggtccacctacgacctctggtcctctgaccaaccagcccaagcaacatctcaccaattttaaattgggtaagcggcctctttttactctcttctccaacctctctcactatccctcaatctctttctcctttcaatcttcgcgccacacttcaatctctcccttctcttaatttcagttcctttccttttctggtagagacaaaggagacatgttttatccgtggacccaaaactccagcaccagtcatagactcaggaagacagtcttcccttggtgtttaatcacgcggggacacctacctgattattcacccacatttcattggtgtcttatcaccgcggggacgcctgcctttgtcattcacccacattcccttggtggcaagtcaattgcagggacacctgctttggctgctcacccaccccttctccactttcctggggggcaagcaccccttaccccttctctctgtgtccccaccccttctccactttcctggggggcaagcaccccttaccccttctctctgtgtccccaccccttctccactttcctggggggcaagcaccccctcaccccttctctgtgtctctaccctctcttttctctccactttcctggggggcaagcacccccaccccttttctccatgtctctaccctctcttttctctggacttgcctccttcactataggcaaccttccaccctccattcctccttcttctcccttagcctgtgttctcaagaacttaaaacctcttcaactcacacctgacctaaaacctaaatgccttattttcttctgcaatattttcttctgcaatgccacttaaccccaatacaaactcgataacggctctaaatggccagaaaacggcattttcgatttctccatcctataagacctaaataattcttgttgtaaaataggcaaacggtctgaggtgcctgacgtccaggcattcttttacacatcggtccatccctagtctctgttccccaatgcaactcgtcccaaatcttccttctttccctcccgcctgtcccttcagtcccaaccccaagcgtctctgagtcttttgaatcttccttttctactgacccatctgacctctcccctcctccccaggctgcttttctggtagagacataggaaacgtgttttatccgtggacccaaaactccagcgctggtcatggacttgggaagacagtcccaagtctttccattttttcctcagcctccgccccgccaccctacaatccttttatcacctccccctcctcacacctggtccagcttacagtttcgttctgcgactggccctcccccacctgcccagcaatttcctcttaaaaaggtggctggagctaaaggcatagtaaaggttaatgctcctttttctttatcggacctctcccaaatcagttagcgtttaggctctttttcatcaaatatgaaaaacccagcccagttcatggcccatttagcagcaacccttaagactctttacagccctagaccctgaagggtcagaaggccatctcattctaattatgcattttaacacccagtcagctcctgacattaaataaaactcctaaaattaaattccggccctcaaaccccacaacaggacttaattaacctctccttcaaggtgtacaataataaagtagaggcagccaagtagcaatgtatttctgagttgcaattccttgcctccactgtgagaaaaaccccagccacatctccagcacacaagaactccaaacacctgaactgcagctgccaggggttcctccagaacctcctcccccaggaacttgcttcaggtgccggaaatctggccactgggcgaaggaatgcctgaagcccgggattcctcctaagccttgtcccatctgtgcgggaccccactggaaatccaactcgcccagcagccactcccagagcccctggaactccggcccaaggctctctgactgactccttcccagatcttctcagcttcgtggctaaagactgatgctgcccgatcaccacagaagcctcctggaccatcacagatgctttaggtaactcttaaagtggagggtaagtccatccccttcttaatcaatacagaggctaccaactccacattaccttcttttcaagggcctgtttcctttgcctccataactgttgtgggtattgaagaccacgcttctaaaacctcttacactccccaactctggtgccaacttggacaatactcttttaagcactcctttttagttatccccacctgcccagctccctgaataggtcaaaacattttaactaaattatttgcttccctgactattcctgggctacagccacacctcattgttgccttttcccccagttcaaagcctccttcacacatcctccccttgtatctccccaccttaaaccgtagtatagtatacctctactccctccttggcaaccgatcatgcacctcttaccatcccattaaaacctagtcacccttaccccacttaatgccaatatcccatcccacagcacgctttaaaaggattaaagcctgttatcactcacctgttacagcatggacttttaaagcctataaactctccttacaattcccccattttacctgtccaaaaaccagacaagtcttacaggttagttcaggatctgcatcttatcaaccaaattgttttgcctatctaccccgtggtgccaaacccatatactctcctatcctcaatacctcccctccacaacccattattctgttctggatctcaaacatgctttctttactagtcctttgcacccttcatcccagcctctcttcgctttcacttggactgaccctaacacccatcaggctcagcaaattacctgggctgtactgccacaaggcttcacagacagcccccatcacctcagtcaagccagtgttcttacacaagagctgggaccgcgccctgtagcctttttatccaaacaatttgaccttactgttttagcctagccctcctgtctgcatgtggcggctaccgctgccttaatactttcagaggctttcaaaatcacaaactatgctcaactcactctctacagttctcataacttccaaaatctattttctttctcacacctgatgcatatactttctgcccaccccactacctctcagcaagccaaactcattgccttaacttgagccctcactcttccaaaaggactacacatcaatatttatactgactctaaatatgccttccatatcctgcaccaccatgctgttatataggcaaaaaaaaaaaaaaattcctcactatgcaagggtcctccatcactaatacctctttaataaaaactcttctcaaagccgctttacttctgaaggaagctggggtcattcactgcaagggccatcaaaaggcatcagatcccattgctcaggacaacgcttatgctgataaggtagctaaaaaagcagccatcaaaaagtatcagatcccatcgcccaggacaatgcttatgctaatagggcaactaaaaaaagcagccagcgttccaacttctatctcacagagcagtttttctccttctcatctggccactcccacctactcccccactgaaacttccacctatcaatctcttcccacacaaggcaagggtttttggaccaaggaaaatatatccttccagcctcacaggcccactctattctgtcgtcttttaatacctgtttttctcctcttattctgtttagtttttcaattcatacaaaaccatatccaggccatcaccaataattctatacgacaaatgctccttcaaacaaccccacaatatcacctcttaccacaaaatcttccttcagcttaatctctcccactctaggttcccatgccgctcctaatcccgccctgagaaacatcgcccattatctatccataccagccccaaaaattttcgctaccccaacactttaccactatttcgttttatttttcttattaatataagactacaggaatgttaggcctctgagcccaagctaagccatcatatgccctgtgacctgcacatatatatccggatggcctgaagtaactgaagaatcacaaaagaagtgaaaatagcctgttcctgccttaactgatgacattaccttgtgaaattccttctcctggctcatcctggctcgaaagctcccccaatgaacaccttgtgacccccaccaaagaacaacccgctttgactaattttcctttacctacccaaatcctataaaatggccccacccctttctccctttgctgactcttttcggactcagaccgcctgcacccaggtgattaaaaagctttattgctcacacaaagcctgttccgtggtctcttcacagggacatgagtgaaatttaaactatctgacttcaaggcttcttacagagctacaataatcaggagagtactgtgctggcctaaagacaaacaaacagatcaagagaacagaatacaaagtccagaaacagactcacacatatacagttaaatgattttcaggggaggcatcaaagcaattcaatggggaattgcttttcaacaaatagtgctggatcagttggatatccaatacagaacaatgatgaacttcaaccccatctcacaccatgaataaaaaataatttgagattgatcatagatctgaacctaaagccaaaactataaaacttctagaaataaatacagcatatctttgcacagagtgtaggcaagatgcaagaaaagcatttgatgaaattcaacctaaggaagatgcaagaagtaccaccccctcatggtgttagaataacactggtagaatcaatatgaaatcatattgttaatagttgttaatatatgtgtgtatacatagatgttgctagggtatgaacgtgtccccaaaattctcatgttgaaacttaatcacgccctggtgtcctggctcaagcctgtaatcctagcactctgggaggccaaggcaggagaattgtttgagctcaggaatacaaaactagcctggacaacacagtgaggcttcatctctactacaaataaaaattaaaaaaaaaaaaaaaaaactagccaggcatggtggcaagcaccttaaagcatcccagcttaaaagtcccagctacgcacgaagctaaggtgggaagatcactggagctcaggaagtcaaggctacagtgagctacaattgcaccactgcactccagcctgggtgataaagtgagactctgtctctaaacaaaaagagaaaagaaaaaaaaaaaaaaaagaaacttaattgccaatgctaatattaagacttgaggactttatgaggtgattaaatcatgagggcagagacttcatgaatgggattagggactcatcaaagagccagagggtgaaataagccaggcacagaaagagaaacatcacatgttctcacttatttgtgggatctaaaaatcaaaacaattgtactaatgaacatagacagtagaaggatggttactggaggctgggaagttaatggggggctgtggggaaggtggggatggttaatgggcacaaaaaaaaaattgaaaggatgaataagactcactatttgatagaacaacaggatgactacagtcaatagtaacaattatacattttaaaataagagtgtaattggattgcttgtaacacaaaggataaatgcatgaggggatgtataccctatttgccgcgatatgattatttcacattgcatgcctgtatcaaaatatctcatgcacctcacaaatatatatatacctactatgtgcccacaaaaattaaaaattaaaaatattatttaaaaaagggctggaggagctagtcagcccttttgcccttccacttttccatcacacgaagatacagcaagaaggccctcaccagagaatgaatgctggtgccttgaacttcccagctgctagaaccataagaaatcaatttccactgtttataaattacccagtctcaggtattttgttatagcagcataacgaactaagatatataaatttaaaataagtatctgtaatcctaccactttaaggaggccaaagcagaggactgcctgtggctaggagttaagaccagcctggagaatacagcaagatcccatctctactaaaaattttaaaaatagctgggcatggtggcccatgtctgtagtcctagctacttgggaaaccaaggtagggggatttgcttgagcccaggagttcgaggttacagtgagctatgatcataccactgcattccagcctaggagacagagtgagaccctgtctctaaaaaaattgtttaataaaaaattaaaatatggatatacatatatctatttacacacaaacaaacatatcctagctgtggccactgagtaggcctagaaataatgacacatcagtcacaataagcacatcatatatccagatcttgatttccaaataccattttttcctcactaatagtaacaatactcctcgaagaaaagctgatttgaggggtgggccatacaaaatgagcccagatcatcttgttgcaccagaaagtaaataggtactcaaagaattctggagacatatgaaaacacagaagccagtttgaaagagtttacacagaccaaatttgggatgattttagtatcaagataataacagtaatgagttacagaccactaaataagaatatgtatatgaatcattcaaataaataattgaacaaataaataaatgggatgtggagggaggagggaaaggtcttccttacagtagaatgccaatcaatagctacagaaggaagcatgcagttggaaagtcatcactggacgctaaaactagtgggtgaaagtttgatgaggaacaggatattaacacattgtcaacaaatattaacttcaaagagaaaaacagtatcatggcagtagagaaatctggcagataccaactaaaccaactgtttgatgttatcagcaatattagaacaaactgacatcaggttgctcctaatatgctgcactgagaaaaataaaaatcacttttttgttatccttgcataaaatgcatgaactgaatctaaccatgaggaaatttcagacaagtaaaaagtgagggacattctaaaaaaataactgatctgtactcttccaaaagatcaatgtcaagaatgacaatgaaaggttaacaaagtactccagattaaaggagactaaagaaatatgataatttcatggcgattcaggactggatactggacatggaaaacaaaagggcaataaaggacattatagggacaactgttgaaactgcactatgaattagataacaacaccgtaccaattgttaaatttcttgactgctaattttactgtggttatgcaagagaataccctggctcttagaaatacatgttgaagtattcttaggacttatacaacttaaactcaaatgaatcacaaaaaatacattcacatatatgcataaaaagaaagggggaaagagtgataaagctaatgaggtaaaatacaaacaactggtgaatcttagtaaattatatgtagtaattctctatattctttgtgtattttttctgtaagttacacataaagcaaaagacataactagaaaactaggtaagctttttttttttacaaaaatgacagacaaaaagtcactacctttcatatataaacaagctatataaagcaaatttcttttaaaaagcactataacccctccaaaagattaacaggaaaaggacatgtacagccaactgcacaaaagaagctaatgaagttttaaaggaaagcaaaaacaaaaagtcaatgaaagatgagatgttttccacctgttaaatcggtaattttctttttagaaaacatcaacattggcaaggatgtcctaaaatggccactcaacaccttgctagtggaagcattaattagaatcttttaggaaagcagttcagcaatatgaatcaagagccttaaaaatatccacaccaggccaggcgtggtggctcacgcctataatcccagcactttgggaggcagaggtgggtggattacctgagatcaggagttcgagaccagcctggccaacatggtgaaaccctgtctctactaaaaatacaaaagttagccggacgtggtggcgggcattgtaatcccagctactcgggaggctgagacaggagaattgcttgaactcgggaggcggaggttgcagtgagccgagatcataccactgcactccagcctgaaagactccgtctccaaaaaaaaaaaaaaaaaaaaaaaaaaaatccacagtattctacttcatgacactatctgaaagaaataatctaaactgtggactaaaatttatgctgaagatattcatcaaatgataactataatagcaaaattcttaaaataatccacattaaacaatagcgaaatcattacgtaaacaacttaggatataaccacaaaacgcaatatgcagtcattagaagttatttaaaatcaggaaatatgacataataaatgttaagagaataaagtttacaaaatgggcagttaggatgatcttaagtaaaaaaaaaaattcataaagctcagaacagacatattataaacagtgactgtttgaaaatgaaaataagtagggaatatgaacacctgtcccagtctccagtttatgagatctcacccctcaccatctgtgaactaccaccgcttacatgatggtgcctgtctcactccctgtgcactccaagtatttcttgaggccatggcaccatacctggctgcattcagtaaacatttgctgcttcaaatttacaaactctcccacctcatttcatatatgtaaaaaatgtatctagctatttaagtcacctgaaaactgaaactatattgaatatgaagttcgtcaagaaccagtttcacttttctttgcttctttcaaataaaaacattaaggaggaaacatgcttggagctttcgttaacaacagactccaaggcaggcttgagacaatataaagataccacatacctgattagtattgtgcgctaggaccaccggtggtattgtcagtttattttcatgtcaaagatcatttgctttagcagtctaatcttagctaccacaaaaaaacacacccatctgtgtgctgccagagcttagcccctacccagggccacacctgactccagctctgccctattccccactgattccaccttctacttggcaactttctgcctaattagctaagcagagcacagtcaggtaagaggaggctgtgagcaaggctgggaacacggagaaaccagacaagagtaggaagaccttaaccatggcagaggaccagctgagcggtattcgtaagtctgtggttctcaacaggggcagtttatcaccccaggggattttgccagtgtcttggagatatttttagttgccacaattgtggtggtgctaatggcacctagtaggaagaggccagggatgctactgaacatcctacaatacacagaacagttccccacaacaaagaattatccaaccccaactgtcagcagagctaaggtcaagaaatcctaccacagactgatgcatccactaatacagtggagtctactgcacagtacaattcagcaggaacaagacacccagtggttagaggagacctgaggtagttcaggaaatgtaaacacacacattacctcctcactcagatgctaaggtgatcaaaattctacctcaagaattgggaatgagggcattgtaattaattaattaatcaaataaaactagtaagaatgcttttttccccaagggcttgctcctataaatatcttatatttcttcaaagactgcttcacagcagaaactgtaagaagataatactatcaaaattgcccagactggtaaacatctccagaaaacttggcaacacacccacataatcaatgacaaatttaatttagctgtgtatctcaacaggcccttcctactaggtgccattagcacccccacagttgtggcaactaaaaactcaaactcaaagttcccagcttagtttacggggaaagtgtcaagctttcaaagatcactcaaaaagaagaaaagggctgctttcccagatgaatcatcaagaactacacaagacttaaaggagtaacattttcaaaactgagaacagtacttaggcacttcaaccaaaaaaaaaaaaaaagcagattttcaaaaaagtatatgaatcatcattattataatttggttaaagtaatgaccaatgagtcacgccacaatatgttttttaaaattattttaacaaccttatcatgccataatgtccacctatgggaggccaaaaggttagagaagccatccagtactatccctggctggctgggacttaaataacttcaacctgtctctaaagcatcattttgcctatctaccttgacctctgtcctttcagtgttaggaaatacccaccacttaaggtggcccccttcaatgttggacaggaattaactgttaggagtgtgtccattatgctgaatccagagcacctcccgttcaactacagctattagttttgaatcacatgaaaccagcctaattattctctatacagcagcccttcaagtttccatattatcttgtctttctcatccaagcctttttcttctccaagttgtaaaatgcactccccccacaagctgttacagttagctatttaagtgatacaattaagattaaacaggagaccaaaaaaaccagaatggcagaactgaaaggaatcagagaccagccagttcaaacccaatcccatttttataaatgagtaaacaaggcagagagaggtgaggcaaggctgcttgccagaggtcaagctattcagaaaagtcaggagcagaattcaagtttcctaactctttcgcccctcagaactgtatcaagttgtacagatgttgtgtgaaaggattgacagtttttgttttataaaaatataaatactgagagaaaagatgatccatctaccaagaatctgtattaaaaagtgatgcaggtgaaaaaaactaggtaacttaacttaaaaaatacataagaaaggaaatgtagtcatagactactacctggctttgcagatgaatagttaagttgtcactaactaaatatttcttattgatttcactaaaaatacggatgtaaccacagtcagagagtgggaaatggtaaatgaggagtttaagatgtccaaatcctcacctatcaaactgggaaggcaatgcataatatttaaagtggataaacaaataacagtggaataaaatgtttagaaatattaaaaataggtattataacaagaatagagtttgcctctatttttcattgcaagactttatgctcgctatttttaaacaatgtccaagtattattttgataaaaatttcaacattaattttaagatacagaaaaataagggatcggtaatagataatgttgtaggcaagtgaataggggaaagaacaccaaaacaccattagtgggagtacagactgaaataaaaacgggacaaccaattgccactatccaatttaaatctcctttgaccaggcaattccacttctagggctctagactaagaatacacccataaatgttcaaagatatatatatgagaatgatcactgtgacaccattttaaaagatacaaatcagagcacactaaatatcaactaacaggggaagggctgaataattcatgaatatatgtacccatatattcttcacactcatcccacaaatatttattgattgctaggtactaagtatagaatagtaaataaaactcaacctgcaaaggaatactacatcattattaaaagaatgcggatctgtatgtattgatctaggtgaaaaagcatatttcaaaatatagtatgtagtatgatgctacttttattaaaatacccagtataactagatgagactttttctttatgtacttacagtatttgacttttttagcattgtgacattacctgtgtagctcttttaaagacaataaagacatatgcttgtcagattggataaaagcagtaacaaaagaaagcaaaaaagaatggagggaaggtgatggcacgcgcctgcaatcccagctactccggaggctgaggcagagaattgcttaaacctggaggggcggaggttgcagtgagccaagatcgtgccactgcactccagcctgggtgacagagcgagacttcatttccaaaaaaaaaaaaaaaaaaaaaggaggaaaggaaagaatctactttttgtaagtctatatagtaaaacagggaagatgcacatgatttccacttctagattctaccaacatatatacaatcatatatatatatatatatatatatatatatatatatatatatcaagaaattctctcacacattcacaagaactaagaaacaatctaaattttcatcaatgaaagaatgaacaaattgtgatctattcatacaataaaacaccatacagtagttattaaaactcaaaccacaaaagcacaaatctgagggaaaatctcacatgttagagaatacatacagaataaaattatttatgtaaaactttttaaaaagcaacaaaataaaactatctttacttatggataaatatggacccacagattatggacccacagattaaaaacaccatgagataccacttctcagcctaaatatctgacaatattaagtgacaatattaaggacatggaacaagaactccaatgtctgctaaggtaaatgcatactggtaccaccactatggaaaacaacattatatacagtggtagtcagaaatctaaagatagtcctccaagattcctgcccctggttattcaaacactaatttgagtatagctgtgaaaggaccacggagataaaatagagtaatctagattatcccagtggacccaatcaaatcatatgagcccttaaaagcagagaatggtctccatctagagaaggaaaaaaatatgagtcagagagattcaaagcatgagagagattcaacctcctattgccggctttgaagatgaagaaagaaagaggatcacaaggcaagaaatgtatggcctgtagaagctgagaacgaccatcagctaacatccagcaaggacacatggacctcagtcctacaaccatatgaactgaattctaccaacaacccaaataagtgtgggagttgatttatctccagagcctccagaaaagaatgcagtcctactgacaacttgatttcagcctcctaagacccagagcagataacccagccaagcctactgcatttctgacctataggaccatgagattttaaaatgtgtgttgttttaagcctctaagtttgtggtaattagttacacagcaacagaaaactactacttctagaaaagttgaagaaatgcattatcctacaacccagcagctatacacctgaccatacacaaagagaaactcttgcccaagagcataaaaagacatgcacaatgttcacatcaccactgctcatgatagaaaaaaaatggacaatccagtcattcatcagtactacaaaggacaaattgtggaatattcataatgtaacacaataagacaaggagacaccaatgaactacggccatacaaaaatatgaatgagtctcaaatctcatacggaataaaaaagcaaatgaaagaagtttacccacaatacaattctagtcataaagttcaacagcatgcagggcaaaacaacacagcttagagatacaaatgtggtaaaactatagcaatgaaataataaaaacaaaattcagggtagcagttatgtctctgggaacataacagaatgggatcagagaagagagatgaagggcatcaaaagtaatgtagattgttcctaactggtgattacagaataacagcacttacattctatacataatttataaatattgtaatatctattcaatatttgaaaaatgaaaacatctagataatcaaacttctacataacaaaaaaaacttcttttctttggcaaagatgtgttcattgaaaggaataattcaaatgatataaagagtccaatcatttttttaatcacctaaaattctcaccacctggacataattagtaacaatttgcttaacatccttctagacatttcctatgagtatacatacatttaaatattttacataaaatctcagtatatatacacataggtatatgttcagtctgtaaatgctttttagaccctttttaaaaacaactctattaagacataatttacataaaataaaatgcacccatcttaagcataatgtgaagttctgacaaaagtgtataaaaagtgtatacgtagtataaccaccacccaatcaaaatacagagtaattccatcaccacagaaagttctcttttgctcctctgcagtcattccccacccctacctataacctcaggcaaccactaatctgctctcttaatgttttggtggttctagaattacacatcaatcaaatcatacagaatgtagtgttttgtctggcttcttttgctcagcataatgtttttaatttcatatagtgacactgtgcaattcactccttttttctcctaatatcccattgcagacttgttgaaagattatactctttccggtgttaagcactgagtacaagtcatttgtgaatttaaggttttattttacacccaggggtgtaaatgtctaggtcatacagtaagtgcatgtttaagttaataggaaactgtcaaacagttttccaaagtgcctgtacattcctatcagcaatttatgtaaaattctgattgctctacatcctcaccaacacttggtattgttagtctttttcattttgacccttcttgtaggcaaaaagttgctcataatttcctttaataaatatattgggaatttttagtatgtctactagaatttcaaataccttattttgtgaagttgctccacaaattttttttttaccgattttgcaatttgagttctctagcttcttcttaatttactgaagttctttatatatgctggataaaagtcctctgtcagatacataaattgccaacatttgctcccagtctatagtatactgtttcttttccttaacatctcctaaagtgcatacgttttaattttattaagtccaatttaacatttttaaaatgttgtagttagtgctttttgtaccacatataagactaaatgctttctccctcaaattgacaacaggacatggacatctgctctcaccacttctatcataatattggacttgaggtcctcatcagtgtcataaggcaagaaaaagaaatagaaagcacatgagtggaaaggaagacgtaaaactgtctttattcaatgactgtatgtggagaaaatccaaccaaaagactaccagaactagtaagtggattcagaaaggctacaagacacaaagacaatatacaaaaatcagctgtatttttacacattagcaaggaatacttgagaaatgattttttaatcctatttacaatgacattaaaaatgtaagatattaagatataaattcaacaaaatatgcataggacctgtacactgcaaaactaaaaaacatgttgcaagaaattaaagaactaaataaatggagagctataccatgttcatgtattgaaaggttcgatgacattaaaatagcaattctccacaaactgatctatagaaccaagacaatcccaattgaaaccacaagttgttttcttttttaaaaaacctaacaagctgattttaaaatacttttgaaaacacaaaggacctataatacccagaaaatttttgaaaataaggaacaaagttggaggatttacactaaccaatttcaaacctcatataaagttatagataaagataatatggtaccgacataagaacagacagcaaaagcaacaggagagagtccaaaagcagatccacacatacatcaccagttgactttcaacaaaaatgccaagagaactcaatgggcaaaggatagagaaaggggaagaaactcaatagggaaagaattaccttttcaacaaatgatattaaaaaatgtatattagaccagctagcttgagcccaaggcctcctcggacaaaaaataaaattaaaattaaaaaactgtgtattcataaaggaaagtaaagaacctagacccatagctcataccaaacaccctatcaacccctaaaaattgatcatgaaccttaatagtggagctataaaacctctagaacataggagaaaattcagtaggctttttttcacacaatatttcagctatccttacatgctaataaatatattttttcattttgtcaaaagtaaaaaaaaaaaaagaaaatccttacaaactgtgaaaacatgtcttcatttcttaaatgaaatttcgaaacactttccttatccatacagtcatacaacatttcttcaactgaagaacagaaatattcaaaggaaaagaacaaaaatctttttaacctcctttcatatagttcctacaagaacgggttggcttctatgagacggtagttttgccttgatgattcttttttgagtgcctttgctgaagtcataaataaataaatctcccaacatattaataccacttatgttttaaatataaaagttaccagaaaaccataccaatatgtgaaatgttatgtactgctatattgtcttaaaattgcctgttttggttgataaagacttgtattatacagagattacacattttttcaaactgtaataaaagaaattttagccattttaagtataatttatccccaataattggcaggatatctcaataaatgtatcattgactattggttatgaattgtggttaacaaaataatgaataaaagaatccattataggccgggtgcagtggctcatgcctgtaatcccagcactttgggaggccaaggtgggtggatcacgaggtcaagagatcgagaccatcctggctaacacagtgaaaccccgtctctactaaaaatacaaaaaattagcctggcatggtggcaggtgcctgtagttccagctactcaggaggctgaggcagggagactggcatgaacatgggaggtggagcttgcagtgagccaagatcacgccactgcactccagcctgggtgacagagcaagactacgtttcaaaaaaaaaaaaaaaaaaaaaagaatccatattataatttagtaatttaatcaccatagttttccagaaaactaaaatttaaaaaatacacattgcaacactgctgcttatgagtgtttactgttgcacacaagttaacccaaaactcagtagtttaaaacaatggacatttattacctcatagttaccataggccagaaatctaggcacagcttagctgggtacttctgggtcaaagtctatcatggggttgcagtcaagctgctggccaagctgtgggatcctctgaaggcctccatgtattaaaaggatatggttcccatctcagtcacatggctataagcaagtctcagtccctaccacctaggattctccaggaggcatacaacatggcatctttgttaaaaaaaatttccttctttccactaatagcttttttgcaggtgtgcaattcaatagtttttagcaaatgcacagaactgtacaaccatcaccacaatcaattttagaatattttatcaccccaaaaagaaacctagtcctctttagctgtcaaacccccatttttccccaccccctaccccaacaccagttctaggcaaccagtaatctactatctaattctatatttgtattctggacattccatataaatgtaatcacacaatgtgttgccttttgtgactgtttcttttatcacttagaatgttttcaaggttcatccatttgtagcatgagtcagtacttcattcctttttattcctgaataatagtccactgcatggatagaccacattatttaaaccattcatcagttgatatatgtttgagttgtttcaactttttggctattatggctaccgctactgtgaacatgtacatacaaatattggcataaatatatgttttcatttctcttgggtatatacctaggagtggaactgctttatcatcccttatcccaaatctagccatttcaagaactgccagactgtttctcaaagcagttgctccagtttacattccaacatgtagattccaatttctccacaacatcaccaacacttattattacctgtcttttttattatacatagccatcttagtttactaagatggtcacttagacagtcacttagtaaccgtcttagttacttcgttggtgtaacatggtatttcactgtggttttgatttccatttacatggtagctaatgatgtaaaacatcttttcatgtgcttactggctatttgtatgtcttatctgaagaactgcctattcaaatcctttgtcgatttttttgagttccttttctttttatgactgaggtataagagttccttaaatactctggatacttactctggatactagacctttaatagatacatggttttctcataccaaacactggggagcatgtagacaggataaaaacaggaactctcccactgcttgtaggacaataaaaccgtacagctacattggaaagcaatttgtatctagtagttactggtgtacgcacctgacaaacaacaactccaatcctagatgtatattccagagaaattcttacctttgaagaaaaacatggatgaaacttagtaactaatttaaaaagttgcaggaaaaaaagtccacatagcatgatgccatttatataaagtttaaaaatatgcataagcaaacaatattttggggggatatacatatacaacgtaaaataacattatcaagaaagcaggccaggcgcagtggcttatacctgcaatcccagcactttggaaggctaaggcaggcagatcacttgaggtcaggagtctaagactgtcaggcctgagcccaagctaagccaacatatcccctgtgacctgcacttatacatccagatggcctgaagcaactgaagatccacaaaagaagtgaaaatagtcttaactgatgacgttccaccattgtgattggtttctgccccaccctaactgataaacgtactttgtaatctcccccacccttaagaaggttctttgtaattctccccacccttgagaatgtactttgtgagttccaccccttgcccgcaaaacattgctcctaactccaccaccttataggtgttgagaaacctataagaactaatgataatccaccaccctttgctgactctcttttcggactcagtctgcctgcacccaggtgaaacagacagccttgctgctcccacaaagcctgtttggtggtctcttcacatggacgcctgagacacagaccagtctggccaacatggtgaaagcctgtctctacaaaaatacaaaaattagtagggcatggtggcgtgtgcccatagtcctagctacttgggaggttgaggcaggagaattgcttcaacccaggaggcagagttgcagtgagccaagatggtgccactgcactccatccagcctgagtgacagagcaaaactctgtctcaaaaaaaaaaaagcagcagcagcagcaagcaaagaaatgacagacacagaattcagcatgctggttacctttgagaggaaggaagaagtacacaggaggtctcaatgctattggtaatattctacttttttcaatacatactcttatatgcgtgacacatttaataaacattttttcaaagagcttcactgacaactgaaggtctttctaatacagaaagacaccagagcagttcaaagtaaatataaaggagatgagagcatcacagtgaaccaaacaccacacatacacaatattgtaaagtattttaaatccagcaaagtgtatgctttgtagaactgagaagacagattccttgcccttatccacttctttccaccgttctgtccacctctgtcttcctgatcccacctctacttccatgtccagaatccacttctacctcctccagagattttcttccatatatcaatctgaagggcacccatccttcctctcaatttccatagcatttgtacctcttcaaagccttcatcatattatcctcagattacacgttttaactcctctatcagaaattagcacctggagaactagaacaccagtcacatcatcaacctggctctccaaacacaccaaattttttgttgactattgatttaaaaaatgaattagaaaattcaggcatttccaagtgagttaagaaattggtctggacaagaaagaaagaaagagtttaaaattacactccttgaaaaagaatttcaaaattgaaaacccttcaatacagcaaagacaaagctgacaacagtcagataaaatataaaatgtttatagtgtatacagtgataatttttcatattcacagggaacaaaattagaagccataagaataacttcctgattacttggcatcagaacagtccacggctttagaaaatgtcttgcagtcaaccacaaacctagggaacaggtagggttgtaaagtgtcttttacgggggggaaaaagcacataccatttcaaggctcgaaaaaatgaggttacttttagaaatttcagcaatatttttaacttgctttcagatattttaaactacttaccaccagaagtataaacctaaacattatgtgattatagcagaaatggaactactacataagggaaaaagaaacaaaccacaagtgaatcaacgacaaccctcaagaaccagacgctactactgacaaccattagggtttcttggctgcttgaatcaattcattcccagctctgctttgagctggcactaatttaaaggagacaaaaatgttggagctaaggctgccagatttaggaaatataaatacagcaagcccagttacactttaatttcagacaaacaacgaatcttttttttagtacaagtatgctcccacgtaatatttatagtaaaaatttattttaaaaattttacaaaaattcactgtttatctgaaattcatatcaactaggcatcctgtattttatctggcaaacctagctggagccaaaaggtagaatagtaatcaatccaatttcctcatttttcagcagaaactgagaaccaaagaaaggaactgacttgcttaagcttaagccaaagatcagggaagtaagttggttttgaaaagagaaaacctttccactaggtcaccttgggtaccacttacagtacattccacttccaattcttgctcaactcacagaagcaccaagcagacaaggtgtaaaagagtatggtttccctcttgtaacattaaacttcaagtttcagtacatctcttaaaaccctagtctccaaaatcaattaggaaactatgtgctactcttaaaaaaaaaaaacctgataattttgtctacacactaccacctcatactgtttatattttcactcaccatatgaaacaggacatccttctctcctgaactcagttctctcaaaatccaaaattctcttgctccagggtctcaagatttcacacaagagcatgttcacattatttcatgactctcaacgacttgagttcgtatactccttcagttttcatgctttttagcgttttcatgtttttcagatatgtcctaacccattcggttggcctcaaaagtctcccattcccattctgtatcggagcaactaaatcagcaatgaggaatgaagtctcactattataaacatacacttacttccccagggactgggatgcaaggaaacatggaaagagaaacgtctttatcagaaattttggggccaaaaaggccccgaagtatggtatgtgagggttatgctagctgtctaattacatagcatgcaatcgaacaaaataaagagaaaaataacagaaaactccacacatgcaaagaattcattttccagatcccatcaaattaaaaaatacacaaaacatttcctcaactccatacagagctcctcaacctatgacttgcaggggtcctcaagggtagttagcgtggggatgggtggtgagaatagtgatagtgaggcagaaaagggttccatttttatttatttatttttacaatttgggcttccaaataggttttaagaaaaaaaggttttgttgcattaaagaaacatgaaaacggtaacataaaccattataacccccacccaataagttttctattaaaaacttcacccaggtggacaggaatacgaatcgtttaagatgaaaacagatttaaagaccaaagaaaagttagcaattaaaggacaaaatagttacctatgctttccttctggcaccccgaatgtacgcaggtctctcgagatcacacgtcagacgtggaaggtcctcacggatcactagtccgagcttccattttacagatgtgcacactcaggccaaagacgacggctgacgggccaacgtctcacagccggtcagggaaaggaattcacctggcacccggggcggccggcctagagccctgggcgctgaccgtttctgcgattcctggttccgctcggcccggccccaggggcagacgcgagcaccggggcagagagacccactgcctggagtcgcgctgcctctccgcgggctccacgccgggcccgcagcgcagggatgggtccttggcggccgcccccacccagcccagcccagcccagcccagcccagcccacctgtagccgacgcgctgccggcagccacaccccctgcccgggccgggggctcggccgcccttattggcggccagcggcggcggctgcgcgcggcgtgggggactccgatcctagaggccgcaggagttacctcaggtgggctctgagctggcggcgctaccgccctggcccgcctcgagcatgcccgagacgtggacgcagcaaggccgcacctcccccagcgcgtcgcctgtttacaccctacgcccctccgcgggaggacaccgagtggcaggtcacgtgacgcgggcgtcacgtgtccggccgagttgggtggaggcgttgccccggcgactgcagcgcgctgggggcgggctgcagcgggtgccgccgcgcggcctttctgtgcttccaccccttcgcagtgcccaggcgacaacccactgggcttggaaccgaaaagacttccccagctctgtgtgtgtcgtttagtgtctcctggccctgactacatgttattaatattagtgttttggaaggaaaaggaaattttgtctggcaaaaggatgttttacttggagaagaagatggaaaatactttcttacctgaggctatcaaacgggaggaaaagcgaaggaataagtaataacggtttttgccttgacagatttttgtttgctttcgctccctaatctggactgaaagattcccacagcatagcctctcagccagagaaagcacgtgaaggaggtttatacgacttcttacttttaagttgtattttaatttttatgggggaatcatctctgtgtacatacagacgtctaaatatttgattctgcattcatctcttttttttttttttgagacggagtctcactctgtagcccaggctggagtgcagtggtacgatctcggctcactgcaagctccacctcctgggttcacgccattctcctgcctcagcctccccagtagctgggactacaggcgcccgccaccacgcccggctatttttttgtgtttttagtagagacgaggtttcaccgtgttagccaggatggtctcaatctcctgacctcgtgatccgcctgcctctgcctgccaaagtgctgggaatacaggcatgagccactgcaccgggccagactctgcattcatcttttgtccacataaaactctcattattcctctgtcactttcatcactgtctaccaaatccaattttcctacatcaaacttcccagaaatagtttcaaccactgccagttttatttctcccataatcatgcataaaagatgaataatttgtatttcttagtaaattcatgagtgaattataagcaaatcctctcaaatattccatagttgttctgttgtcccggagtgatctatcatatagctaatcaattcctccctacaattctgaccactttgaatttttggctaagtaaaaagcagattgtcaggttcaaaacagtgtgctcaagatatcctctggatcagcaaggtcaaaacatctccatttctataacacacttacaatacagtattacaaagagcagaaaaatgatgaattttctccatttgtcttttactgtggaaaataggttatcaaggccagttgccacaacctggttggctctactgcttctggcagcaggtgttccatgaaggtagtaccaatatcttccattggtatagcttatgcctagaccaggcttgttgagccaaagggttggctgactgatgaatggatatggaatcctgtcatccttctacaggaagcggcagaaccttcgtagttcaacagggatctgtgagctatgcagggctgataagcagcactcatggagacaaagctagggtgagtcctggcgcaaccattactgtctaggcaatttccttaacctttccgagcctctcttcagctttctgaaagatatctactgaatagagtggttatgagacaaaatgaggtaatgcctgtataacacttttaagtgcccaatacatacagtgttgggtaaatgttaaccaatatggtctttggcgacggggtattagtataggaggtcagagtcctgagggaaagggagctgacaacttgaacgtgtccaggtcctgggtccagattcttgccacctggagtgtagttcaagaagggattgccagccaggcgtggtggctcacgtctgtaatactagcactttgggaggccgaggcaggcagatcacctgagctcaggagttcaagaccggcctggccaacgtggcctagccaacatgaaacctcctctctactaaaaatacaaaaattagccaggcatggtggcgggtatctgtaatcccagctactcgggaggctgagacaggataatcacttgaacctaggaggcagatgctgcagtgagccaagatcatgccactgcactccagcctaggtgacagagtgagactccatctccaaaaaaaaaaaaggggggggcggattgccagcaaggaaacaaagcacaattgggaagaaactgttgcactcagaatgtaaggcagccagtaagggaattgctcatagggcaccaggtgctcactccaagaggcatactggccttgtggcaacagcttaattccaaatcctccctgcttgtgttaatggggactcctaatacactgcctttcctttgccttagcccacatagggaaattacctaccctctcctacagtttgtgggacatgaagacataagaaagaattcaggcttgagccaagtgatcagtgttatctccagaaccagtcacactgactccctaccaaatggttaaatacatcaacccatcaaccatgttctagttttgttgttgttgttgttgttgttgtttgagacgagttttgcttgtgttgccaaggctggagagcaatgatgcgatctcagctcactgcaacctccacctatctggttcaagcaattctcccatctcagcctcctgagtagctgggattacaggcgcctgccaccacacccagctaatttttggtatgtttagtagagacagggtttcaccatgttggccaggctggtctcgaactcctgacctcaggtgacccgcccgcctcggcctctcaaagtgctggtgtgcccggggttggttccttctggtgggttcttggtctcactgacttcaagaatgaagccacggacctctgcagtgagtgttacagctcttaaaggtggcacggacccaaagagcgagcagcagcaaaatttattgtaaagagcaaaagaacaaagcttccacagtgtggaaagggagtcgagcaggttgcttctgctggctggggtggccaacttttattcccttatttgtccctgcccacatcctgatgattggtccatcttacagagcactgattggtccattttacagagtgcttattggtgcatttacaatcctttagctagacacagaaaagttctccaagtctccacttgacccaggaagtccagctggcttcacctctcactgggattacaggtgtgagccacgacgcccaaccatgttctagttctttaaagagtttcattgcaaaaaataaaatgtgttggccaggcgcagttgctcacgcctgtaatcccagcactttgggaggccgaggtgggcagaacacaaggtcaggagatcgagaccatcctggctaacaaggtgaaaccccatctctactaaaaatacacaaaattagccaggcgtggtagcgggcacctgtagtcccagctactcgggaggctgaggcaggagaatggcgtgaacctgggaggcagagcttgcagtgagccgagatcgcgccactgcactccagcctgggcgacagactgaaactccatctcgaaataaaataaaataaaatgtgttatgtatgacaaaatatatggcaaatgtacagtgcatggctctataatgccacccaatctaatacaacagatatgctagtgttcccactagaatagatgaatgtaaggactaatggggagcttgcaaacaaaggaagaaactagcaataacctagtaaagtgttgcaaagctatgtggtagagccaacattgaattcacgtttcctggtcccaaatctaaatgccttttcctttttttttgttgttgttgttgttgttgccttgatataatactttttcctttttattaataaccttaataaagatatagtttcaccagactcgagttcaccagactggaattcagaggagagatatagagatataaattgaagattaggcagtggtattcaaaaagccacatgattggatgagatcacacagagaattattttcatatctttgacctcaacccaaaatacaaaatacattttacatattaaccaaatacatgtatataatttaaaagtttccagaaacaaatttaccattcctacgtgtgatgcacgatttcttctgtttaaatttttcactccgaactcaattgatttttttaacccagtaacagttgtggcctacagtttgaaaatcattgaaagtcaccgatctaggacgttcataagtccgaattgcataattgcagcaaaagaagagactgaaaggctagacatctggtactgtagagataagaaggaaatttagaagaagcaatcagagttaagaggagaactggaacagaggagtcctgatcaagtgaagaaatgtttcaggagacaagtgcctaaaggtgtcatttgcactgagaggctgagtcagttgaggattgacctctgaactgtcagtgtagagatcactgagaccttgggaacagagcaattaagataaagtggtaggattaaaagcctgattcttgagataacagatggtgacgacaagtaaatacaatcattgctttcttgctgtaaaggagagcagggaaataggatcatagtaggtaagagatgcaggattgaggttttctgtttaaatatttatatgctaatacaaatgctgtaataactggatgtacaagaaagtgacaactgtaagaaggaaaatcttgagtagattggaggagtcatccttagataaggaaaaaacaagagaaggggaatagcaggccacagatacagatagcttggtagattcgttgttgaacatgaaactgacccaatagtcccatagacagttcttttggccaaacatagaaagtgacccttcttttcttaaagctcgaaacttacatttgttttatctgagttcctttctcgggaaggacccctggcctctgaaaaagtatcaaataattgaaacttaccagattaccacattcagacaatgagatgccagacccttccttttgtttccttaccgctccctagttcgtgttttctaacacactgttacacttcttccccgctatataaaccccaaattttagtcagggagatggatttgagactgacctcccatctccttggctgcaacacctgattaaagtcttcttcctcagcagtgagcaccaagacttagacagaatccccgatgtttctgtatcatgtggaatttctcttcgattgttgatagtttaataaaataaaagctgagcatgacaagagggagagaggtgctggtggtttgagaaaggagagcatgtgactatcatccaggagctgctacagcccagcccagccctaggatctcccacgtggatgactgctgtatatttctctcaacttccatccttgcctccttacagtcttttttttcctacacaatcgccaaagtgacttttcaaaaccatgtcaaccccagtattttcccaattcagaataaaatccagaagtgtttggctctaagtcctgcatgatctagcccctatttcccatcgtcctctcacttgctttgctctagccacctgacttccttgctgttccttagtctcctcaagagtagaacatttccttccatttctgagaggtgacagcgtgcgccctcgctcgctctcggcgcctcctcgaccttggcgcccactctggcggcgcttgaggagcccttcagcccaccactgcactgtgggaccccctttctgggctggccaaggccggagccggcaccttcagcttgcagggaggtgtggaggaggcgtgagcaggaaccggggctgcgcgcggcgcttgcgggccagctggagttcccggtgggagtgggcttggcggaccggcactgggagcggcctgccggccctgccgccccgggcaatgaggggcttagcacccaggccagcggctgcggagggtgtgctgggtcccccagcagtgccggcccaccggcgctgcactccatttctcgccgggccttagctgcctccctgcagggcagggctctggacctgcagccagccatgcctgagcctccccctcctccgtgggctcctgtgcggccagagcctctccgaccagcgccgccccctgctccagggcacccagtcccatcgaccacccaagggctgagcagtgcgggcgcacggcgcgggactggcaggcagctccacctgcagccctggtgtgggatccactgggtgatgccagctgggcttctgagtctggtggggacgtggagaacctttatgtctagctcagggattgtaaatacaccaatcggcactctgtatctagctcaaggtttgtaaacacaccaatcagcaccctgtgtctagctcagggtttgtgaatgcaccaatggacactctgtatctagctaatctggtggggaggtggagaacttttgtgtctagctcagggattgtaaacgcaacaatcagtgccctgtcaaaacagaccacttggctctaccaatcagcaggatgtgggtggggccagataagagagtaaaagcaggttgcctgagccagcagtggcaacccccttgggttaccttccacactgtggaaactttgttatttcgctctttgcagtaaatcttgctgctgttcactctttgggtccacactgcctttatgagctgtaacactcaccatgaaggtctgcagcttcactcctgaagccagcgagaccacaaacccaccgggaggaatgaacagctgcagacgcgcggccttaagagctgtaacactcaccaggaaggtccgcagcttcactcctaagccagcgagaccaggaaccccaccagaaggaaaaaactccgaacacatctgaacatcagaaggaacaaactccggacacgctgcctttgagaactgtgacactcaccgtgagggtccgcggcttcattcctgaagtcagtgagaccaagaacccaccaattccggacatgtttcctcacttcctttatagcttatttaaatgtgactttctcgaggttgtctttgaccatcctttgtgaaacagcactcctatcaatgtcaccttcccctgcttggtttttgttattagcacttattgccatctctggcagagatttatagcacattaaatatccatttgctaccagctcctttcatataacccttgcaattaggtcaggccctataaacaatgggctgtgagcaaaaaggggcatatacacatctaggcaaaagcaccaaatgcaaccctccagctctgtcttcccctgctgcagtgatctagaccacatgttgcagtggtgaagccacagagtggacacagcctaaatcactgagtcactgcctgggtcagctgttctgggaagttgcctggctcagtgagttttccatggtggaaaaataaactttgttgtgttaaatcactgagcttttgggattgatttgttaccacagcataatgtattatctgatatggtctaaattgtgtccctccacccccaaaattcatatgttgaagtcctaactcccagatctcagaatgtgactgcattttgagatagggtccttaaagaggaggttaaaaaaggagattagagtgggccctaatccaatatgacagatgtcctcataagaagaggtgattaggtcgggtgcggtggcttacacctgtaattccagcactttgagaggccaaggtgggcagatgaggtcaggagttcgagactagcctaaccaatgtggtgaaaccccatctctatcaaaaatacaaaaattagccaggagtggtggtgcacacctgtaatcccagctactcaggaggctgaggcaggagaatcgcttgaacctgggaggtggaggttgcagtgagccaagatagcaccactgcactccagtctgggtgacagagcgaggctccatctcaaaaaaaaaaaaaagaacaggcgattaggacacagacacacacagaggaaagaccgtgagagcacacaaggagaagatggccatctgcaaggcaaggaggtgtcagaagagctggtttctgaccaaaaatgtgagaaaattaatttgtccctgaagccgctcagtctgtgatactttgttatggcagccctacaaatgaatgcagaatcctaacaccatctggcatatttgttttatttcctctagaatataaatgtgtgatgaaagcaaggatgtttagttcaacactgtatccacagtacttaattgagcctgacacctaccaaaggctcaattaatatctattaaattactgaatactgcattttaatgaaaaagttcaaagaaaatctttctgtggctctactcattttgctaactttctctaataaatttttagactcctctgcattgaactttattttcatttctaattttgctagtttgcttttctttcttaaggtaaggttgatgtgaatttggttgaaatatttcaggacaactgcaattttatacaattcccagtattcacttttttcctaatttccatttcctcctctattttggttttctgacatcttttctcaagttttagattatagtttttctttcttggtaacatggacatttctatattcaatcctttctggaataaagaatatagcactataaattttctggtaatgacagctttgatggtgctctcaaaaacttaataggtactactttaaaatgtagtataattgattctagaattctttgatctacatgtgaagatttttttagccattattgctatagattttaatgacagtattttgcaacacagtatttctaagaaggcaatgctgacttttatattttatatgaattttcctgcctccaaagtgaactttttataaagcaattatataaatgagaaaatgaaacccctactgtttgtcccattctctacaaaaatctaaaagccaccttgtttttctctgcagactcactctatctacaatgggtatcaaggcacttggtacctagtctattccacttctttctgcaggtatcttttcttaaaagttttttttaataaactattcttagaacaagtttagatttactgaaaatttgcaaaggtagttcccatacatctcacacccactctcccctatgaacatcttacgttactatggtatatttgttacaattaatgagccaataatgagacattatttaaagtccatgctttcttcagattccctcagccttcccttttctgtttcaggaccccatccagggtacgacatgacatttgtcagtatgtccccgtactcttggttgtgacagtttctcatactttcctcttttcaataaccttgacagtgttgagaagtactggtcaggtattgtgtagaatgagcctcaatggacagtgtctaatgttttcctcatggttacactggggttgtgggttttgagaggaagactactaaagtgtcattctcaccacatggtatcaagtgaacacactagcaacatgatttatgcctgctgatgttgaccttcactacttggctgaggagtttgtcaggtctctccactataaagttactcttttctccatttccagactgtactacttggaagaaagtcattatgcatagcccacacctaagacttgaggcgtttgctcctcctcctccttgggagtggagtatctacagaattcttttgtgtggagaatacggcccttctcccttatttattaatctatttatttatatcagtgtagaatcatggatatttattttatactgagttataagccaatactactgtattttgttgctcaaattgttttagatttggccatcgagaatgctttcatttggttcctgtgtccccctggcataccccatagttcttgtaagtttttgatatcttggggtttttcagtacttccttactttttggcactttaagacatacttttggctgggcatggtggctcacgcctgtaatcccaacactttggaaggccaaggcgggcagatcacctgaggtcaggagttcgagaccagcctggccagcatgatgaaaccccgtctctactaaaaatacaaaaaattagccgggcgtggtggtgtgcgcctgtaatcccagctgctcgggaggctgaggcaggagaattgcttgaacccaggaggtggaggttgcagtgagcccagttcatgccattgcactccagcctggacaacaagagcgagactccatctcaaaaaaaaaaaaaaaaaaagacatatttcctgccccagttccacaatcaggcatctctccaaggaaccgtgtcccctctttagagaatggtattagaaagtaagacgtgggcagtacatgtgctcattgctgctagggtattgttgcgtctaggacccctcagctgatgtcacaatgaaatatattcacataataaaacatgatttacaagtacaaggaaatgagctaacagtaaaagattagcctactatttgtctatatctttctacttcaggtgtttcttataggcagcaaggtaccagattttattttttaatcctatctgtaattttttctttttattaaagactaaagtctatttgtatttattctatactttatcaacattttctccccttaaggtctttgttttataagtaattctattgacagatgttagctgtggtaaagtagaattgaatatcattaaatactaaacatatgattataattttaaaatactatatagacttaaaacctcaaccttattcttttttttctattctacgtgcataataaaatgtttcatttctttcttggacaaattggatatgagttttggggctgatttagtgttcctgcattctcttcattaggattttgttctttatattttctttctgtctcaacaaaccttaaatactcttttggaatcaaatcatcttctgtagcagatattgtagatcattagctcaatctttttttccaaacttgttctcccttgattgaaactgctataatggaaaggctacccttttaacagattctgatcaatgaagtataggctgaagtcactcagcagggcacccattcctaaatagagaataaagtttgactaggaaaaagtccttcagaatatacagttgtctcttggtatctgtcagctattggctccaggatcccctacagataccaaaatccacagatgcttaagtctcttatataaaatggtatagtatttgcacataacctacaaacatgctcctgtataatttaaatattctctagattacttataatacctcatacagcataagtgctatgtaaatagttgttatactgtgttgtttagggaataatgacaagaaaaaacttctgtatgtgttcagtacagatgcaaccatctatttttttcgaatattttcaatccttggttgaatccatgaacatggaacccatggatactgatatgatttggctctgtgtccccacccaaatctcatcttgtagctcccataattcccaagtgttgtgggaggtacccagtgggagataactgaatcatgggggcgggtctttcccttgctgttctcatgctaataaacaggtttcacaagatctggaagtttaaaaacggagttttggccgggcgtggtagctcacacctataatcccagcactttgggaggccgaggtgggcagatcacttgaggtcaggagtttgagaccagcctggccaacatggcaaaacctagtctctactaaaagtacaaaaaagttagccaggcattatggcgcatgcctgttgtcccagctactcgggaggctgaggtgggagaatcacttgaatcttggaggggaggttgcaatgagctgagattgtgccaccgcactccagcctgggtgacagagtaagactccatctcaataatagtaatactaataaatgaataaaaatgggcatttccctgcacaaactcttcttgtctgctgccatgtgagacatgcctttcaccttccatcatgattgtgaggcctccccagccacgtggaactgtaagtccaataaacctctttcttttgtaaattgcccagtcttgagtatgtctttatcagcagcgtgaaaatggactaatacagatatgaagggccaactatatgtattttttctcctagacctctcccccatcatctccttcaccactttcctagctaattttcattactctttcagaagtttcaacttcaggagtcctgtactaggtcaggtgcctgtgtttcatatttgcatagcttcgcatacttcccctttaaaatatttatcaaaattataattatataatgacacacttagttgtttaaagtctgcctatattgcaatgtaaactccacctaatttactactatattccaaacactaattacagtcccttgcacctgggaggcactccataaccatctgaatgaataaatttgcaaaagattacctaataaagcatagtgaccaagtacatataagttaagcaatacttccactcttatccttaggccccacccatgctaattggtcatattcttacttcctcgctatgtacaaaattctcaaacatttgagaaaaaccaacagtacaaaagaaagaaattgtgactgacaaagaatccaagagaatgaattggaaaaaattcaattaaaataaaaaattcaattaaaataaaaaatttctaggaataaggctgaataggttaattgagccactcctcaaactaaaaatgctggaaaaaaaaatttaaacgtatatatgcttaaagaatcaaagaactgggacaactctcaagaatcactgggataaaatctaagtgaaagcatgcatccaaagtggaacacagagcactgaaatcctgtgtcctatgtacatgtgacaaaccaagtagtgtgactttggttcccatggcttcccaaagccagggagacagaagtcaaagctgcatgtcacctaagggagaccctcttctccccaaaactgggatcccactctacctcccaacccccaagtctgcaaagaaggatactctgaggctggtagagagggaacctgaggagtggaggaggatatgagaaattataaacaaaagccagttcccaggggactagatgggggagggaaaagggggaagggggagggggaagggaaagggaaggaagggggaaaaagaaagaaaggaggagttaggtaagagtgtgtccttgttcagggaaaacacatactagaaatacatagagatggatgcgcatgaggtctgcctcttactctctcattcagaaaaaggctaatggtaattgctaaacatgtgctgacagagagtgcaaatatggtgaaatattaatagctggggaccaagaaagttctttttctgtacttataacttttctataaagttgaaagtatttcaacataaattataagaatactaaattaaaagtcaagtgattatgtgaagaatgtcttcaagaagaataattctcaatatactaattatatgattagtagccttaatagggacagtcttaatctgatgataagatccaggtatatttttccaatgacattaataaacaagaaaagtaatgggaaaacaaaaacccatgagcttcacaaaaaaaagaaattaaaaagcaaaataaactatggcataattttagacaaatgaaggaatttaaggggaatcagttttatctctatgtttagaaaatgaacctttgcctatcacaggtttagcgagcttggattacagaaaagatatcatactctcataattagatcttcagtaaatatttctaaaaatgtaatattttaactttattagtgtcagattttaagtcaacctaaaaaaaaggcagaaaaggctataatttaacagaacataatatgctttagggctaacatatactacttaaagtggatagatcactaaaaagactttgtacattcttttttttcttttttgagatggagtcttcgcacgatctcagctcactgcaacctccacctcctgggttcaagcgattctcctgcctcagcctcccgagtagctgggattacaggagcacaccaccacgcccagctaattttttgtatttttagtagagacgggggtttcatcatgctggccaggctggtctcgaactcctgaccttgtgatccacccacctcagcctcccaaagtgctgggattacaggcatgagccaccacgcccttttttttttttttttttttgagatggaatcccgctctgtaacccaggctggagggcagtggcatgatcttggctcactgcaatctccaactcccgggttcaagcgattctcctgcctcagcctcctgagtagctaggattacaggcacctgccaccacacctggctaatttttgtatttctagtagagatggtgtttcaccacgttggccaggctggtctcgaatgcctgacctcaggtgatctacccgcctctgcctcccagagtgctgagattacaggaatgagccaccaaacccagccgagacttagtacattcttaaaagctttttcattcattcaacaaatatttattgagggcttaagcacaatgcctggtgatggcttgggagcatggatggatagatgggcaggagagcaattcctgctttcatggacttgccatcttgtccaactcaaaggctcacacaattaaacctgttgtggatttcctttcagggaaagaaaatggtttcaagaggaaaggcactgacctagacaggaatatatcctggcaggcttccttcaggaagtaatgatggagtggacatctgaaagaagagtgggtgttaacaagagaaaacaggttggaaaagctaaaagaaagtgaatgtgggcaaatcccaggaagcctagggaaacagtgcaagatgaggctggagaagtaagagtgggctagacaacagaagccttactaggaagagaaaaggttaaagatttggctctgccatagactgaatgtttatgtcttcccaaaactcattgaattcattagggtgaaatctaattcccagtgtgatggtattttgaggtggggctttagggaagtgattaggtaacaagggtagagccttcattaatgggagtagagcccttataaaagagacccaggacggaggccccttgtgccttccaccatgtggacatgatgaaaatatggtcacctatcttcaagtaggccctcaccagacatcagatctgctagtgccttcatactggacttcccggtctccagaactgtaagaaatacatttctgttgtttttatagtattctgttatagcaggccaaacagttaacacagggtctattctaagaacagaggaagtcctgaaatatttcaaacactgatgtgctcaaagttttgtttctgtaagctcactctggctaagtgtagaaacaggttgtaaagggcatagaagtaattcagggagcctaggtagggacctattgcaatagctcaggtaaaagctatggtaacatggactagtctaactgcagtagaatagggaatttgaaataactgacttatggactgaatgtttgtcccccctcccacaaatttctatgttgaagccctaacccatgcatggctgtatttggagtaagaaagtaattaaggctaaagaggtcatgagagtagggccctaatctaataggactgatatctttataagaaagaacactgaagagcttgttgtctccccactgcccctcactctgctgcacatgtaccaaggaaaggccaggtgagaacacagcaaggacgctgccatttgcaagccaggaagagagcccttacccacaaagaaccctgctgaactttgatttgggacttctagaatccagaactgtgagaaaacaaatttctgttgtttaagccacccagtcgtcccttggtatccatgggggatttgttctaagatcccctgtagaacccaaaatccatggatgctcaagtctcttatataaaatggcatagtatttccacataacctatgcccatcctcttgtaattacactgccttatttagagaatgagagggaaaaaaagtctgtacatgttcaacatagatgcaaatatccttttttaacggaaatatttttatccccagttggttgaatctatggatgtggaacccttagatatggaggaccaactatactttgttgtggcagcctgaagataaatacagattttggtaccaaaaagtggtatttctgtaacaaatacctaaaaatgtggaagtggctttggaactgggtaatggtgagaggctggaggagttttaacatgcatgctaaaaaaaaagtctatagtgtcctgaaggactgttgatagctatggtccaacagatgattgaattaaaggtaactcttataagggctcagaaagaaaagaggagagccagagagaaagcctccatattcttacagaatacatatatcatcatcaacagaatgttcgtgggcatgatggactttaaaggcccgtctggtgaagtcttaggtagaaatgcagaacaggttaatagaaacaaaggagattcttgttataaaatagaaagaaataaatagttgtgttctagtgttttgtggaaggcagaaattgtgagcaatgaaactggatctaaatttagctaaggagatttctaagcaaagtattgaaggagcaacttggtttctctaccacttaaaatgcaaggagataaagcgaaggaattttaagcaaaaagaaactagaacttgaagatatagaaaattctcaagcctatccacattgcgaagaaatgagaaagcttgtttggaagagaacattaaaggtgtggttgaacaaccatttgataacattagtgtgggtgtgaactacagatttaatcagccacctgagcagaagccaagaatagagatgggattgtaccagcagagatactgtcagccaggactaaaggggacaggaaaaatcagaatggaatgaaagaaggctgtaggacttctcagattctacagaaacagacaacagagctatctggctgtgagcatgagctacccttttaaaaagtgaagaatggccccaaaagtgattcaaatactgtccgtgaaccacagcctgccattctcaccacaggcctaagaggcagggctagttcctcctccatttcaaagggtggggctttttcactcaggggaggccaggatcccactgcccaatgcctcagggacaaggctgaggcccagtgccataagggtgacagtgcaagtgggcctggagggcatagcatcaaaccaaaaagaataattctagagccttaagacctaatgggatttgccttgccaggtttggggacttgcttgggacttgtcatcctttttttctttcttgtttctcctttctgagatggcatgtctttcctatgcccgtcccatcattgtgttttggaagagcatattgtctggtttcacaggttcacagctggagaggaattttgcctcagaatgaatggtaccaaaagtctcggccatacctgatttatgcttacattaggctttggattttagactttagagttgatacttaaacaagttaagacttttagtgtggttgggatggaagagaatatatctacatgtgacaagaacacagattttggcaggccacggacagtatgttacagattgaacgcatgtgccccccacttcaaaattcccactttgaagccctaacccctagtgtggctgtatttggagtaagacagtaattaagattaaattaagtaataagggtggggccctgatctgacaagactagtgtccttagaagaagagacaccagatagcactcatgctcttctcccacccacaacccactttgtgtgtacacattgaacaaaggccatgtgaggacaaagcaagaaggcagctgtctacaagccaggaagagagccctcaccagaaactgaccctgttggaccttgatctgagacttctagcttatagaactgtgagaaaaatttctgtaggttatggtactttgttatggcagcctgaaaagactaatacactgacaaaaattaggaagtattgaggtaatgtgttgttaagctaattcctcacttttaatagtagagtagaataaaataacgtctaaaatatactggctagtgttatgatggtaacaactagaaaaactaaaattaattattagaagaaattggaggggggtgtctatgataaaattttactttttaacccttagtttttctaaagctatgtatattagtttcatcaaccatttcaaaagtttaacttaattttcaaagaaaacttaaaatatcatgccttcattccttaaatttcattgttttatttttatgatttttgctatattaatccttgccaattttaaaccaacatttttaacctaaatcaatttattttacattattttcaacttaagctgcttatacttacattttccaatacattaaaatatataattattacaaatgttcacccatgtaatacctaaaattatctcacgttccaggagtggtagacggcttacactttgaaaaacatgactagatgcaaaatttgagtattcgtcttgatggcttaaaaacatattaaacataggctggatacggtggctcatgcctgtaatcccagcactttgggagcctgagacgggtggatcacggggtcaagagactgagaccatcctggccaacatggtgagaccctgtctctactaaaaatataaaaattagctgggcgtggtggtgcgcacctgtagtcctagctactcaggaggctggggcaggagaatcacttgaaccggaggcagaggttgcagtgagctgagatcatgccactgtactccagcctggcaacagagtgagactccatctaaaaaaaaagaaaaaaaaaagaaaaatcacattaaacatatatgagaaaatgaattcctgtcttttaaaaaataattgtctccacaagttacacgtacactgataggattttaaggacacctgagtatttggatttccctttttagaatgattacattaaatataacctgaaaatattccacatagccaaaagttaaaaatttaaaacttttagtgctgttaaaactaaatgctgttttaaaaaaatccagaaactgaacttcgttacataaaatgggcttagctaaataaaacaatataaatgccttttttaaaaaagcatgggccaggtgcagtggctcatggctgtaatcccagcgctttgggaggccaaggtgggcagatcacttgaggttaggagttcaagactggcctggctaacatggtgaaacctcttctctactaaaaatacaaaaattagccaggcatggtggtgggcacctgtaatcccagctactcgggaggctgtggcaggagaatcacatgaacccaggaggtagaggttgcagtgagccaagatcgcaccactgcacccagcctgggtgacacagcaagactctatgtcaaaaaaaaaaaaaaatcacggttaagttgtccaatgcatcaatttattcaactaatgtttaaccagtacctacaggcaatctactctgctaattactggaaatgcaaagacagatacaatgtctctaaaatttggaatgtgtctgtgtaagaatttaaagcataaagaaatgcccctcaatataatgatataacttgttgaattaaaatagttcagctgtcagttattgaaaactagtaaaaagacttaactttcaccacaatctttagtaaaacttagaatgagacttacttctacttatagtcttggtttaaaaagcatagcacactacatcaagtaggccctaggcattcatatttgtttgcagaataaatatgctatggtccatttctcagcagtctaactctgtaaggcagttcttatattttaagtgtctaaaacacgtgtcttcttgatacaggaggaaatactgaattattcataacacagatgaaagtatttttcatctacttatatccacccttcttaaaaagcatgccttcaacccccatttgcatagctcctctgctaacttttagccattccctcttatgaatgtactgccctctttgtctgaaggcatctgtctccatcaacatttcatttcttacaggagcaggggcagtgagctctccagttcattcagccttaagtagaggaaggggcccctcacagctcctaagttagccttctggtactcttagcagagtctggtactcttagcagagtctgctaccccagggctgcagagtctacctgggttaggtgctagttgtttaccagggttcagcatcagtctgaactgagcttctatacagcaagtggccactaagtgccttagtggtttctggttacacctggggaacagggtccttaatatcctaaaagaatatttttatactgatagttattttatccacgtaaaataaatcactcatttaattaaatagttttataaaagaaaaattatttataaaagaaaaactattataaataaataatgaaattcataatgaaattgaatatttatttgaatttctcctggtaatagcactcaacaaataagaaaaaccgagctgtgagattttgttttaaatgtagccatatttcaaaaggtaaaaagttggcttctatatttaatggcaagtgggacatcttctattttaaaattaacattcaaaaagtagtaaaatatacactatcatgaacacgatgtgttttatagaatggattcatgtccgaatactaatctgaatgtggaagaaatgtattatctgttaaaaaccacactggaaaaatgttcttttttataaaaagtagcttgaagtaaaaaggaacttgctaataaagccagtaaactttcacacgtgggatttttaaaaaatctccacccatcccacctctgaaaaaaaaagaaggagaagaataaaagaaagaaaaagaaaaaacccatatggtcaatctgagtagagccattcattacatgactgctcattctgtacaatgtggaagcctggttatttaggaaatatttcgtttcctaaagtgcatcttttgaagatttgcctagtaaaactgcaatatcatatacaaaacacttaacacaagacatgcaataacaaagctaaatcattccagtgtaaagttgttaaaactacttttaaaacttttgtttcaccaagaaataaagatgtaaaatacagtagcattcttgttctccaacagtatgcattgtatgcttttgttatttggcaaatcttttagagtcgaacaaaaataatagtctaaacaacatttcttctgtcattataatacgaatcccgggcagaacagtaagatgtagaggaagagttagatttttggaagctttggtgcattaaccacaggatttgcctcgtgcaagtatctcctccctgcactcttgtaatcataggtacagccatgagtttctgcataacgatgagatgcacagaagttgtttccacatctaaagcacaaaaaaagtttacgtgaatagttgtatttctatgaaaggctcatctgtctgggagacaggagcttgacttcaggtagtccaacaggggccctttggttctttttagcaatttcactgctgacatttcccttccattcgtaaacaagcataaatacccccaaaaagaacaagttaattatctacgaatatgacaatttatgataaagaagtcattattgactgaaacagggtagaccaggggcggtggctcaagcctgtaatcccagcactttgggaagccgaggcgggtggatctccaggccatccaggccaacatgatgaaaacccatctctattaaaaatacaaaaattagctgggtgtggtggcgtgcatctatagtccagctactcgggaggctgaggcaggagaatcgcttgaacccaggaggtggaggttgcagtgagccaagatcgtgccactgcactccagcctggtgacagagcgagacacaatctcaaaaagaaaaaagaaaaaaaaaaaagaatgaaacagggtatagaactctatcagtagtaaaactgcaaaaagctgataaatatgcccatcgtttctcttatacctagtaaacctaaaagaattctgaatttctgaggaattcagtctcatgataaaattaaaatagtaaaacctaactatgccatgaaaggatttttaaaaatatttctagtagcaaaataggttgttttcattcgaaccgaatacactctaaaaagcagggattgggatgggtgtggtggcggctcacacctgaaattccagcactttgggaggcaaaggtgagaagatcacttgaggccaggagtttgagaccagcctaggcaatatagtgagatctgtctctacaaaaaatttaaaaaattaaccaggcatgatggcacatgcctatagtcctcactattagggaggctgaggcagggggatcgcttgagcccaagacatcaaggctccagtgagttatgattacagtactgaaaaaaaaaaaaaaaaaaaaaagtccgcagcagcagttattttaattcaagcctagccccaatctaagggcagacatccaagataatatgacataacatccttggaggatatcaatcaatactaatgaaataaataattacagtaagaaaaaggtcatacttttttggaaatatattattcatctattttatattaacttttaattttttaattaaatttttaatagaatattcagggaggggttcttccaaggtgccactcaaacaaaatccaagcaggttcatcataagacgaaaaaggtacactctcagattggtttaaacctcctaacttaaaggacaaggaaggatctgtttttgtcttttggaaacccatgagctatctacttgttctttacttcagccaattagaagttcaactgaagatagctattgaacatcatcttaatgatgttataaacaggcaatttaaatattttattttgcataatccccaagctgggttatcacagagaaagcatctgagcttctccagctcgccaacctgcctgcattcgtagctactagccagtcctgttttctttccacaaagaaaacaatgatttgttgttttcttctttgtctgaagaggggctttcacaggtgggaggtgatgagtagtacattctcctgtttagagaaaggacaccttgattaacacaggcataaaatcctaaacatgaaatattattaagcaaaacacaaaacatagtcctatcaaagtaaatatctatgccataaaaattaatttgtgctatttttatatctaaaattacttataaaatctacaggtcaagttgcagtggaactatttcttttaagatgtggtaggtttctactgattagcacttatatttttagaactttttatacacaccactttcctcattatttctaatggtaatcagtttatataaagtacaccaaattttgacagagaataaagaaaaatgtctgcttcaaaatcatatttgatgaagcctctgagaacatgattgcaatataaatattctgtttgttcacaccaaaaagaagtaccagaatatcatgaaacatgccttttagtcctattacaccactgacagttcatcaaaccatgagcaagtcatttattctttcaaaacttcaatatgtttatttttaacataatagaacatgtatttttctctctaggttaataagcactttaaggtcaactcaatccatatatgtaaaaagcactctgaaagttttaagcatgttataattacataaaatgtcatattaataatagtaactaacagtacacagctcaatttcacagtactactagttttccaaaaatatttactgaattctgtattactgtatcaacttgagtttttaccttaaaaataagagcacatctgttattatataagaaagaattaaatcaattttttttttttttgagacattttgctctgtcgcccaggctgtagtgcagtggcgcaatctcggctcactgcaagctctgtgtcttgggttcaagtggttcttctgcctcagcctcccgagtagctgggactatgggcacgcaccaccacgctcagcttttttttttgtatttttagtagagacggggtttcaccatcttggtcagtctggtctggtcttgaactcctgacctcatgatccgcccatctcaacctcccaaagtgctgggattacaggtgtgagccaccacgccaggccaaatcaatttctttaattactaagttaaatgtcttttagaactgatcaaaatgccaacaaaccccagtcataagcagagaggctcaaagttcctgcccatagttgataaagtaacagtacaaatacacatgtgcttggtgtcacacaaaggctaagaagcaagaggcaaagaaagaatgcaagaacaagtggaaggagtgaggaaaaactggtagtgtcaatggtgctgggaccttttctccactactgaaaaaggtttaggaggcctaagcttggtatttagttggcagctaaaagtctgaaatttcttaaagggttcaaaaaattggatttacaattaattggttctatgtctttttttttttgtcacaacagagattaggtaatttgtacacaagcccagcaaaattaaatcttctttattaccagtataaaatacacttccagatcttgccaaaactagaaacaaaatttgaaacaattgagagactcctaatggtgcctgggtaccaactcagttaataaacgttttctttctcaagtgcacttagagataccaagaacatctcacaaaggtgagggagtaattccattatttaaagtatttttaaaaagatatttacttgcacttgcacaagacaccaaagaaaggcatatattacaagatgtccaatgaatgttaatctactcgaaaccatctttaaaattcaggcttaggatattcttccttaaacaatggtggaagaatctctgatgataatttaattcactgtagtcacattttcattttttttcttttcttaggggatgcttaacttgatattctccatactttttttcatttaagaactcttgtgaggctgggcgcggtggctcacatctgtaatcctagcactttgggaggccaaggtgggcgaatcaactgaggtcagttcaagaccagtcaggccaacatggtaaaactccgtctctactaaaaatacataaattagctgggcatggtagcacgcgcctgtagtcccagctactcaggaggctgaagcagaagaatcacttcaacccgcgaggaagaggttgcagtgagccgagatcgtgccactgcacttcagcctaatcaggtaacagggcgagactctgtctaaaaaaaaagaactcttgcgaatgtgtagagacagagaatacattagtgacagtaatgaggtagcacaaaaatataagtgcagtactctatgagagcagcctccatacatccttctaccaatagagaaaactattagcaactactgtgtactaggaaccatcaataaacatattgattccccactataaacaggaaaaatctaaattccttggactggcatttaaggtattattatgtccaatataatgcctttctaactatccagagacactgtaatttaccatgtcatacctaccccgaaggatgtaccaagtccttccacatctgcaatctcttctaaagtaaactctaccttgtcaacccagtagaatttgacttatcctgtaagacatcatcaattatcaactcctctctgaagccttctctcaaatgtgtactgaacagatgaataaagaaaaaaacccataaaatcatattgatggtaagagttgcttttcacaacaagatgaaaggtacttgaggtaattcacttgcttgccatttcctagtctcatattttatctaacatctaacaggatctacaaaaactgacccaacagaaaggcagcaaaaagtaataaatcagtgttccagacgcaaggctggtagtcgtctgcctaaaatcaatggctaaatctataataatgaatacagtttccaagggaaaccttatagtgaaaagaacagaggaccaatggaggaatttaggaagtcaattaaatgaaacttgcatcaaaatgtatatagactcttctagataattcagaatgatagttattacagtgagagaaaaatggaagcaagttacacagctctactgcagctagcagctgatacttcaaatctaaatgaaatcaaacaaaaaagcatatatctggggacaagcagagggctggttaaaaaaaaaaaaaaaaggacagaagaaaactgaggttaaggccaggcgcagtggctcacacctgtaatcccagcactttgggaggctgaggtgggcggatcccgacgtcaggagatcgagaccatcctggctaacacagtgaaaccccgtttctactaaaaatacaaaaaattagccgggtgtggtggcgggcacctgtagtcccagctgctcgggaggctgaggcaggagaatggcgtgaacctgggaggtggagcttgcagtgagccgagatcgtgccaccgcactccagcctgggagacagagtgagactccacctcacaaaaaacaaacaaacaaacaaacaaaaactgaggttaaaaaaagattaaaacaaaagtaaaaatttataacaatgtgatagcctagaattttttttaaaaaaaactatttcaagaatgaaggacacaaaaatcaaataagataaagatatggaggcatccaatggatttgaaattatggagattgtcagtgaccacggcaatagcagtttcagaagagcagtgagacgtgaaccagcactgaagactgaactagagctgagtgagtagggatgggtgcaatgcaaatttccaagaagatcagttgtgcgttagggcaggacagagttatgtgtcaacgaaaaacaacaactataacattaaaagtcaataaattacagtaataaaaacgatgtgatactggcataaaacagacacatagaccaatgagtagacagtccagaaacaaatcctcgtatacatgatcaaatgactttcaacacgggtgccaagaccattcaatgaggaaggacagtgtttcaacaaaagttaataagaaaatgggatgttcacatgcaaaagaatgaagtggaacccttactttacactctattttaactcaaaatggatcaaagacctaaacataagacctaaaactataaaacttctagaagaaaagataggggaaaagcttcatggtattggatttggtggtgatttcttggatatgacaccaaaggcacaggtaacaaaaggagaaaatagacaaactggatttcctaatgtgtcaggcatcggatttcctaatgtgtcaggcattctggactttccagtgatgccactgagatagcacctgtcaaaagagcagtggttccatttctagattgtggatcttcagataaattctgccattttcatttcacttcctgaaagtcagggttggcttgtgaaaagttgttaaacaacatgctaaatgtgaaatgtcaaccctcactctaaactttccccgttcagaacatcagatacttcattgggttttatagtggctttctgatttttggtagtccgttgaagacgggagtttgaaagttgttgtatactgttaacgactgtctgtccatgtactgcctgaaataccatgattgtttatggaaagtatctttaataaagctggatacagtttggtttcggggaaaaaaaaaacatgaaaagacatttctccaaagaagatctacaaatggccaataagcacatgaaactactcattaggaaatcaacttcactaattagggaatcaataatcagtaacactaatcgtcacagatacgcaaatcaaaaccacagtgacatcacctcacacccattaggatggctactagcaaaaacataggaaaataacaagtgttgccaaggatgtggagaaattggaatccttttgcactgtcgatggaatgaaacatggtacagcaactgtggaaaacaatatgacggttcctcaaaaaattaaaaatagaaataccttctgatcccgcaatttcatttctgggtatatattctaaagaattgaaagtagtgtctcaaagacatatatgtgcacccatgttcacagcaccattattcacaatagctaaaacatggaaacaatacaactgtctattaacagatgaatggataagcaaaatatggtgtgtgtgtatgtgtatattgtgtgtgtgtgtacacacacacgcacaatacagtatcagccccaaaaagaaaataatttctgatatatgctactacatgggtaaactttgaggacattctgataagtgaaataagccagtcataaaaagacaaatactgtttgattccacttacataggtacttagagtacctaaaaaatcattgaattaggaaatgaaatggtggttgccagggtggtgggagggggaagagtgtttcagttttgtaagatgaaaagtgttctagagaaaggtggtggtgatggatccccaacaatgtgaaagtcactgaactttatacttaaaaatggttatgacagtaaaatttatgttatgtttattttaccacagtacaaaataattgaaaaaatgtgcaaatagattatgattttataaccttgggccttacataggaatgaaaaacaaaccctaaatgtcttcaataaaaacataaaacccacatgacaaccataacaaataaggtatcttttaaaaccttgaggctacaaaggtggcacatctttggtaacgagtttcccatccctggtctgggtattaaaacatttaaaaagatggcttccttcctccttgaaaataatgactggccggtgcatctttaatgtgttaccatactggtagaaagaagtgctaatgtcatggtcacttccactaataggccttggaaagggctggccctacagactgtccctttcttttatccagaaatgactagttcatcaaaaagagattcttaccaccacctctgatgtttggccatgatgttgaaagacatctttctagggtaattcttcaaaacccacatggctctagagtggccagcaactaaggtggttgggaactacatgttcattcttcaataatcttgtgggtttttttgacatagataacacctcttccaagataatatatttcaatttcaatttttgttttattctttatatatgtcctacagtccgttctcataattattcttaattggaaaaagcatttagagacagaatttactctgtacatgccacagagaaggttcttcccatttctctttgaaaattcaaccggatgcataattatgtaattatcagccttgtattgttttcaaaattatctgtagcttacctacgcttttccctgctgctgcattatttccattcattccaacaccatgggtagactacaattaaaacacaaaacatctatagaggtgagtcaatgaagaatagaaatgatcaacaaacatgaaatacttgtattttatcactaagatgctgttggactttcattttaaattatttattccaatttttgtttaattaaattaactcagaacctgattccacatctagcaatatcgtgcttattatttatctttaagagggtagaatttgccgggtgctgtgactcatgcctgtaatcccagcactttaggaagctgaggtgagaggattgcttgagcctgggacgtcgtggctgcagcgagctgtgattgcaccactgtgttccaggagtttgagagcagcctgggcaacatggtgaaaccccatctctacaaagaatataaaagttagccaggcatggtggcatgtgcctgtagtcccagggactcaagagactgaggcgggaggattgcttgagccctggaggtcaaggctgcagtgaaccatgattatgccactgtgctccagcctgggtgacagagtgagaccctgtctcaaaaaaaaaaaaaaggccgggcgcaatggctcacacctgtaatcccagcactttgggaggcccaggcgggtggatcacgaggtcaggagatcgagaccatcctggctaacacggtgaaaccccatctctactaaaaatacaaaaaaaattagccaggcgtggtggtaggtgcctgtagtcccagctacttgggagcctgaggcaggagaatggcgtgaacccgggaggcagagcttgcagtgagccgagatagcgccattgcactccagcctgggtgaaagagcgagactccgtctcaaaaaaaaaaaaaaaaaaaaagggagagagagagtgaaatttgatgactcaaataaaaagttcttacttgggatggaaaaaaacattaaaaacatttagcatttaaaaatacatatttttaatacgtatttgaaaatatgggtgtattggcatgttcctatattcccagctactcaggaggctaaggcaggaggattgcttgagcccaggagtttgaggagtacaacatatacatacatatctgataaactgtttacattaacttatgttcaaattactgttctcatttcaggactaaaacagcattcaaaattcgactatcaagattttatacaaactaaataaacattttcagataaatttatgaaaataatctaatcttagccttccttatttatgtaaacaaaaaccaaactttaaataagttgaatcactacaaggataactactagagcatgttgaaaggaaaatactgaccaaaaaaactcctgtatgttctaactggggagaacttttcctaaagttttcttcctgaaaatgctggaggtttgtagacagcccagttccagagttctgaagcctgcctgccccacgtgtgctctgtaatctatttctgcttgtgctcccggccagtgaggcaagaaaactgatattatttacacaaccaacaggctctttggaagccttgttagtcatttctgtgatatcccgagcctcaactttggaaataacatcagatcttttcccaagtgaatcaactttaacaccttgaaagcaagtagtcctagagaaagaagaatcagttatgttttgaacatccagtgactgagaagaagaaggctgtagcttcccaaactcaaaacatttggactgtctctctggtttcaccagagaattatgtagcgacattggtgcagaacagcgaagaggtgacaagagtctattcttgtgaggacttaattcccggtagttaagaactgaagtctctactgattccccattcagcactcctgcaacatgcttgagatgctgctctggagctttcaaccctttgtcagcattagtgagtagcaactccagattcactttgcacgcaccttctaagccgctgctctgttcatcagcatttccttctgcaaatgaagccagtgagcccactttaggtagaagtgattgttcggttacacattcttctgaaggtaagacaatgttcccattactagatggcaagtttcctaaaaaatgttttgtttgcctaggcagggatgatccaagatggagaacagagtcagcaagctcctggtcatttcccaactccaaatggggtatctgaggaggtagtttgacgttgctactgaagtgagacagtgtgttattctcccagctattatcttccttaagaaattcaccagtgatagaagatatgtatctctcagcagagagttgagttgccaaacttgaaattccattcctggagatttcgggcggatatgcattcccaaaagcaggtgaacaagattgaccaatgttggggaggacccttaacaatcggtggcgagatggtgcagtggaaccactagaaggtcgaggagctacaggtgggtgaggttttatcttgacagctttcttaggctaaaaggaatgaatatacagtttctttacacagtcgttttctctgcccattaacaaaaattagcgaaggaagaaaatgttacttaccataacatactagcatttttactatctcaatttaaaatgtttaagaagaataaaatcttaagattatgacagagaagatgctattttccttcactgagtatacttttctgggaatattaaagaaaaataattttgttttatttccttactgctgtttctcagagttttactacaaagaaaatgaactgattatattagatatgacattgctgacctattttagatctccaacaatttttcctactatgttgaataaatgtttcattggactggtacacagaaaaaaagttatcaatcctaaaaaaaaaaaaaaagttaaaagggctaaactgctatccttgaaaagacttgctggcaacactggcctttggctggcttttgggaacatctatttcaggaggttcaggagggttcccatgaacctaactgataagagtcgttcattgtgccaaactatttacgcaataatacagttcatgatgaacacttgctttccttttgggagtctgaaccgcaaatgctaggcagagggtgcctacaatgaagaggcccagtaaaatccctgggcacagagtctctaatgagcctccccggtaaacaacatttcacatatattgttacaactcactgatagaggactaagcacatctcatgagactccactgaaagaggactctaggaagcttgcacttggtttcctccagacgtggctctatgcaccttttacctttgctgattttgccttgtatctttttgctgtaataagtacaactatatacagcaacatactacagccctgtgaatcttcctagcaaaccatcacacctggggtggtcttggtgccctctggcatggtagattttttaaaaagtaccacaaaaattcaagatcttatgaataaagttgagaactaaacacaagaaatctagctcttaaaaataagcaaaaatggtagcaagcaggcatgaggatgggatggaataccttatgacataccaatgctcccacttacagaagatataaaatatatgaaaatataagaaaagctggataattcagtggataccaactgaggcaagaaaaattagaggagctaagaaggaagaaaccttggaaagatgagctggctcctatagatgtttttatcctagagacagagttgtcgcctaggcaggagtgcaatggcacaatctcaggcctccacctcccgggttcaagcaattctcctgcctcagcctcctgagtagctgggattatgggcacccgccaccatgtccaggtaatttttgtatttttagtagagatggggtttctctatgttggccaggctggtctcgaacccctgacctcaggtgattcacccatctcagcctcccaaagtgctgggattacaggtgtgagccaccacgcctggcccaatctgtaattctttatccagcaaaaaattcttcaaaaattaaggatatgacttctgggctgttgaaattaatgacagctgcctaaaactgaatttctccatgctccagaaaaactacacagatcaacaacatacacaaataaaatcactcataacccatgcatcagaaaaactgggagacatatgatatgaacttcaaaatattccccaatccaagaaactcatctgcaaagcctatgcctgtggtgacagacaggcaaaagtatggagaagtatggagcttcaccaaaaaaaaaaaaaaaaaaaaagggaaaaaaaataaagaaagaaaaggagaggtttgctgatggaacaaagaaaaatccacaaaagacaaaatcccacttgattatgaagatactaaaaatagatctaagatatgggatatcaaacacaggctaccgagaaattaaaaggaagtgactttatttttatgtgtattttttgagacagggtctggctctgttacccaggctagagtgcagtggtacaataatggcttactgcagcctcaccctcccagggtcaatcgatcctccgagcagctgggactacagacacacatcaccatgcccagctaatttttatattttttgtagagatggggtctccctatgttgacaggctggtctcaaactcctggattcaagtgatcctcccacctctgcctcccaaagttctgggattataggcatgagccaccacaccgggcattaaagttgttcaggataaaggaggtagcttcaagaagacatcactttttgaagggagaaggggtaaattgaaaggaaaaggcaaccattgagactttgatagtaaaagtaaagaaagaagcaggaaagggaaaataaggatccttcaaaaacagtagtgaatcacaaatcagaaaacatactgacactgccctccaataagagtgtcattgatttgagccaggcatggtggctcacaactataatcccagcactttgggaggccaaggtgggaagattgcttgagttcaggagttcaagaccagcctagaaaacatgagaaaaacccatctctatcaataatacaaaaaaattagctgggcatggtggcaggagcccgtagtcccagctacttgggaggctgaggtgggaggatcgcttgagctcaggaggcagaggttgcagtgagtcaagatcatgccactacaccccagcctggatgatagagcaagaccccatgtcaaaaaataaaaataaattaatttttaaaataacaaataaaaaagtgtgtcactgatttaaaaaacctgcatctcactacaccaaaggaagaggatgctcttgaaataagaaacttacttccctacacaaaatcctcacttctgtgtattaatatataactgttaatactcatctaagtaaataaaattatagaaaatacaattagaaaataaatagaaaaaggcagaccaaatccatgtaaagctgctataaaaataaaacagaaaatgagaatcagaacattttagctaatgaaaatcctccctaaaacaatgaaacaaaagaaaactccatcacaataccccaacctaaattaagtatcttttagtatttgcagatattttttaaaatctcatcaaatcataaatgcaaaaactcaaggcagaatagataaaagtaataggaggatacgaaatgagagctgagcaaacccagaaatactctgcagaaaacaaaatcatctcagaaatgaagactaaattacaaggtgcccacaggagactaaaattctacttaatatttaataaagaatactgagaaaaggtataggccgggtgcggtggctcacacctgtaatcccagcactttgggaggccgaggcggatcacgaggtcaggagatcgagaccatcctggctaagagggtgaaatcctgtctctactaaaaatataaaaaaattagccgggcgtggtggcaggcacctgtagtcccagctcaggaggctgaggcaggagaattggcatgaacccggaagacaaagcttgcagcgagccaagatcgcaccactgcactccagcctgggcgacacagcaagactccatctcaaaaacaaaaatactgaggaaaggtatgaaaacagccaaaagaataaaaataaaataaagaatctaaaaggataagagagaaggtggttgtatattagacaaagaagttctaacagggcagagggggtatctcatgccgctgaggcaggaaggtcacttgagcccaggagttcgaggctgcagtgagctcaggctatggcactccagcctgggtgacactgcaagaccctgtctttaaaaaaaaaaaaaaagaaagaaagaaagaaaagaccacgacgatgttctaacttatgtataaaataagctccaaaggccgggcgcggtggctcacgtctgtaatcctagcactttggaaggccgaggcgggcggatcaccaggtcaggagatcgagaccatcctggctaacacggtgaaaccctgtctctactaaaaatacaaaaaattagctgggtgtggtgacgggcgcctgtagtccagctactccggaggcagaggcgggagaatggcgtgaacctgggaggcggagcttgcagtgcgccgagatcatgccactgcactccagcctgggcaacacagcaagactccgccccccaaaaaaaaaaaattccaaaaaagaaaacaaacaaaaaaacaaataaagtactaaaaaaaaaaaacatataaattctaagaaataatcctgaaataaaagacttgaatctttatgttaaaaagactcaagtgtatagtgaaaattgaccctgaagagttaattccaagatacatcctaataaaaccactacatttaaaagaaaaaaaaatcctcattttctccagacaaaaaaaccaaatcatttacagagaaaagaaagattggtaattagatttctcaatggcaatataaaaagcaaagcatagcagagcaacattttagacaaactcaagggaaaagatgtgaaccaaacattttatatccaggcaagccatcatgtaaggattaaggctaatgtttctagcattaaaaaaagatgaatatttaaggttatggatatcccaattacactgatctgatgtttacaaattatattcatgtattaaattatcacatgtaccctgaaaatatatctattacgtatcaatgaaaataggaaaatacaaaaatagaagaaaaacctacaattaatatcatacataatggtaaaaacaaataaaaatgttaagtctaaagaaaagggtttgaacatcgaaaaattcaagaattactgtacctacaagcctttcttgaggacttcagatgagcttcttctaaccaaaatgtatggggaaacctacagcaaaaagactgatcataagaatggaatacaattggccgggcatggtggctcatgcctgtaatcccagcactttgggaggccaaggtgggtggatcacaaggtcaggagttcgagaccagcctggccaacatggtgaaaccccgtctctagtaaagatacaaaaaaaaaattagccgggtgtggtggcacacgcctgtaatcctagctactcagaagactgaggcaggagaattgcttgaacccaggaggcacaggttgcagtgagccaagatcgtgccattgcactccagcctgggtgacagggcaagactccatctcaaaataaataagtgaataaataaaaaggatggaataaaattaaaactaaaataagagtgagtagaaagaaaaatgatttgtaaaggctatgttttctttaaaaaagtagaaaaaaatttttaatgagaggatgaagagagaagagaaaaaaataagttcactgattttcacttagtaattaggagtcaaaggatatttaaagctggcaaataaaagaggagaaggttaaataaggaaaaggcagatcaagaacatgataaatagtattaatgtaaagtgaatcaataaaacaaaatgcaaaagccttctgaaataccaaaaaatacacccttacacattcatatatacagatacacacaaaagaaagcatagagaaggaaactgtaagtataacaaaataagacatttaagaccaaatatgaagtcatatcaataaatataaacgtgattaagttacctgttttaaaatttcaagctggctcacaaagcaaaaaccaactctatagtgtatataaaggaaatatgtaaaacaaagtaacttaaaagttaataaatagagacatgggaaaaggtataccaagcaaatgaaaccaagaagataccagtaggtatgggcctgatatcaggcaaggaaaattcaaggggaaagtcagtgaatgtgatagagatgaaacatttcactacttttgtaactagcaacacagtgaaaatatgttattaatatttatgtaccaaattacacaactaccactttcttacagcaaaaagtatgagaaatgaaaagagaaatacacagaaacctatgaataatagaccttcatctattaccattctcattctaagacagatcaagttgacaaaaaaaaaaaaaaactttaataaggtctatcttataaatatctagcaaacttttacctttttgatagagaataaactgtcttctgaggtatatattcatgaaaagtgctattagatcccaaagaataaaatgctataaagtagaaatacaaacaatattctctgagttccatgcaataaaactagaaattaaaaacaatgaaaaatcaagcccggcatggtgctgcacacatagtcccagctacgtgggaggctgaaatgagaagatcccttggtcccaggagttcagtaacatagtgagactcccacctctaaaaacaagaaaagaaaagaaaaagaaaaaccaaaaagcctctgccaccagaacattttcaaaatatattaaaatactcttggactaatgaggaaataccaactaaaattgcaaattttctttaaaaaaaaaaacgaaaaagaaactactacaaattaacattatgtgccttctgatgtgttgcactgagaagaataaatcatctgtgtagtattcctaccaaaaatgttcaaattccatctaatcataatgaaacagccaaatctccaaattgaagaatattttacaaaacaactgatctatattcttcaaaaatattttacatgcatgtccaaataaggcttagaaacagttttgtataaaaggagactatgaaaacattacaacgaaatgcaatgcatcattcttgattggatcccagattaaaaacaatataaaatgctattaagcacattattaagacctgggaaatatgaatatagatgacataatgtgtatcaatcataaatgagtatggtaactgtatcataatcatgtaaaaggtggcccttattcttaggagatacataataaataaagtacttaggggaagtgtcatgatatctaacttgcacatagatcagctaaagaaaaatccaaacagaaagcaaatgtgggaaaatattaattgatgaatctagtcttataacatttctaaataattaaacatttctcagccaggcgcggtggctcatgcctgtaatcccagcaccttgggaggccgaggcaggcagatcacggggtcaagagatcaagaccattctggccaacatggtgaaaccccatctctattaaaaatacaaaaattagttgggcatggtggctcatgcctgtagtcctagctactgctactcgggaagctgagggaggagaatcgcttgaacccaggaggtggaggttgcagtgagccgagaccacaccactgcactccagcctgggcaacagcaagactccatctcaaaaaaaaaaaaaaagaattaaacatttctcaaaattaaaaaggtaaaataagttttcagacaaatgctgagagaattatcatcaggaaccctaaatgaaaagaagtactagtactagaagtcctagctggagaaatcagacaagagaaagaaataaagggcatacaaatttgaaagaaggaagtcaaattatccttgattgcagataatatgatcttgtatttggaaaaacagaaagactgcaccaaaaaacgattagaactgataaacacattcagtaaagttgcgggatacaaaatcaacatacaaaacccagtagcatttctatataccaacaataatctaaaaaaatcaagaaagtaatctcatttacaatagctacaaataaagtaaaataaaatacctaggaataaacttatctaaaaaagtgaaagatctctataatgaaagctataaaacattggacgacacaaaaatatgaaaaaatattccatgttcatgagttggaagaattaatattgttaaaatgtccatactgcccaacgcaatctacaaattcaacataatctctatcaaaataccaatgacatttttcacagaaacagaaaaaataatcctaaaatttacatggaaccacaaaagacacagaatagtcaaagccatctaagcaaaaaaaaaaaaaaaaaacaaaaaaaaaacaaacaaaaaaaaactggaagaatcacaattatgtgactttaaattatactacagagctacagtaaccaaaacagcacagtactgacatgaacatagatgcacaaccaatggaaaagaacagagaacccagaaacaagtccacagacccacagtgaacttatttttgataaagatgccaagaacatacactggggaaaggatagtctcttcaataaataatgttgggaaaactggatccacatgcagaagaatgaaattagaccccttatcttttaccatatacaaaaatcaaatctaaatgaactaaagacttaactctaagatctgaaactatgaaactactaaaagaaaacattgaaagtagggtctcaaagacatatttgtatacttatgttcatagcaccattattcacaatagccaaaagatgggggcaatccaagtatacattgaggaatgaatggattaaaaaagtgtggtatatagccatacaatgaaatattatccagccttaaaaaggaaggaaattctgacacgttatgacaattttacaagacaaaaaacttctggagattggttgcacaacactgtgttatacacttaacattactgaactgtttgtacacttaagatggttaagataattttatgacatatgtattttaccacaaaaataaaatttaaaaaattttaatggtagaatctagatattagataaataagtgttcatggtaaaattctttcaaccttactgtatattggaaaagaaaaatatagatcaaaatttctctcatgaatgaaatcgtaatgcaaaaatcctaaagaaaatattaataatttaaatctaaagaaatgaaaaatacatcacaaccaagaatggttcattctaacaatgcaagactattttatatttttaaaaaatcagttcatcacaatatcagaatatttttattcagtgaaaaaatacttacttctctttggacttcttgactatcagttacttagaagtgtgttattttcaaatatcagaaagctttccacatatctattattaatttctaattttattccattgtaatcagagagcatttttgtattatttggaatcttttataatttatttgaaactggtctaggcgcagtgactcatacctgtaatcccagcactttgggaggccaagacaggtggattgcttgaggtcaggagttcaagaccaacctgaccaacatggtgaaaccccgtctctactaaaaatacaaaaaattagccaggcatggtggcatgagcctgtcgtcccagctactcaggaggctgaggtaagacaatcgcttaaacctgggaggtggagattgtagtgagccaagattgtgccactgaacttcagtttgagggacagagcaagattctgtctcaaaaaaaaaaaaagaaaattgaacctgttttatggcacacaatatggtttaccctggtaaatgttctacatgcacttaaaaagaaatgtgtactctgctgttttgggtagagcatactgtaaatgtcagttgggtcaagtaggttgattagtgttgttcaagtctcctaaatccttcactgattttctatctgttccatcgatttttgagagtgggatgtagaaatctttcaacaaaagtatttgtttatttctttgtagtttttgcttcatgtattttgaagttctattattaagtgcataaacatttaggactgtgaagaaaggatgttttttcttaatagagctaagtcaattgttccccatcagaaaaaaaaaaaaaaaagatctttaccccactttacgttatatcagaaaaatttcagctgggcgcggtggctcgctcctgtaatcccaacactttgggaggccaaggtgggaggactacctgaggtcaggagtttgagaccagcctggccaacatggcaaaaccccatctctactaaaaatacaaaaaatagccgggcatggtggcacatgcctgtagtcccagctactcaggaggctgaggcacgagaatcacttgaaccaaggaggtggaggttgcagtgggccaatattgtgccactgcagtccaccctggagacacagcaagactccgtctcaaaaaaaaaaaaaaaaaaaatttcagctggactaaacctaagtgagagaaaaacaatcataaagctttaaagacctgtggtaggaaaatatttcatcaaaaggttatcaaaaatgataatcataaaagtaagctgggtgcagtgactcatgcctgtaatcccagcactttgggaggccgaggcaggcagatgacaaggtcagaagttcaagaccagcctgaccaacaaggtgaaaccccgtctctactaaaaatacaaaaattagccgggcgtggagatgcgcacccgtaatcccagctatttgggaggctggggcagaagaattgcttgaacccaggaggtggaggttgcagtgagcagagatcacaccactgcactccagcctgggcaacagggcgagactctgtctcaaaaacaaaacaaaacaaaacaaaacaaaacaaaactgataaattagaatacaattaaaaacattcacccaaagaataagaaagtaaaagaacaagccaccatagagtgttagaagtatctgcaacccatatatctgacaaaggacttgtacccatagtatataaagatgcctagaaatcagtaagcaaaaggcagagaactcaatttaaaaataagcaaaagacttgaacaggcacttcacataaaaaacgtatcttaatggtcaataatcatatgaaaagtcaatattattcctcattagagaaatataaaagaaaaccatttacacagtcaccagaatggttaaaattaaaaggactgacaatatcaagtgttgacaagaatgtggcataaactagaactctcacgttgctgggaagaatgtaaattggttcaaatgcttggcaaaattggccgggcgcggtggctcatgtctgtaatcccagcactttgggaggtcgaggcagtcagatcatgaggtcaggagatcgagaccaacttggctaatacggtgaaaccccgtctctactaaaaatacaaaaaaaaaaaaaaaaattagcccggcgtagtggcgggcgcctgtggtctcagctactcaggaggctgaggcaggacaatggcgtgaacccgggaggcagagcttgcagtgagccgagatagcgcctgggtgacagagcaagactctgtctcaaaaaagaaaaaaaacaaaaaacaaaaaaacaaaaaaaccaaaaaatgcttggcaaaattgtctggcataatactaaagttaaacgtgcatcttccctctgactccgaaagtccattgctaggtatatgctccaaagaaacaagtgctatgtccaccaaagaatgtatgagaatattcaaaggaagtttattgataaaagccaaaagctagagacaactcaaatgtccatcaaaaggaaaagaaagaagcaaattgaggtaaatcaatcacacagtacaatagtacacaacaataaaaaagaattaactgatacatacaaccacatggataaatcaaacaaatacttttaacaaaagaaaccagaccatactctctatgattccatttatataaatttcaggaataggaaaaacgtatttacggtaatagatgtaagaacagtcgttatttctgagagtaggaacaggtacgtattaactgggaaatattatgaggaaacattctggagtgaaaggtcctattttaatttgggttgtgtctacatgagtgtatataaatgtaaaaattcgtcaagtagtatattaaagatttttgaattttattatacatgaaaaggaagggagccattaatagagtaaaaaggaaagcaataaagtggtaatatgaaacaaaggacttttatctagaatatatataaaactccaaaaaaaatctgtaacaaaaaacatacaacccaatagaaaaatggaaaaatataggtgttttattaaaaagggtatccaaatgcccaataaacatatgaaaggtgctcaaccttccaggtctcatgagagaaatgcaattaaaaccacaatgtgatgccaccacaaacaaagtaggattacaaaaattacaaaggaccatgccaaatactggtaagaatatgggaaaatggcaactctcattcactgttgtaaagaatgtaaattggttcaatcactttggaaaaaactggcactatctactaaatagtagatatctttatccataataaataaatattaacatattttaaaaagtaattattgccagattaagattaagctctctttttttatccttcttagacccagaatgatctttaaaatgatgttaagtgcagtataatcccttcaggtgtgcttctaatccaaaaaatccaatttatcccttttagaagtttaataaataactgaggccagaaacctgaaatgaataatactttataattttttcacaatgaccaacagacctcattgctgagtgctctgcaggggtaagctagagataagcctggtcaaatgccaacagcttcacctttttgctgagattcatgttcttcatcttagccttcagcagcttcatcttattcatagttattgaattttcaattatctgttgcccagaagaagaaggctcagtttcttcatcctcatctgtatctgaattatacatagaaccaccactgcaaagaaaacaataactacttgaaatttttctgatacctgctcagtgactaaaaatgctctatatgaaacagcaatctatagaagttactaatgataaaacactacatccattttgtcaatgttaatgtcaggaaaatatatttcaaagaatgtacttcttaaaagaaaaaatgaaatgggaataaatattatgatctaggattactgaaaatctagtatagctgagcttctctgaattcagtatatcataaatgaagatgttttgacacctgccatatcattcccaaagaggcaaaatccatttccatgagaatgtctgatttcattttatcagccaaggctgataattgtgcaacccagacaacaggctgatgagatttccatgaatcagaatttttttaaatttggcacgggagagaagtacagatttttagtcatcctgaggagattctcactaaaaaaaaaaaaaaaaaaagaattcatacacaggtgtcatcagaacattttctattcttaaggagcaaaaaacattttttttttcttgagacagtctcactcttgtcgccaggctggagtgcaatggcacaatctcggctcactgcaacctctgcctcccgggttcaagcgattctcctgcctcagcctcccaagtagctgggactacaggtgtgtgccaccatgcccagataattttttgtatttttagtagagacagggtttcactgtgttagccaggacagtctcaatctcctgacctcgtgatccgcctacctcggcctcccaaagtgctgggattgtaggtgtgagccaccgcgcccagccaatacatttttttaagtagagataacttcaaatttttctaagtgtgtttgaaaatgtaaaaacctagactagcatagattttaacaagaaaaaacacatccagtcaagtcatgatacaagctattaaacaggttaaacatttcaattactgatcaaccacagcgacgttattcatatttcaatgtaattaatatttggagcccttcctctttgattgtataatataatgatgtatcacacgatcctcatatttatacttacatgtttgttttgccccttattctcccacatgtaagcaagttgaaagcagacattagactttatcttctgagtctgcaccaggcacagcgcttggcacatagccaataaatgtttgatgaactgaacacaaagattttgaaatttaatttattttttctataatgggaaaattagaatggcaaggatttgataaaacacaagcttggcacatttggaaaacaattaagactttaaataaagcaaaataagaatacatattagtttctatgcagatttacttataggaaaactaggttatctacactatggaagtatgaggaaaatttcccgttttatatggttgtaagaaatggaaacaatttaggacagccttaatggggtatattccttaatgtttctgaagcacatattgtcacacaaggccaaaaaagagagcagacagccccattcctaaattttatatggtgcaacatgaaatgttctgaaactgtgggttaattacacgcactatacgcatgggtagcatctgaaggaagaatgtaggactggtctccacaaccaattcagtctgtggtgcttgacttgtgacagccacagttacctactacagcatggctaccacagtatgataactgacacaagtacaacactgaagtaataatattgcctgccatttactgaatgcctgctctgccaggcacttcccacacattattcctaattctcacaaaactacataaggtagatattatagctgattttattaatgaagaaactgcaggtgagagaggttaagtgatttggctcaagatcagaaagctatagacagcagacctaagattcaaatcccctatgtgtctggttcctaagctgattcttcctactactactcattgcttccccaggcaccaaatgacaggacttactgcatcatgcttgtgcacccagatgagtgccagaacttctactgtgtgaaggcttttgtctcaaggccaactatacaatacctgaagaagggtgcatgaagattttcgtcatgtcaccctgtggagttagaaggaataactcaagtatacactattctcagttaccttgcaatattttaaccttaaatacttctgagttactctgtggcattttaagtatctttactgaatactgaaagaagtttctgattcaacattactgtcatgaaaagacctattctctcatggaatagatacatatatacacacacatacatacacacatatatatatatataaaagaacaatcagctgggcgtgatggctcacgcctgtaatcccagcactttgggaggccgaggcgggtggatcacgaggtcaggagatcgagaccatcctggctaacatggtgaaaccccatctctactaaaaatacaaaaaattcgccgggcgtggtggcgggtgcctgtagtcccagctactcaggaggctgaggcaggagaatggcgtgaacccgggaggcagagcttgcaagtgagccgagatcacaccagtgcactccagcctgggcgacagagtgagactccatctcaaaaaaaaaaaaaaaaagaacaatcatgataaatcactggactcattttagagtataaaaacacttttaaattcacctttttttttcaaagaaccacattattttgttttctctcatgaagtatagattcatgagatgagttagaatccaatcacaaatttttttcagatgaaaaaatgtaactaggttaacatactaatttataaatttaatccgaaatgactttctttatatttaaatataatataacatttccttgaatttctaaattttttttagtgctatatgtaatttctccaaatcttttttttttttttttttttttttgagacagagtttcactcttgttgcccaggctggagtgcaatggtgcaatctcggctcaccgcaacctccacctcccgggttcaagcgccctttctcctgcctcagcctccctagtagctgggattacaggcatgcaccatcacgcccggctaattttgcatttttagtagagatgcggtttctccatgttggtcagactggtctcaaactcctgacctcaggtgatccgcctgcctctgcctcccaaagtgctgggattacaggcatgagccaccacgcccggcctcaaatcttttgatttaatgatatgattaaaggatacaagataggcaaatgtaatattattcaagcatgaaatctgcacatcgcaaagccaagacctcatttaactttcacagtttaccattaagtcttacaatgtctccttatctatctttctgcttaaaaaatcccaggccgggcacagtggctcatgcctgtaatcccagcactttgggaggccgaggtgggcggatcaccaggacgggagatcaagaccatcctggctaacacggtgaaaccccgtctctgctaaaaatacaaaaaattagctgggcatggtggcgggcgcctgtagtcccagctacttgggaggctgaggcaagagaatcgcttgaatctgggaggcagaggttgcagtgagccaagatcgtgccactgcactccagcctgggtgacagagcaagactccatctcaaaaaaaaaaaaaaaaaaaaaaataccagtaaggtggcatgatccactaaaaagatttgagactaaaaaaagactgatgctgcattttgtatcagaatgaaacaaattaacactcaattctccctctttctttttagagtagaagccagcaaaccatggtcatgggtcaaatctgccccaccacctatttctatttctgtgtggcccatgagctaagaatggtttatgaactttaattagttgaaaaaactcaaaataatggtatttcataacaaatgaaaattaaataaaattcaaatttgtgtccataaataaagttttattggaacaaagccatattcacccaatcatgtattacaaatggctgcttttgcctacaatggcagagttgagtagctatgacagactttatgtggctctctcgttgctctacactgtgatatggagaactacaaatcacagtaacatagtcataattcaacagtattttgactgccatgtatattgctattctgtgactttttttattactagggtatacccaaccttgtcaaacaagaaaagtagacttcaaatgttgccattttaaggtaccgtagagtggattatttgttagcaattagatagcaaagcatgatgcttataatgcagtgacactatagctatgctaaaggaaaacagcataaatagacattaccaggttaggcattcatcacaatattcccaactttcaggaaagcaacagtcagaaaaactagaaaatttacagtagaatatctcatcacagcagaatttctttacacaaataaaaaatgaaaatgaagctataaaaccaaagaagtttctgaatgtttatatctgctagccaagcaaggaaagctactcatcaatagtgaattaattcactattgatcacagcagttgaggaagtatgtcctgagaaaataaagttgtttaaagattacttttccagcagggacaatttctcaaaaagttgatagaattggaagtaatgtcaacagctgatttaaaaagctgattgttttttgatgagctgacatatattacccatattgctctgtgttattgtttattgagggcgtcaataccaagtttgaagtgactgaagagttggcccctatgaatagtctgcatgaagctactacaggtgagaatattttcaaataaattgctaaatactaatttagtacaactttaagtgaactctgctataactgatggggtgatgtgtgaaacagaaaaaaacttattggacaaatttatagttagtgaacatgtaaggtctttttttttttttttttgtctttttgagagggggtctcactctgtcacccaggctggagtgcagtggtgtgatctcggctcactgcaacctccacctcttgggctcaagcaatcctcccaccacagcctccgaagtagctgggactacaggtgtgcaccaccaggcccagctaatttttttccagatggagtttcactgtgttgcccggacttgtctcaaactcccggactcaagagattcgcccaccttccaaaagtgctgggattacaggtgtgagccaccatgccctttaaacatgtaaggtctttaaagtctacagttattcattgtattattcatcagcaggtatttcatggtaaatatctgagtctatcctgtgttattaaaccagcagtgttaatggtaaacttcaattgtttcatggacttatccatcatcagtttggtggcttactggtaataaagttttattatgttttttttagctcaggaactctgaatgagaagaactggccttaactactattacaaacactttttaaatttttaaattgcctttggaaattaatttttactgtggacttcataatgtttcataatgaatttaacctaaaattacaaaataaaacaatatttatatgtgaaacatatactgcaataatgtcatgttaacaacaactagtgtttgaattacacgtaacagcaagctgcaatcattcccatgctttcaaaagtagaaattaagtgatatctctattcccacagaaatttgcagcagatatatttccgagctcaaattataggtctagcagtgtttttatacctcagtgcaatttccaaataatgttctatttcaaaattcatttaaatgtgcaactgaggagcttccagggcaaacaccaagagaagatctgatagaattttataaacgccttaaaaatgatcaatatgttcaataaaagcatgtgctcatggactgatatcagcatctgacagtacctatctgtgtgaaaaaaaaatttctaagataaaatacataaaatctcattacagatcagctctaacaagtgaacttttgcaattgactttgcaaatttgatgggcaacactaactttccacctcaattaggtaaaacgttattcccatgaaaaagaattccattcttctctggaattctgtggtacaaacagaagaaaagtacccaattgttagtcttatattttgaactttgttagtgaaagttctgtggaaatttgttttctctcgttacataagtacctatttaatatccttgatgctgtctcttggcctaaaaatcctaaaatagttactatctgcacacctttacagaagaagtttgctacccctgttgtagactaggaaagcctcttctagaacaggaaatataaatgttcttcatggtatgatcagattgttttctactcctctttctcattcatccatccctttccttgtccaattattgtagatgaatacaaaggaagaaaaaatatataaattatcttgtgatgaacaacaagacagttctaattaaattccatgatgatatttgggctgagtcataaacacaaatagaagttggctgaggagaagctggagtaagaggagaaaatgacgtttcaagcaaaggagaaaagatgtctaaaaacacagcataatgagaagacctggaaaactgatggtaacacgttgtcaaaggactcatacgctaagctgaggagcttgggtttcctttaggaaaagggagccaaaagagtgtgtactagagaagaaaactaaacagtgagccagcacacggcaaaactggtatgaagacattctattaatggcctaaggctgtaaccctcactgctacctcctccatttcttgcccagggtttatgccaagtttgaagtgctaaccagatgctgacatgttaaagtcaacaggtaacacccatgtgtcacagtctgctctctgaggccacaaaaaattcagtctaatctttctttcatgtaacactctgtggaggggcagaagcctaggggaatctctctgactcttgacccttggtgttcacatcacatatggtttcctacccttgagtgtgggcatgatggacatctagcttctagccaactgaatatggcaaaggacgttgcagatgtaatttaggccccaaatcagttggttttgggttcatcaaaagggagctgagggcagcctctagtcaatagccagcaaaaaactgggcgctccatcatataactgaaaggaaatgaattatgccagcaataagagtgactctgtaagtagattctcctccccagtcaagcctcttgataagagaattgctgacaccttgactccagattgtgggacttggagcacagcaatgctgtgcctggactcctgatccacagaaactgttctccaaactacaagctgttttttttttttttttttaatgattttaccactacctttttattttgcaggatgtgtaacaccttcccttgctttgtctgcttggcaaactccactccccttttagggtcacttcttctcagaggatgtgtctaactctctgcctttcatgcataataaaggccctgtcatctattctcccagagatcttgatatctttttataacatcaccaacattatatcactgatactcttcatagcagactgcatgctccatgaaggtaggaataatcatctttacaacatcagtgccttgctcagtgaatggccataaaagttcagtgagtgaatgcttaataacttgaagtgaaaggagataaaaaaatcatagtaactcagaatgcacagcaactaactgagaggttgccttgtccaattctctaattcttctattgcttagctaaatatatgtagggtttttcctcctgattttagaatattacaatttatctcccttttatagagtaggaaaacaagaccagagaagtaaagagatttatctgcctttaaggagcagagttaaatttagaaaaaaaggtatcaactttaggtttaaccctttctattatgctaaggttgtataataacacactattatgacaggattctataatctattaggcatcttagagtttcacagactaacagaaacaaatctttttatgaaaacatcccactctaaaaaaacctcagttttatcatatcaattatacgaaggacaatttcagacttatatattgggggctggggcaggaatgagatgcatgacatttgttaatatatatagattattttgacaacacaaggtaaacaaaagtttatggagtacctcatacgatgttctccttttctccgtaggacatgcaaatgaaaatctattttctttgaagagtcagataacggtgttaaagtgccatctcccctatctactgcaggaaagaaattcaattgatctccttcttggtataccaaaaatgtaacttgtttgctgcaggaggtcttctcccagacctcaactcgactggaatccaagtactctgccatcttcctaagtggatcgtctgtaggaactacaaatggaaaattgaaataagtcttcaatttggatcaagttttatgcatcttggtacagtgacaggatataatatactgaatttgaacaacagtcctgtgcatataatataaacatgatattcttcaaataagtttctgatctttctacaattaatatagcattccctatgttatattaataagaaacaaacaaacaaaatgcatgattatgttgctatattcaaagacagggctaaactaaaacatgagagttttttgtcctatgccattatagtctatattttttccctatgtcactagagtctgtgtatttgctgattctatgatattactatcaataatttttttactatatactttctgctccctatattttcaaatattggttccaacaataattaaaaccaaaataaattccacttacgttagattaaaagtacacagacacggccgggtgcggtggctcatgcctgtaatcccagcactttgggaggccgaggcgggcagatcatgaagtcaagagatcaagaccatcctggccaacatggtgaaaccccgtctctactaaaaaaaatacaaaaattagctgggcatggtggtgcgcacctgtagtccctcaaaaaaaaaaaaaaaaagtacacacacacacacaattaggagacatatctaagaaattagaagtaagcagacctatctttttctttctggttttatataaaggctgattcttaagagctgttccttgacatgaagttaggtaattaaaagtacataataacttagaacgtgaggggggtcacttcatgtactaaaactgcaacagttccaggaaaaaataaaagttctctcccaaagacattctcatcatactgcagaaacatctgttttctcctaaaagaggtaaagatttcccaagctgcataactttcacttatttattaacagaatcgtggtgctctacaaccctttaaaaagaagttgcagcaataggaaaatattaaacttggaaagcagtaaggtaaaaacatcaaagatgcttccatagcctaaattcaataacactattactaacataaaaatcttataatatggtttagcttgctttatgaaaacagttatttggatgttttgatttactttcacaggcccaaaatgtataaatattaaaagacacttttcaaacaagttcttgccttttgtaagttaatgctccactttccatattacatcaagagataaaaatttggatcagagagcagacctttaggggggaaaaaacccaacaaaacacaacaaaaaagaaataaaaattatgcccattttttagatattgctatagccattaccacagtcacatgaaagcctttcctaaaccagcacagggtgccttactcaggcaagtgtatgtgtggatcttctcataacagaaaaatctttcagattttatcagctataaaacaatatatatgaagtttgatatgcattgggcacaatttagttttagaaaagaaacattttaatctttctatgctgctttgataatagttatttcaaaaacaatttttttttatttgtattcgttttttgagacagagtctcactctgtcacccagactggactgtagtggcgcagtctccactcactgtaacctctgtcacccagactggactgtagtggcgcagtctccactcactgtaacgtctgtctcccaggttcaagcaattctcatgtctcagcctcctgagtagcccgccaccatgcccagctaatttttgtatttttagtagagatggggtttcaccatgttggccaagctggtctcaaactcctgacctcaataccactgcctgtaatcccagctactcgggaggctgaggcaggagaatcacttgaacccaggtggcagaggttgaagtgagcagagatcatgccactgcactccagcctcggtgacagagcaagactccgtctcaaaaaaaaaaagaaaagtaaaaaatatatatatttacctcagaatctgtatcacactcctcataaacatataaaataattttagttctaataagaaaagtaggtgttttgattaaacactttggtttaaagtagtactacgcacaaataaccaactttcaaaaatgtaatacaatagagttcacatggcattaaacactatataattctatcttaacataatggttcagtaaacacagggttcttgtgctacttcaagagttattactataaacatcacatagttattactataaacatttatagttattactataaatgtcacataggacaattacctaaatccaattaattaaaagtctctggtatcaggagtgctaaaaggccctaacattattaactttgtttttctctaacctataaaaagcagtccaacagccaaagtagcatatctcattaaatcctcttgaaatagctaagaaaaagatggcaataatcctattttctaaccaaaattattaaacatagggatataatttgacatgtggaagcaagccaggagtagaatcaatacttatccttcggttttctggttagtgaaggatcaaataaatctgaaggacttcctcaaaatgaggtccacagaagaggatgctctgactagtctcctccacttcatgggaattcatgtgacatacctgactcagggaccaatgtgaatactgccgtctcttcttgtgcttaataaaaccctctcatcaatcaagtctccactaatgtcatctttttcgagggcccttcctaccctattttctgcatagcacttacaaccattaggagttacatcgactctttacacatttattgtaggcactgtcatgaagcagagactttctctcccatgtctaccatacttggaacattgcactgaccattcagtagacgctcaatacgtatttgttgaatgaatgactggatttcagaactacttatattctgagaaaggatgcaaccggggccatgataatatccatgaaacccagacacatcacaaaccaggtaaacaggcaatgttggaattttgcaaaacgatcatcatcttgggatttgaagatctggtagatttaaaaataaacaagactcgtatgaaactaaacacaatggtaaagtagtatttatagtatgtcattccatttctgttccctatactggcaaaaggtttatttttaaacctctctgaattggatcaggaatcatgtgatttttctgaattgtattttagagttccagcctctaggcatttaggttttaaagaacaatgcctagagaatcaaatgtgatttttctaagacctaatagcagaaaggaaacctaaataaaacctgaggctataaaaatactaactgacataaagaatgttactgtcaaattgctttaatatatatatatgcctacctcttctagtatttataggtccgccacgcatagccaaaactagcttcaaggtacacccttctgaaatgctgtggatagttaacacaaaaataaatcataatcatcaaaatgcattcagttaaatgtacacataattatgtgctggcttatcaggcagagtggccactctctaaaatataaaaagatatagcaatgtaaatacatataaaatgttaacatatttactggtacaaataataaaaaaggtgaaacaaattctcataagccataaagaaatccaagaataaacatactggaaaagacctctgtgattacgtgttttagcctgttcatttcacattaaggaaaaggaggcccagagaacaaaagtggcatgccggagacccaaagtgcagaaaatagcaaatctatttaataaaacagaaaatagaaaaataacaaggtctcctgactctcagtgctcttacagctattccacactgcctcttatccttttactcttttcttaacaaaagagtgatgaattatgtgaaagaggggagaaataagagagacaaagtgtcagaaagtacgttggtagtcactggtgcacacagcattgcttagtaacaaaaggagggcttaatgagaaaggaaagactttgggaagaacaattctctcttatccaaaactcttgtaaaaacagaaagaaaggaacatagccaggaaggaatggttcaatattcaaagaaaggagaaaagtaggcaagaagataataggaggatttcaaaaggcaggagataaacagcttgacatgaaaaatgaaaagggaaaataaatgtatcagaggataaaggttaaagtagtatacagtaccaaactaatgcatctaaagttcaggatgtataatgaaatctaggaatgtgaactattcaggagaaaaacagacatgatctaagagttcaaaagaaaaacattagcatatggagtcataatactaagtgcctacaaaacagccaatatgcaattacactcacttgtaatcattcaagcaataatcattttcaagttccatgttattccaaattaagtgttgtcgacagatgggaataccttaagggaaagttattaaaaaaaagtgttaaagaattcaatagcatctccaaaagagtatgatacaaatctatttcattaaggaactaagagcactaaaaaattaaacattcttctaaattgaatgctaggtgctaaaatttacagaatcataggtagaaggcatgcctaaaaggagatatagtccaatccattcactgtagaaaagaacagcatgttgcaataactctctggtcctaaaacaaggtataagatagggatccctttaaaaggcaagatatcatgctcctgcacagcaaaagaaactatcaacagagtaaagagatgatctacagaatgggagaacatattcacaaactatgcatctgacaaagatctaatatctacgatctgtaaagaacttaattcaacaaacaaagaacaaccccattaaaaaatgggcaaaggacatgcatgaacagacacttctcaaaaaaagacatatatgtggccaacaaatatatttaaaaagctcaacattactaatcattagacaaatgtaaatcaaaaccacaatgagatacaagctcacacctgtcagaatggctattaataaaaagtcaaaaaataactgatgttgtcaaggttgaggagaacagggaacgcatacactgctggtgggaatgcaaattagttcagccattgtggaaagcaatgtggagatttctcaaagagtttaaaacagaacgaccattgaacccaacaatcccactactgggtatatacccagagaaaaataaatcactctatcaaaaagacacatgcactagtatgttcatcacagtactattcacaatacaaaagagatgaaatcaatcaagatgcccctgcaacagtggactggacaaataaaatgtggtgcatatacaccacagaacaccatgcggccataaaaagaataaaatcatgtcctttgcagcaacatgaatgcagctggaggccatcatcctaagagaacaaatgcaggaacagaaaacccaaataacatgtgttctcacttataagcaggagctaaacactgagtatatatggagacaaagatgggaacaataaacactagggactacatggggagggaaggggatgtgggttgaaaaactacctatcgagtactatgctcacatcctgggtgacaggataattcatacaccaaacttcagcaacacacaatttacccacgtaacaaacctacccatgtatccactgaacctaaaagttgaaaaaacaaaaaaagatattgggctgggcacagtagctcatgcctgtaattccagcactttaggaggccgaggcaggtggatcacgaggtcaagagatcgagaccatcctggccaacatggtgaaaccccgtctctactaaaaatacaaaaattagccaggcatagtggcaggcgcctgtagtagcagctactctgtaggctgaggcaggagaatcacttgaacctgggaggcagaggttgcagtgagccgagattgcgccactgcactccagcctggcaacagagtgagactccatctcaaaaaaaaaaaaagatatcatgaatcaggcctgaagagtttagtatttgaggcctaaaatggaaatcaaaagcaagcaggagtagctattcttatatcagagaaaacagagtttaaagcaacaatattacaaaaaaagacaaagaaggtcattatataatgataaaaggatcaatccaacaagaagatattacaatcctaaatatatatgcacctaactcttgagctcccagattcataaaacaattgctatcaggaaaagagataaacaacaacacaataatagtgggggactttaacactccactgacagcactagacaggtcatcaagccagaaagtcaacaaagaaaaaatggacttaaactgcactctagaacaaatggacctaacagatatttacagaacattcaaccgaagaactgaaaaatatacattcgtctcatcagcacatgaaacattctccaagatagatcatatgagaagccacaaaaaagtctcaaaaatttttaaaaaatcaaaattctatcaagtatcccccccagaccacagtggaataaaattagaaatcaactccaaaagggaatcctcaaactatacaaatacatggaaattaaacaatctgctcctgaatgatttttgggttaacaatgaaatcaagatggagatttaaaaattcttccaaaggaatgataatagtaatacaagttatctaaacctctgggatacagcaaaagcagtgctaagaggaaagtttatagtgctgaatgcctacatcaaaaagtctgaaaggtcacaaactgacatcacagtttgatgtgtaacatcacacctcaaggaactaaagaaacaagaacaaaccaaacccacagctagcattagaaaagaaataacaaagatcagagcagaactaaattgaatggaaacaaaaaatactaaagatcaataaataaaagtttggttctttggaaatataaacaaaatccacaggccattagctatattaatcaagaaaagaaaacagaaaatgcaaataaactcactgagaaataaaaatggagacattacaacttacaccacagaaatacaaaagatcattcaagattactataaatacctttatgcacataaactagaaaatctagatgaaatggataaattcctagaaacatacaatcctcctaccttaagtcaggaagaaatagaaatcctgaacagaccagtaacaagcagtgagaatgaatcagtaatttttaaattgcaaacaacaaaaaaagcccagggccagatggattcacagacaaattctaccagacattcaatgaattggtactggccgggcgcagtggctcacgcctgtaatcccagcactttgggaggccgaggtgggtggatcacgaggtcaggagatcaagaccatcctggctaacacagtgaaaccccatctctactaaaaatacaaaaaattagctgggcgtggtggcacgcacctgtagccccagctacttgggaggctgaggcaggagaatggcttgaacccgggaggcggaggttgcagtgagctgagatcgcaccactgcactccagccttgacagagcaagactccgtttctaaaaagaaaagagaagagaagagaagagaagagaagaattggtaccaatcctactgaaactattccaaaagattgaaaaagagggaatcggccaggcaaggtggctcatgcttgtaatcccagcactttgggaggttgaggtgggcagatcacaaggtcaggagaccagcctggccaatatggtgaaaccctgtctctgagagctcaaagcttcagtgagctgtaatggtgccactgcactccaggctgggtaacaaagtgagaacctgtctcaaaaaaaaaaaaaaaaaaaaaaaagaaaagaaaaaagaaagaaagaaaagaaacaaaaactgtaatggaaaacttaaaagcaccagaatatcaaaacacagtaacaagaaaacgacaaaaatttgaaaagacgcttcaccaaaaaagatatacagataatgcaacagactgaatgtttgtattcccccacccaaattcatatgctgaagcctaaatacccaatataatggtatcagaggtaaggatgggggtctttggaggtaattaggtcatgagggtagggtcctcaagaatgggattagtgtccttagaagagagatgatctccctctctttatctaccgtgagaggatgtagaaagaaaatagctatctgcaaaccagaaagagtgccctcaccagaccctagacctgtggattagtaatcttggacttcccagctccagaaccgtgagaaataaacttctgttgtttaagacatccaatctatggtattctgtgacagcaacctgaacttttttttttttttttttgagacagggtctcatccattgcccaggctggagtgcaatggtgcaattttagctcactgcaatctccatgtcctgagctcaagcgatcctcccacctcagcctcctgagcagctgggactacaggcgcatgccaccacgcccagaaaaaatttttgtatttttagtagagacagggtttcgcaatgttgcccagactggtcttgaactcctggacttgagtgatccacctggctcagcctctcaacctgaacttattaagacagatgacaagcaaattaaaagatgcataacatcatcagtcattaggaaaatgtaaattaaaaccacagtgaaatatttccagttcgaattataatagcaaaaatgaaacaaaaagtaaaactaaaagaacccagacaatattattaagtgctgataaggatacagagcaactagaacttttatgtattactcatacaaacacaaaatggtaacaaccactctggaaaataatttagcagttttataaagttaactatatacttcctatgcaattcagcaattccactcttaagtatttacccaagtgaaataaaaacctatgcttccataaaaatgtgtatgtgaaagtttatatggctttatttgtaatcaccaaaaactaaaaaccacccagatgtccctcaacttgggaatgagtaactatggtacttccttataatggaacattactcggccataaacagaatgaactactgatacatataacaatatgataagtctcaaacatattatgcataagtgaaaaaaaccagacttaagagactataaagtatatgatttcatttatataaaattctaaaaaaggcaaaattacaggaacagaaacagatcagtgggtatgataggggcttggaatagaggaagggattgaccacaaaaggtacaggagaattctgataggtgatggaactgttctatatcttgattgtggtggtgactgtatgatagtaaatgtctgccaacaccaacagaacgatatacttgttatgatatactgtgtcccttcaaaattcttaggtggaagtctaagcctcttatacctcagaatgtgaccttaacttgaagacagaatcttgacatatgtattcaagttaaagtgagctaactagggagggccctcatccaatatgactggtatccatataaaaaggagaaatttggaggcagatacacacagacacaaggagattatcacatgagaagaccagggtgatgccttgaataagccaatgaactagaaagattgaaagcaaacccccaggagctgggtgaaaggcatgtgacagattctacagccctcagaaggacctgacactgtcaccaactaaatcttgtattttcagcctccaaaatcgtgtaactttctgttaagtcacccagtttgtgatactttgctatgacagccctagcaaactaatacaatatgtgaattgtatgatatgtaaattatatcttcctaaaaaatagtttgttagaatttggagacaaataaaaacatgctcagtattattagttagcaaattaagaatgtgtataaactaaaaaaaatgatcgaagctgtctaatcgtatatattgctgtgattacaaagcccttaaagaactattataattttttaaacaaaaaaatatttttagcaaaacaaatacttggaatttaataacactgacattcaacttaccaaaaacttgtaggatatagctaacacagttattggaattttaaaataaacggttatgtttttaagaagttgagactcctagtttcagctctgatatatggagaacttttaattcaccactccttacaagaaaaaaagctgaacaaaccgaaaaccaacaacttttctttgtgccatcagagaaattaggtagtaaggtaaatcaccataagaaaatctgttgagataggcaaacccagagagtcagagccaagatccatttacgtgaagctgaagcctctaaagtcataaactggaaggaacacttgaatggtaattttgatgaattcatagaggctgagtgtggactagtatgagactgggaaattattgagggccagaaaccaggcccctctagcctccctacctcacctaaactactagaagttgaaggaggggagaagctaagatacactttgaaggtcccagcctagaggcacaggcccactgcaagatttaatcataagattacagaatgttccccctcttcccaatacctcaccaccacactaacaaggctccagtataacaacagtggattacaacggaaagaattgtaagacgcaaactctaaggaggagtctttagggaaactcaaaggcaacaggggagacaaaacaagaaaaaactagaggaatttgaaggctctggcacttataactacagcaaacattaaacacagcccaatttctagcaagttgaagataaaacctcactctaatgtcctatttacctcaattcctattacctgatatgttatgtctggttttcaactaaaaattacaaagcatgctaaaagacatgaaaaaatatggtatgaaaagacaaaactagcatcagaaatagactcaggtatgtcagagatcttgaaattatcagacagggaaattaaaacagctaagattaatatgctaagaaatctaatggaaaagtatacaacatgaaataacagattgataatacaagcagagatggaaactttaagaataaaaagtagatgttaaaaataaaagctccaacagaaataaagaatgcctttgattggtcatctgcagactggatctggaaaagaattgggaagtttgaaaaatggcaacagaggccgggcgcggtggctcacgcctggaatcccagcactttgggaggccgagacaggcggatcccgaggtcaggagatcgagaccatcctgactaacacggtgaaaccccgtctctactaaaatacaaaaaattagccgggtgtgtagtcccacctactcgggaggctgaggcaggagaatggcgtgaacccaggaggcagagcttgcagtgagccaagatcacaccactgcacttcagcatgggcgacagagcgagacgcatctcaaaaaaaaaaaaaaaaaagaaaaatggcaacagaaacttcctaggcaaggcacagtggtatgcacttgtagtcccagctacttgaaaggctgaggcacaaggattatttgagtccaggaggtcgagtccagcctggccaacatagtgaaatcccatctcaaaataaataaataaataaaagaaacaaagaaaagaaaataaacttggcaaaacggactgttaagagaaaaaagaatgcacaaaaacaacatctattaactgtgggacaatttcaaaagttgtggcaatttcaaaaggtgccactagaatatcagaagaaaaaatgagacagaagaaatacttaaataatggcccagattttccaaaattaatgaaacataccaaaccacagatccaagaagctcagagaataccaaacacgataactaccaaagaatctacaccttcaacatattatatcaaactgtagaaaagcaaagacaaagacaaaattcttaaatcagccaggaaagggaaaaaaacaccttacctaaagagaagcaaagataattactacaggggagttttcatcagaaatcatgcaaataagaaaagactagagtgaaatatttagtgttgaaagaaaaaaaataccaacttagaattctataccctgaaatattatccttcagaaatgaaggagaaatactttttcagacaaacaagaaacgttaaaagatggcttttttgcaagaaacgttaaaagacattattcacagaaaaaatgatgtaggtcagaaactaagatctacataaagaaagcaagaggtggaatttgttgccagtggacccatattgcaagaaatgttaaaagacattcttcacaaaaaacaggatgtaggtcagaaactcagatctacataaacaaaggaagagggctgggcctggtggctcaggtctgtaatcccagctctttggaaggctgaggcaggaggatcactctgctaagcacttcacctttaactcatttaatcctgagaacaaccctttgagataaatactattattcttcctatcttagactgagacaactaagatacagagagattaagtaatttgggcagccagtaatctgaagccaggcagcatggcttcggcactccagtccctttttcaaggcccattgtaaatccctgagcaggccctgctcctcccttgctgcagcctccttgttcctaatgcagcacactccttcagtcctttctccactagcccctccatcctccccactctccccaccaggctctagttc

SEQ ID NO: 616 - DNA, 565648 bp, Homo sapiens
aaggtatagaaaaatgttgattgtatatgaggcatagaaaaatgcttaaaggaatgatgatctttaataaattcataagactgacccatacatttttcttttttttgagacggagtctcactgtgtcgcccaggctggagtgcagtggcacgatcttggctcactgcaacctccgcctcccgggttcaagcgattcttctgcttcagcctcccaagtagctgggattacaggcacccaccatcacgcccagctaatttttgtatttttagtagagacggggtttcactgtgttggccagtctcgaactcctgacctcatgatccgcccacctcggcctcccaaagtgctgggattacagccgtgagccaccgcaccgggccaaaactgaccaatacatttgtacctgcctctcccacgcaagatgctttcagatatgaatgaaaccaacagctcttggccgggcaccgtggctcacacctgtaatcccagcactttggaaggccaaggcgggtggatcacttgaggccaggagttcgagaccagcctggccaacatggaagaacccggtctactaaaaatgcaaaaattagtcgggcatggtggcatgtgcctgtaatcccaactactcaggaggctgaggcaggagaatcgcttgaacctaggaggtggaggttgcagtgagccgagatagcaccactgcactccagcctggacgacagagtgagactctgtctcaaaaaataaaaaaagaaaaagaaaccaacagctctgaagcactcagactgtccacctcactgtctccagacctggggctcctgctccgattctgtgtctgaaactgcctgacactccacgggaccaaagccagggtgagctgcttcttgctccgtctcccacccaacccccctctccccattccccgccagggatcagggcatctggcttctctctctttttgtcttttcgtccctcccaaagtgctatggattcctttgttggttggttcactcactgtttcaggaatattttggggccttaaaaatgttccaggggccgggcgtggtggctcatgcctgtaatcccagcactttgggaggccaagatgggtggagcatttgaggtcacaagttcaagaccagcctggccaacatagtgaaatcccgtctctaataaaatacgaaaatttttagtagggtgtggtggtgcacgcccgtagttccagctgcttgggaggctgaggccggagaatcacttgaacccaggaggtggaggctgcggtcagccgaggtgacgccattgcactccagccgggacaacagcgtgagagactccgtctcaaaaaggaaaaaaaaaaagttccaagggctggtctgaaagcagtggtttatctcgcctgttcagtaagttacagacccaattccttgttctactctttcctcgctgctcactactgtccttgccgtcaagaaaaaataaaaataaaaaaaggaaagttccagtcactgtgctgggggttgaggacgcactgcacacgacatatcccgggccagcctcaaccttcagggtggcgagggcagcaccgagggaaggagcaggaacccaggcagaggcgcccaggcacacgcagaggagccgcgcaggaggccagaggctgagccctgaggggcggggacaggccgcttccctgcgtgcagtttcacaagctcaagctgctgtgtgcggtccggaaagagtagtatgaggcctgaccactggctttggccgcctggtgagagcagcatccgtgtgacagtgagcacagcggccggctgaagctgccggggaagggggagagtggggcaagtgagcactgccggccctgtcaggagacttggctgctggagagcagagtagagcagcgggagtggaggctggcgatgttaagggagggttttgctttgcttttaagatgagagagacaggagcatgtgtaaatggtgatgaaaatgaatggtgccaggcgcagtggctcagcctgtaatcccagcactttgggaggccgaggcgagtggctcacctgaggtcaggagttcgagaccagcctggccaacatggtgaaaccccgtctctactaaaaatacaaaaaatcaggtgggcatggtgacgtgcacctgtaattccagctactcgggaggctgaggcaggagaatcgcttgaacccaggaggccaagatcacaccactgcactccagcctgagtgacagagaaatactctgtctcaaaaaagaaaaaaaaagaaagaaagaagaaagaaagagagagagaaattgaacggtattaatagtagcgacatctagagcactcacttgtaccagctgctactctatgtcttaaactcacccatgctgcccattttacagttggggaaagtggacgcctaggtggctaagtaatatacccaggatctctctgctggtatgctgtggagctgtgatgtgaacatgtgtgaactggatccagagaccttgctatcaaccacaggcagagttgcagcccagggatggaggaggaagggaatgagatttggggcatgtgaagaaggcctgaggcaggtgctgcgggctgcgggaaggagccctgcctggtgaatcgcaggccacgttagggtccctggaggctggagatcctggatcaggagggcagcattctgggcaggggagggagggcaggaagaaccacaggatgtgagaagggcgaaggctgcccagaaaaggctgaaacgatgcactgaggctggggagggtccacatgcagaccagagcgggctgatgaggaagggcggagctggggagtcacaggtgggggagccaaatatgggtgtggtggagtgattgaagggtgactgggatgggaggtggtgggcagagagggcgcctgtgtccttccagctgtctgatacctgcagctcctccctcatcaatgctgcccatcagttttcctagaacagccagtgacctgctgaaggagtctcatggcgcggatgtccaccctcaccactcctgctccacattgtgctagaggtccaagacagtgcaataagaagagaaaaaaataaagccatacagattggaaaagaagaagtgaaactgtcctttttcacagacaacaggatttcctatgtagaatcaacaaaaaagctattggaactaataaatgggtctagcaaaatggcaggattcaacaccaattcaaaaaaatccattgtatttccttataataatgaacaaatggaaattgaaattttaaaaaacatgcttacaatagcacaaaaaaagaaatacatataaatctaacaaaatggatacaaaatctatatgctgaaaaacacaaaataaggatgaaagacatcgaagaagacgtaaataaatggagaggtgtggcatgttcatgaattcactcaatcttgttagaatgtcaattctccccaaactgatctataggctcaatgaaattccagtgaaaatcctagcagatttttttgtaacaaataataaggaaacaatacaattttttaaatggacaaaagattggaacagacacttcaccatagttacacagatggcaaagaagaacatgaaaatatgcttaaaccattagtcattaggaaaatacaaactgaagccacactgagatgccactacacatgtcttataccggcttaaacaaaaaacaactgacaacatcaaacgttcgtaaggatgcaaagcaattggaattcttatatattacgggtaggaatgcaaaatagtaccactattttggaagacaatttggcaatttattatgaaattaaacattcaggccggacacagtggctcacgcctataatcccagcactttgggaggctgaggcaggcagatcacttgaggtcaggagttccagaccagcctggccaacatggtgaaccccatctctactaaaaatgcaaaaattagcccggcgtggtggctcacacctgttgtcttagctacctgggaggctgaggtgggaggatcacttgaatctgggaggtggaggttgcagtgagccaagatcgagccactgcactccatcctgggtgacagagtgagactccatctcaaacgaacaaacaaaaaaccacattcaattaccatatgaccccttcaagtatttaccccaaagaaatgaaaacttatgttcacatgcctgtacaccagtgtttatagcagctttatttattataatcccccaaactagaaataacacaaacatcttcaattggtaaatggataatctattgaacatccatacaatgcaataccgtacggcaatcaaaaggaataaacgactgctatgagcaacaacatgaatgaatctcgaatgtattgtgctaagtgaaagaagccagactcacaagccaacaatttcagttattctggaaaaggaaagtgataaggacagaggacagatcagtggttgccaaaagccacaggtagggggagaaattgactacaaaagaccatgatctctgatttttgggtgggatggacctgttctaaatattgattgtggtggtggctgcaggactgtatccgtgtgtcagaactcatactgtatactagaaaaggatgagtattacataggtagattattgctcaataaacgactttttgttttggtttttgtttgttttgagacagagtctggctctgtctcccaagctggagtgcagtggcatgatctcagctcactgcagcttctgcctcccaggttcaagagattctctgcctcagcctccaaatagctgggattacaggcacatgccaccatgcctggctaatttttgtattttttgtagagacagggtttcgccatgttggccaggctggtctcgaactcctgacctggcctcaagtgatccacccacctcggcctcccaaagtgctgggattgcaggtgtgggccatgcacccgtccaataaacttggcttttaagaaattctaccctggctctcataccatgatttcatcatcaagcctaaattctccacctgactttctggggttgttttgttttgtttttgagacagagtctcaatctgtcacccaggctggagtgcaatgacacaatctcggctcactgcaacttctgcttcccaggttcaagcgattcttgtgcctcagtctcccgagtagctgggactacaggtgtgccccaccacacctggctaatttttgtatttttagtagaaacagggtttcaccttgttggccaggctggtctcgaactcccagtctcaggtcatctggccacctcggcctcccaaagtgctgggattacaggtgtgagccactgcacccagcctgggcatttttttttaagacagggtcttgctctattgcccaggctggagtgcagtggtgcaatcacagctcactgactgcagcctccatctcccgggctcaaacaatcctcccacctcagcctctggagtagctgggactaaaggcacgtgccaccgtgcctggctaattttttaattttttgtagagatgaagtctcgttttgttgcccaggctggtctcaaactccggggctcaagtgatcctcctgcctcagcctcccaaagcgctagaattacaggcatgagccacggggcacagcttggaactttttcttttcttttcttttctttttttttttttttttttggaggcagagtctcgctctgctgcccaggctggagtgcatggtacgatctgggctcactgcaagctccgcctctccggttcacgccattccccagcctggacctttttaatgtggccaacagaagcagtcgacttggttgcccacaccaccttcttgccccagttagaattgtttcctctccatcctatcaacattccacagactttcaggcttccctgagtttttgcaaaggtgtcccctcacccgcaatgccctcctctccgtcttctgtctctcccgaacccctaagctgcacgtcctaccctaccatgtggtcctccctcaaccctcaatgcctgagtctgcgccacacagctcaggaccggccccctctctgagtgttcgtgggtatctggtgggtgttactctgatttcaggttcctcatcaacacgagtgtggaatgtagccttactcacctctattcccatcgctcaaagaatccaaaccgcctagcacacagtaggcccccaggaaggacagggaccactgagctcccggaggaggcgagattggagcctcttaagagctgggtctggagggacctaacgaggcaccatcgcgggtgggggtcaggctatcagggccaagggcagtggagaaagcgcgggaagcgcggaggtccccgaggtgcaagctgaccacccgcggccccgcgtaccttgcccttgtaggtgcggtcggccgagctcacggacagtgcctggatcagcagcaggagggacagcggcaccaggaggcccgcggcggacacggccaccacgatgctgcgcgggttaaggaaccgggctgcgggacccccacgcctggccccgccccccaggcccgactccgccccgagccccgccccgcccccggacgcccgcccctcaggcccgactccgccccgagccccgccccgcccctggccccgcccccaggcccgactccgccccgagccccgccccgcccccggacgcccgcccctcaggcccgactccgccccgagccccgccccgcccctggccccgcccctcaggcccgactccgccccgagccccgccccgccccccggacgcccgcccacccgccccgtcccctggctccaccctcatcccgcccacccccttgaaagcctgactccaccccgctgtccccgcccgtccagatctgcggtgcacctttagcacccgctccgtgaccccgccagattcctttttcttttcttttcttttcttttgaggcacaatcaccgctcactgcagcctcgacctccctccccggttcaagcggtcctaccacctcagccttccaggtagctgggactataggcgcgagccatcacgcccggctaatttttctatttttttgtagagacggggtctatgttgcccaggctggtctgggtctcgggctgaagcgatcctcccgcctcggcctcccaaagtgccggaattacaggcgtgagccaccgcgccggcccgggggaggcttaacgctccgccccttctcctagccccgcccatcccccgaccccgcccacctcacctcgtcccagactggtcctcccaggcggcttctccctctagccccgcccccatagccccgccctctgcagccccctccttggctgtccccgcctcctctcctgcttccccacgtgggcggatacgcgatggccttgtcggtggagaagggcaggtgggttgtgcgcaccaggaagatgagacaggtgaccagcatggcgcccgagtagaggcacagggacaggacaagcagcatgaagaagcggaagttgcggtgaccgatgcagttattgacccacttgcagtggtggtcaaagtcctgggcgacagggagaggggccaggcttgaggacttctcctctggcccaaattccatcaccccaaatcctgaggccctccccctgccttctaggccacctgcccttggcccatgcactggcttccacccccagggagaaactgagccacagaatgcctcatgctggcatttcccttgttagagcacagttaggactctggtatatacggtcacctgtcagaagacctttagagagaagactggcctggccttctgtgagacacatcctactgtaactctgggcagaacgtaaaccatctctggacctccactttctcatccattcgatgaagatgacagtaacagtaacacccttgcccagccagcctcctgcacttgtaaacctatgcaagccgtgctctcgagagagatggtcactcagagccaggagaccctccaacttggacacccaggcgaggacaggcaaggcctcccagaccaggcgggcagccagcctgaggggcttgggtatctcgtgttagcgagcccaggggtgggacagagggctgcctctcctcccctggcctgacccagcccaggacagatgcggatgccctgtgcatgtcagcacctctgcaggcaacggccagcctcccaggacaggtgcaggtggagaacacatgagtgaccaagggtggctgggagttactgccacccttggcctttagcagtcctgaaaacagcttcacacccagccctggcccctgtatgagggaggctcctggtcccagccagatgtggggcgatggctggtggacaggtagaggggcactcacctccacacagatgttgcaccaggggcagtggtaagtccggggcgggcggtggaagcagcactttggacaccattgcaggcggaaggccccgtggttcacccacaccacgtgcaccgtcaaggggccctgctcagcggagcctggcgtgggaagaggattgggcacagcagaaggccctgcggtcaccccgcggcgggggcagctccacggcatcacagggcacaaggaagggtggggacaaggtgggcaggggaacccctgtccccactgagcaagctgtccaagctcagagaggatggcagtcaaagggaagacgggtttccagccaggagagttttgtatgaaactcaggcgtttggaacagtgagtgctgctttgagtgtcattgtgtagtgaagggaggaagtgcatacagtggtttggaagagcccactggcttctggccctggcctgcccggtcctcccatctaaggcaactgggaaacctcaacaattctgtttttccacaccttggtggcttaagaaacggggtagggccgggcgcgggggctcacgcctgtaatcccagcactttgggaggccgaggtgggctgatcatgaggtcaggagttcgagaccagcctggccaatatggtgaaaccccatctctactaaaaatacaaaaaattagctgggcgtggtagcatgctcctgtagccccagctacttgggaggctgaggcagacgaatcgcttgaacctgggaggtggagcttgcagtgagcggagattgcgccactgcactcccgcctgggcagcaaagcgagactctgtctcaacaaaaagaaaaggaaagagagaaagaaagaagaaaggaaagaaggaaagaaagaaagaaaaagaaagaaagaaaagagaaagaaagaaagaaagaaggaaggaaggaaagagagaggaagaaaggaaagaaggaaagaaagaaagaaagaaaagagaaagaaagaaagaaggaaggaaggaaagagagaggaaggaaggaaagaaagagggagagagagaggaaggaaggaaagaaagaaagagaaagaaagaaagaaaagagaagagaagaaagagtgagcgagggccagagcaatgaagacgtggggtgaaggggtccagaggctggaggagggtcagtaggaagagcactttaggaatcccccctgcaggttcccagcccttgagtgacacctccttttcccagggggctgatgcctcaccttgatgtaagatgccagggtctgagaagttgagtgaaacaagactgaagaaggtaaggacaaagagggagcctgtgataacaggaaaggcccactccccgttctgagccagccacctgcaactgagaccagaggcaggctcggtcctgagcaggggcagcccaaagcccccggcccaaggcctgtggcttgctcaggtcaggacccacagaccttcaagccagatctaaaaatccaggctccaaatacccaggcagactcataatggctccaccaaatgtcaccagcatgaccagccacccaaagctcccaaaatgcacaggcacccttgacctctgcgcctttgcacgtcggttcctggaacagaatatccccttttccctgcccgcacccttgacctctgcacctttgcacgtcggttccctcgaacagaatatccccttttccctgacctctcccccggtcttctgcactcccctgcctccatcctatcatcttctgtttccctggctgtctctttgtgggaaacctaacggcttgcctggaaaactcacgggaatgcgaagaagaggccactgaaaaagaccagcagcaccacattgaaggcagcaaagaggctagggaggaaccagggacgtgggaccagaggcaggggatggggctccttcaccagcggcgtggcatccgttaagagtgtcatggctgggcctccttcgcctccaggggaggtcagagccaccaggcttcctcccccagcccagcttccagagctccatggccacggcagcctcagagccgcagcccagggtgaaaggaaagaaggcccagtgtgacatcacagaggctgggggacctcagcagaactgtctgcagccctgctctagctgcctccggtgacaggcacttccaacagcaaaccccacccccaccccgacatgtgctggggaaccgggagttcctgcccctgagaggctgatgttgttggagaaaatatgacctggagaaacacatgggaagaaagttggtaattttcagccggcgctgtaatccctgtaatcccagcactgtgggagaccgaggcaggcagatcactcgaggtcaggagttcgagaccagcctggccaacatggtgaaaccccatctccactaaacatacaaaactagccaggagtggtggtgcacgcctgtagtcccagctactcagaaggctgaggcaggagaatcacttgaacctggaaggtggacgttgcagcgagccaagatcgcgccattgcactccaacctgggtggcagagtaaactccatctcaaaaaaaaaaaaaaaaaaagaaagaaagttgctgggtttttttgttggtttgttttgtttgtttgtttgtttttgagatagtttcgctcttgttgcccaggctggagtgtaatggcgcaatctcggctcactgcaacctctgcctcctgggttcaagcggttctcctgcctcagcctcccaagtagctgggattacaggcatgcatcaccatgcccggctcattttgtattttgtagtagagacggggtttagtcatgttggccaggctggtctcgaactcctgaccacaggtgatccacccacctcagcctcctaaagtgctgggattacaagcatgagccatattaaacttcctttataaaaggcctcaaaaagaagaaactgaggcagaaatttaaaaataaatatgcattcattcactccaagacaagtaacaagcaaggcaaaagttaaaaagaaaagaacaagttttcctctgcccagcaagctcacttcaaggacagttataagataacgctgtttaagaggccaaggccaaaagaataagctccagacacccctcgcctccagagcaaagttgaagaaaaaaaagaaagacaaattctttgactgttactcctttcccaggtttcttaagcatgattatgttttacaaatgtctgtatttagccagttcttgtttttctttcaatgcagctacaaagtcaccagctatgcaaggccacaagttatgctatagatgatgtgacctgtcatatgattaactacttttatttattggaagtctgcttataaaaaccccgctctgtctttgttcgatgctcagctttttagatgacagtccactaagccagtgcgtacctgaaataaacagtcctctcgttctctgtctcagtcttgccagtcctcagtttcctgcaacatctctactaaaaatacaaaaattagccaggtgtggtggtgcgcacctgtaatcccagctactcgggagcctgaggcacgagaatcgcttgaacctgggaggcggaggttgcagtgagccgagatctcaccattgcactccagcctgggaaacaagagtgaaactatgtctcaaaaacacagaataaaagaaaagaaaagattatgcaaaatggaagaaactaggcacaaaaagccacatattgtatggttccacttacatgaaatatccagagtagccaaatccatagagatcaaaagcagattcacagttgccagggtgtgggaggagggggactggaagagatgaggtttgttgttgttgttttgagactgagtctcactctgtcgcccgggctggagtgcaatggcaccatctcagctcactgcaatctctgcctcccgggttcaagcaattctcttgcctcagcctcccaagtagctaggattataggcacctgccaccatgcccagctaattttttttttgtagttttagtagagacggagtttcaccatgttggccagcctggtctcgaactcctgacctcaggtgatccacccacctcagcctcccaaagtacgggcattacaggagtgagccactgcactcggcctaatttttgtatttttaagagatggggtttcaccatgttggtcaggctggtctcgaattcctgacctcaagtgagccacctgcctcggcctcacaaagtgctgggattacaggtgtgagccacggcgcccagcctcttttttgatttttcaaaactgactctcatattaaggaagccaaaacttaagtgataactgaaatgatcgtgttactgaccacaggttctttaggctccgataaaaattgacacgaggccaagcaaatttcccagacaaggctttattaggggcttccgttccaccacgggggagacagcaccgcagggagaggtctccggctggctccccaggggactgcgttgtggcgtctcgaggagggcgacacgcgtaattcatgaggtaggtgagcgtccctgcaggagtgacagaacgcacagggatagttaggaatcgcggtaacacatacatcgcaggatcagaacacgacgagaaagcctctccctggcagaggcttttgttttgtttctgtctgtcacccagtctggagtgcagtgacaagatctcggctccctgcaacctccgcctcccaggttcaagcgattctcgtgcctcagcctcccgagtagctgggattacaccaccacacctggctaatttttgtatttttagtagagacggggtttcaccttgttggccaggctggtctcaaactcctgacacctcaggtgatccgtccgcttcggcctcccaaagtgctgggattccaggtgagagctgccgcgccgaggcagaggtcttggtcttgtaatgaggccgagggtaaagagtggtcgtgcttccggcttcctgcacacaaaggcaatggagttcattccctgaagtacaagattggaagtgcgacgctgcctatcttcatttttcaaggtcgtgtgatcagtggatgtggcattttgtgtaagatttacagtggaatgctgcttatcttaatgctttcactgtccttcaatgagcaggtaagaaaaaaaaaggaagaaagaaaaatgttgggggggggaatgcattagcgaatgcattagtggagttggcagccgagtcccatccctcctctgtctcaataagtgtcagatgatgctatcatataattttgtgggaaaaaataggccaaagaaatgaaattcagaaggacttattctttttggttctaaaatcagtttctgagagctggcaggccccaactgccaagaggagaccctggcggccacagctcatcctctctgaccaagccttagctggggatgggccggcctccaggcagggcctcccgctggctggatcccgggccacactgtacagaagacaaccccgtagagaccttgggtggggcagaagcccccttccctcactgacaccctgccggtctctcctggggtctcccagtctctgctgcccagtggggaagcacccgtctcagcccaaccgcagccccccccggctccctcctgccctttcacctttcctgccattccccactgtgtcctgaagtttctaagaacatccccagcgccctgttgtcagctctgggaagtctaaagttcagggctttgggtaattaaacccaaggcctctcagtgggctgggggtgaatgacctggcgaacgtgcctgcggagatgctgggaggaagctgagtcagtctgcgtctttgtcagggtgggctgaggccagtgaccctctgggggtcagggcccttgcaggcctcttccttccctgacctccaccttaggaggcagctggcccctgagacgcctgcctcacgacattgtcctgtcccaggaactggactttaggaggaggggaagctggagggggatgcagcttgactcttgggagagactttgaggtgtctgggcacaggagtggggagtcctccgggtaccccatcagggactgcttccactgcttgtatggcctcaccagcccagcgcaggaagccccctctcccttcccagaattgaccctctgcaccctctcctgggccctcttctcactacctccatctccaccatgccccaacagagcccctcccccaggcccctttggccgctctccacaccccacagctttctgtctgacctggtttcttagcctctctggacctcagcctccttatctgtaaaatgggaataaggatactacttcccttgtaacgcggtggtaaagtttaaataagctaaggaacacactgcatgtcctgcgggccctggcacaccagacatgctgacagacgctggctgctttcatcagctatgcaaccaaattctaaggggcccttcgtatgtgtcaggctgcgtgccaggaacctagaggtaccaccgtaccacagtacaagatgctgtgtctggcttcgaagagatttcagtctatgtggagagagagaaaagggaagctatcagccaataaaatcgtttgcaagcctgtaattcagcaggttttcaagacctgtcaaatgcccagcaatctcactctgcaactctgcctcttaaatacagcatcttccggcccagcgtgggggtggctaagcccatcatccagatgtgatgaactggggtctgggaaacccacaccggcctcatctggcttttccagcctgtcctcccttccacacatcaggctgacagcaccaaacacggccgaggcctcagccctgagtctccccgctgcagagtgcccaagcctgagttccagcaggttcttcaggggccgctgaccagggaacactgcggtgaggagcgaggacttcgtccccaccccggcccagggcaggggcttcgtggtgagcccaccccaccccagaaggctcctggaagggcagggcagactggcagcaaaatcctataggatgggccgggccagaggcaaggggtggccaaaggcacctgtccaagaggtgggagggaccacacctgggggcagggacgagtcaggcacagggaactccgccagcctagaggatcaaattcctccggggtgaactctgagatagaaagttggcccgggaagctcaaggagggagagcggcagaggggaagactctgcaattctgcttgccccccaccccggcccaggcaagccaccctgcccccggcccccacctgcccgccccgcctgcccttcctcaccccggtgcctgcgggattgctggagagaacgcggcgatggagccgggcaggacccagataaagcttgaccccaggtaagtgagggcggcgggccctgggccagtcgctgggcagcggtggcccctatcccgcggcctgtcctctctccctcccagagccctttggcggccgcactcagaatgagacaggactggaaatgctctagctgttcctaggtcctcagggacaacgtgggtttgggccagggtgtgacactccagggcctcggccttgccccccagcgtggggagagaaaggtcgcagagcgggggctgtggaaggcattcgcagaggaaatggcagcatccctcagcagcagggggcccgtccgtctgtaaggactcacccttcctctgggatcctgctcttcctctctggtcagtccctgggctgctgcccgacccgcatggagagaatccacggtgggctcttcaggcacggcagccaggcacagcctggctaggtggcagcttgtcttactcccccacctgggccagttctccactccctctaagaaaagggccctgaggccgggcgcctgtaatcccagcactttgggaggctgaggcgggagtccaggagtttaagcccagttccagtttgagtcctggagttcgagaccagtgtctgagcaacatggcgaaatcctgtctctaccaaaaatataaaaaattagccgggcctggtggcgtgcacctgtagtcccagcttactcatggggatgggggttgagtagatcacttgagcccaggaggtcaaggctgcctgtatgagccaagacagaccactgcactccagcctggacaacagagcaagaccctgtctcaaaaagaaaaaaaaagaaagaaaaaggaaggaaggaaggaaggaaagagaaggggaaggaagagagaaagagaaagagagagcagaaggaaggaaggaaggagaaggggaaggggaagggagagagaaagagaaagagagagtgaaaggaaggaaggaaggaaagaaagaaagagagagaaagaggccctgaggggaaatggacaaagtcctgcactcaggagtggttgagggtccagtgtgcaaccctcccccttcccccagcccccatggttctgagcacaggctggtgtctcgccaggtacacagcagatcttctggaggtgctgaagaccaattacggcatcccctccgcctgcttctctcagcctcccacagcagcccaactcctgagaggtgagtggggaccctcctcagagggaactgagaggagggaaaccaggatagctgagtggagctggggagaggcggccctgagctggtgcacctgggcagccggggagaataactggcccggtgtctgtcatcgtggttaaggctctggagaagggcaatgcctcaaggagtcagtgggtcaaaagggtagcatgagagcctggctccggagagcaaccgtcatgttgggcctccacaaaactggcctcaaagctcattcaaactgcggacactgcgacctggggcgctttttcagaccccagagccatctggggacccaagatggtgcccaagtggtccaagccccatcgggtctcctggagggctgcacggcatccgccctggacccatgtcactctagagggtggttacggtgagtgacgtgcttcacacaggtgaaccagttgtatttgttttacgatccagcctttctgaaaaacctttgtcctcactggagcattctgttgtcgggtttttgtgtgtgtgtttgtgggtatttgcctcattccacccctgagctctcaggtggacagatgggattcaaaaacctgttctacagtgtttattgtagtggagtaatttgtttgcaataataagtcataattgtccactgaaggggagggtgtggggatccccgaggccagctcaagttcagctgttggaagaattccttgactggaaattttacctttgcgttttgtcgctctgtttcctgaagataacttggggtgctcctggtcgtccatctactgctttgattccttggatcccacccattctttcactttaagaaaaaacaagtaattgttgcagaggtctctgttttgcagcttcccttttgcaagaagcactttttccaaataaaacagtaattaaaaaaaaaaaaacataggtgaacctgcaaaagtcctcgcagtgttggccaacaagattctattactgaattacttttgaaagtgaaaggcattggctgggagcggtggctcacgcctgtaatccctgcactttgggaggccgaggcaggtggatcacttgaagccagaagttggagaccagcctggccaacatggtgaaaccccgtctctactgaaaatacaaaaattagccaggcgtggtggcgggcacctgtaatcccagctactcgggaggctgaggcaggagagttgcttgaactcgggaggcggaggttgcagtgagccgagatcacgccactgcactgcagcctgggcaacagagtgagtgagactccgtctcaaaaataaaagaaaaaaaaggaaaagaaaaagaaagtgaaaggcataggatggggctcagcttattccccggacaccaaaaacattgagaatcacggcccgagcatgcttagagaaaatgtgactcacgcctgcgttttattttgttttcctgctgcatactgactacctctgaaatgttggatacaagtctgtgtctctgtagcacatttaacacgtttcccaggcaacaggaagctctcagtgtgcgttctgttgcagacgtgggcgtgtccttgggctgtgtagggcttcatttcagatgatctgaaccagagcggttgccaactgccagtgtccggagatgcctggtggccactctgtggttagtggcagtaggtggctgctacatctagttccagtgaacctcctgttgagagagtgcagctggtggtacaagccttcccttacacagcagctgtccccccagggaatatttggcagtgtcgggagacttccggttgccacactggaaggtgctactggcatctcgtggtcagaggccaggaaagctgctaaacttcctacagggcacgggaagagcccccacagaaaagattattcaggccaaagtgtcaatagtgctcaggttgagaaaccttgcctcacgcaatgaaaacggttctcacattgctttgcttcagaatgtgcaaacggaaaccccaaggctgttcagaacaggccattctgagtctgctagtccagcaagcctcgccgcaggcagagtggggaggatttggccagcgggccctcctgggacagggaagctgcgaggatgagttcggggacgccccaggcccaggggagcgaggtctggcaggattcaaggatcctggtggaagagcaggggacaattgagagggccgggcaggagaggtgaggcccgctgcgcgccgggctggcggaggagctgtgctttatcccgcagcgagaaggagctcgtgaaggctctgaggctgggagtggctggatgaaagtcgtgcttctcggccattcgttagtaatcaggatggactgcagaggaagaggcttaagaagcagggatgcggccggacaccgtggctcatgcctgtaatcccagcactttgggaggccgaggcaggcggatcatctgcggtcaagagttcaagatcagcctggccaatgtggtgaaatcctgtctctactgaaaatacaaaaattagccaggtgtggtggcgcgtgcctgtaatcccagctactcaggaggctgaggcaggagaatcgcttgaacccgggaggcagaggttgcagtgagccgagatctcaccattgcactccagcctgggtgacagaacaagactccgtctcaacaacagcaaaaaataggcagggatgtaaatgagaggtcgttgccccggcctgccatgcgggaaaagagtctgaggcagggcagtggcagggaaagaagaggaagggttgggaaacaggcagttcaaagaaagagcaggcaatctaggaaagacctaggcgtgtaagtgctggttctgggcaatggtgacggcacagccagaaataggagaagcaggaagaagtgcctctgggaggctgtggcgaaactccttcctcgcttcatttgtaaactttgttgttccttaatttttctttttttttttttttttgagacagggtctcactgtgtcactcaggctggagtgcagtggtgcgatctcggcttaccccaaccctccacctgctgggctcaggtgatcctcccacctcagcctccctagtagctggggaccacaggcacatgccaccaagcccagctaatttttgtatttttttgtagaggtggagtttctccatgttgcccaggctggtctcgaacttaaaattaaatgctaagaaaactatttcaggccagtcacggtggcccatgctgcaaccccaggaggtcgaggttgcagtgagctatgattgcaccaccagcctcagcctgggcaacagaccgaaaccctgtctcaatttaaaaaaaagagagagagaaaaaaaagctattattctagaagaatgattgaatcaattttttttttttaattttaaaatcacggctcacggcagctcgagctctgggctcaagtgatcctcccacctcatcctctcgagtagctgggactgcaggcacacaccaccatgcctgggctaactttcaatttttgtagagacagagtctgacttcgttgcccaggctgatctcaaacgctccagctcaagcgatcctcctgcctcggcctcctgaagggctgggattacaggcgtgaatcactgcgcccggccttaaagctactttttattgaacaaatactacacgccaggtgctttgctaagaagcttaaggagaggataagtaacctgtctatggccatagagctattagtaagtggcattttactttgtttttgtttgtttgtttgtttggtttggttttttgttttttttttttaagagacagagtctcgctctgtcccccaggctggagtgcagtggtgtgatctcagctcactacaagctccgcctcccaggttcacgccattctcctgcctcagcctcccgagtagctgggactacaggcgcccgccaccacacccggctaattttttgtatattttttagtagagacggggtttcaccgtgttagtcaggatggtctcgatctcctgacctcgtgatccgcccgcctcggcctcccaatgtgctgggatgacaggcgtgagcccccccgcccggcctggcattttgctttgaactcaagtgtctgactccagtgctctacactgtgctcctaagctactggaagcaaatatgcaagcatggaaataatttttggttagaaagctgggattatgggtgattactcttttttcaaattcttatttaatgttcctgttttcattattttaaaaagtagtctttgctattccagagacagtgggaaatttaatagttgctataagtatgattatattcaaaatggtcaactagacaagcatttcccaaagtctcagactcttaatcccaaggagtccttcatggaaacagagttctgtaggaagttaagttttgtgaccaggcacggtggctcacacctgtaatcccagcactttgggaggccgaggcgggtggatcacttgaggtcaggagtttgagaccagcctgcccaacatggtgaaaccctatctctacttaaaatacaaaaattagctgggcatggtggtgggtacctgtaatcccagctacctgggaggcggaggcagaagaattgcttggatccacgaggcggagcttgcagtaagccgagatcgcgccactgcaccccagcctggcgacagagtaaggctccatctcaaaaaaaaaaaaaaagttaagttttgtaaaaggtgcgttctagaccctccttttggaaatttacaatgtaaattagcagattaaaaatgtcagtatgctctgcaggaatcatcacatttaaccttaatgcatttccaaaaattcttcagctgtggaatacttttgtcccatagtgtctatttagatgcccttttggggaaattgagtttaaccagcaaagaagaggccatctcctaagaagatagtttgatggacagacccagtatcgggctatggatgctaaggaacttttcctttcctaattagagtaccaaaggcaacagttagaagacactgcaaaaccatttgtgttgaacagtcagaatctgccccaccctcaccttcataaatggaacggccctcccagggttgcctttgatgatctctcccatatccacgagtacacacacctggagtcactgtgtgtcatggttaataagagtgtgggcttagtcacgaatacctgcgtttaaatctctgctccttcacttccaggctgtgtgaccctgggagatgtgcttccttctctgagcctcgtttcctgaaaaagtctatgaaatgcagatgatgataggaattctcataggttatttctttcattcaacaaatagttacagagccgttactcctccgggcgtttgagaacagagcacaagcttgacaaggtccctgcctccgtggagtgtgcaccacaaggtggagagccgagaataagcgagtaaacagctgtgtaaatacaaatagccctgatgtgggcggaaggaggacataacgttacccggaatggagattttcacggagcagggagcagttagggaaatgaagactgggaaggactgggttggtggcgtgtgaaagggcagtttttacgctctccaagggctgatgagcacacggggctgggggtaagagaggctctagcaatggcccccgcttcccaaccacagaacattggttttggaaaaccacctgcattaatgttggctttttcctatctggactttgcctattgtctgagtttttttaattaaacatttctattataaaaatcattcaggtttagttaaaaaaaaaaaaagaaagaaagaaaatacagaacagtaaaaagagaaaaaaatcatctacagtcccacccagagacaggcacggcaaatatcttagtgtaatttccttttttttaatgccttttttttttttttttttttcagacagagtctggctctgtggcccaggctggagtgcagtggtgtgatctcagctcaatgcaacctccacctcccagttcaagcaattctcctgcctcagcctctccagtaggtgggattacaggtactcgccaccatgcctggctaatttttgtatttttggtagagatggggttccaccatgttggccaggctggtctcaaattcctgacctcaagtgatccacccgcctcggcctcccaaagtgctgggattacaggcatgagccactgtgcctagccctttctctatgtttttatttaacatttgtagaaatcatactattcctaaaattttatgttctgtttttgtaagcatgatacaaaataaatttttcacatcattgtatatttggaaaaatatgttcttttctaaaaaaaggtttatttttgttataaatacatattcattatagaataattggaaaagaaagacactagggattttcacacaccgagaaaaggccatgtggggacacagtagaaacgcggttgtcggctggacccggtggctcacgcctgtaatcccagcactttgggaggccgaggtgggcgggtcagttgaggtcagttcaagaccagcctggccaacatggcgaaaaccgtctctactagctgggcgtggtggcaggtgcctgtaatcccagctacttgggaggctgaggcaggagaatcacttaaacctgggaggtggaggctgcagtaagctaagatcagaccagtgcactccagcctgtgcgacaagagtgaaacttcgttgaaagaagagaagggggcggggcgggggggggaggagatgggaggggaggagaggggaggagaggggagaggggagggaatgggagaggggaggggaggggaggggaggagaggagagttgtctgcaagtggaggagagaggcctcaggagaaatcaaacctgctgacaccttgatcttgaactagcctccaaaactatgagaaaataaatttaagttgtttaatttttaaaaaagtgactactcagaaaagatagaaaaaagtaagtagaaaagaagacacaaatcatccatagtcccatcacccaaacataagcattgctaacttttttcagtattataggtattttcctttttttttttttttcacccaggctggagtgcagcggtgtgatcctggctcactacagccttcacctctcccggagtagctgggaccacaggcaggcgccaccacacccggctaatttctgtatttttagtagaggtggggtttcactatgttggccaggctggtcttggactcctggcctcaagtgatccgcccacctcagcttcccaaagtgctgggactaccagtgtgagccaccgtgcccagccgagggtcagcgtattttttgacaaattcacccatagtcctggttggtcctgtggtgccaccaggtgcgactgaccgagacaagagctccagctcaagtctgtaccgtggccacctttctccctgttttggtttcagcagtcatattgctcccactgagctgccctcatgttccttagtcaccaaaacacagagcagactagctaatcccttcctcgtgctcaccccgcaaggcaacaggacaatgactggagtgtggcagttttctccctttcttcctcttatctagtcaggtagcaggtgcaaaggagggtccaataactagaaaagacacttagataaatgaccacaggttcactaaggacctagaaccctttctttaaaactaacggctgcattaatgaatcacgtttgttcggaaacacatattgtgactatattcatttttttctgttagcaacggtgaggccagatgaggtctaccagtatttgtcaaagtgtctgctatcctccgaccactatcaggtgagcttgttaaaaatgcagatgactgggcccatctcagatctatggacgcacatgtctgaacgtagggcctgggcagctagctgctttttaacaactcccaaaatgactgcaatatccacgaaagtttgaaaaccttggactatagttcatgtaagaccaagcatgaggccagcgtgcgtcaggtgtccttggggtttttatttgatccgtttctcttttgttgaagttctcccctggccgagtgtggtggctcacgtctgtaatcccagcactttgggagaccagggtggaaggactgcttaagcctaggagtttgagaccagtctgggcaacgtagtgagaccccgtctctacagaaaatgttaaaaattagccggccgtggtgggggtgcacacctgtagtcccaggctacttgggaggctgaggttggaggatggtttgaacccggaaggtcaaggttgcagtgagccatgatcacaccactgccctccagcctgggcgacagagtgagaacctgtcctcctccccacaaaaaagttctctgctaatgtcctggtttcaccatataattttggtgaaatcaacttaaacagatccagaatgtcccataaattatattcggcttcaattatgttaattgatctacattcgctagtgcagcacctggcactggagatagaaaagtgaagtggggttgggcacgggggctgaggcctataatcccagcactttgcagggccaaggcgagtggatcacttgaggtgaggagttcgagaccatcctggccaacatggagaaaactatctctactaaaaatataaaaattagccgggcatagtggtgggtgtctgtaatcccagctacttgggaggctgaggcaggagaatcacttaaacccaggagatggaggttgcagtgacccaagttcacaccactgcactccagcctgggcaacagagtgaggctccgtcttaaaaaaaaaaaaaaaagaaaaagaaaaaaaaaagactatttcttaggttgaatactctaggtctaaaaaatcctcattcctgtgcacgggtgggagcctagatccagtaaggcaatttcgatccgaggaacaagcccaggccttctcccgctcagtcccggtcgtcagctctctgccttctcctcctctagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacggtgaggcccccggggctgccctgtggggggaactgaaaagaaggcagagaccaaggtgagaattcctctaaactcagcacgtcacttcggcaaagagtgtcctgccacgacccgcggagggccgaggtttgcaggccgacctccccttgcagttaggatcctctgcttggaaggctgtgcagtgtttgcattctaagggctgcggagacagctggagatctgctcagcccaccagccgcctcatccttgctccccgctacagtgttgccacttgaagagcttccttcagtggttcctcagagtgtgggggaaagtctcattccacagggtcacactcagctccacccttacgctgaggcttttgaaacaccctcccacaggtccttggtttgcttgacttaattagtgctttttccagctggcaacgtttaaggaacgctgcctcgaatgtgtaggttttgcctcctgtgtccttgccgcaaaaggcttccggagcctcagggtctccctcccgccctcacctgctcctgccccttctgagcaggtggtgtctgtgctgtgctgctttggtctctggatccctcgttccctggtgctggtggaaatgaccatcacctcgtgagtgccctgcctcgccccacctccaagggcccctctgctcccgctcaccaggactcgagtccgtgtccttgatcccagctgaccatgtatctggcccttcccagcttgtgctagttccgggctcttgcgctcctggctctgctcagggaatgcctcattttggcatctggcacattcctcagccagccctctgttcccacagtctgaaattccccttctcccagtcctgtgggccgtctcctctccctcgcccctcttgggtcacacacccagaacgcccagccctagctctgctcctcagtaagccccacctctccctgctgtctttctctctggcagcagacctcgtaggccctcttctctccccaccccaggttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggtgaggcggggccaaggtgccttccccaggagccggggagcctctcctggacccctggtccccttcaaggctctgggaattaggcgtgaataggccaaagccagtgacggaagggtgggcatcccacggccaggacccacgggcgccaccctcaggggacaggggagcagaggaaggagagctcctcaattgtcatcactgaacttcactgcaccctgcaagccttagccacacagagaaaactggacttggggccattcgcttgccccttctgcccactttggtgaatgaggttgaggtcacactcccagacctcgctccaaagacggaattcttgtctggaggtgagtgggagaccaagagggttcccagcactctcaacattctgcttttttcctctgtccccatccacttaacctggttggtgtttatgacagcagccgagcctcagcccaggagccctgtgaggagccggggcgtcttcctggggcagggggtttgtgggcccatgttcctaaccctcttccccactcaggaagaagcttcagctgctgatgttgggccctttccaatacgccttcttgaagataacgctgaccctggtgggcctgtttctcgtccccgacggcatctatgacccagcagacgtaagccgggagtaagggacagcacagtccaagactcatttagtacctttgtgttctaaaaggaatcaccagagccaacaccccttgacagagggccccagaaaagggtggctgtgggaaaacagaggctcagggactgccagggagagaaccgcaataggccaggcccccgggctttttcattaccgttcctgccgtgggagaggagagctcaaaggaagcaccaggtgccatgatgcatggctcacgaggccgaggtgggaggattgctcaagagtgggagttcaagaccagcctggacaatatagcgagatgccatttctaaaaatgtttttaaaattaggctggacatggtggctcacacctgtaatcccagcactttgggaggctgaggtgggaggatcacttgaagccaggagtttgcgaccagcttgggcaacatagtgagataccatctctttttttttttttttttgagacggagtttctcttttgtcgcccaggctggagtgcagtagcgcatctcggctcactgcaacctccgcctcccgggtttaagtgattctcctacctcagcctcctgagtagctgggattacaggcatgcaccaccacccccggctaattttgtatttttcatagagatggggtttctccatgttggtcaggctggtcttgaacacctgacctcaggtgatccgcccgcctctgcctcccaaagtgctgggattataggcgtgagccaccacgcctggcccatctctattattaaaaaaaaaaaaaagttagctgggaatggtggtgtgcacctgtagtcccagctactcagaagcctgaggcgaggggatcactggagccaggagtgtgatgctgcagtgagctatcattgcacctctgcactttcagctgggtgacagagtgacaccatctcttgaaagagagagagagagagagagagcttgcctgcctcactgactactttctgttgccaccagatttctgaggggagcacagctctatggatcaacactttccttggcgtgtccacactgctggctctctggaccctgggcatcatttcccgtcaagccaggctacacctgggtgagcagaacatgggagccaaatttgctctgttccaggtaactataccctgggagagaaaagatgtttcataaccgagctacagatagttggggttagtaagtgaggccaataaaggctaaagtgggccgggaatctttttcataagcctcacgtctctcatgagatttggaaaatgattcctgtgcttcccgcttttgtctttctgtgctggaattgtttcccagggctgccatgacaaaataccacaaatcagatggcttaaaacaacagacatgtcttgtctcattgtgctggaggctagaagtccacagcgaaggagccagcagggccctgctccctttgagccctgcagggggtcccagcctctccctagtttcctagttgccagcagtcctggaccatccttgaccagcatttgcgtcactcccatttctgcctccattatctcgttatattctccccttgtgtttctgtgtgtcttctatttttttttttttttttgagacagagtcttggtctgttgcccaggctggagtgcagtggtgccatctcaggttaagcaattctcttgcctcagcctcccaagtagctgggattacaggcatgtaccaccacgcccggctaattttgcatttttagtagagacggggtttcgctatgttggccaggctggtctcaaactcctgacctcaggtgatccacccgcctcagcctcccaaagtattgggattataggcgtgagccactgtgcccctccatctcatctatttttaggacaccagtcaaattggattaagggcccaccctattccattatgacctcatcttaactaattacatttgtaacaaactgttcttaaataaggtcacgagtaccggggggcaggacttcaacatagctttttggggacacaatttaacctgtaacacgtgtgttagttaacaaaccttacatttgtctccttgcttcttcctttccttttctacctatgacttcctaaaatcctataacccatcaacaccagcagaagcattagcattagctacaggacctacctacaccatgtgccgggcactttcacacattacacttcaattttcacaaccccaggagtcatttttcccattttacaaaggaagaaacagacccagagatgttcttgctcaaaggcacataaggaacggggctagaatttatacccaggtatgtcttgactcctccacacatctgtcttctccttaccctgcccttcatcttcacaacgcttctgaaaattctctcaaaggcatgttggcccaccttctacgtgctgccttctctaacctcaaagatgacttttccaccaaatgcaatgacttctaacccagtcttgttctccttctctctccatcctgtctccttgctggtcttctactcccaaggcataatgactgccctacagtttaacagagtgagttcacgtacattctcatttgatctacgtacatgcctcccaaatgtgaacttccaggcacataggaggtagaatgaaaggggctatgggaatagagagagaagtccccggaatgagtcagggactgaaggggcagaaaggttctgggtcccagaagtacttgagaccaggccgaaagataaaagccgtgtgatggccgagcctgcccatggttaatgtgggggagcctgggtgagccacgccagccttgaagaagctgaggtttccacacaatgtactcagggagggcaatactaagataaatggtgcttccagggcttctggacagtgatcttcttcttctccccttttgccttctttatttggtgaaatattgataaaatttgccattaatgattttgaagtgtcaggttctgtggcattaagtacattcccatagttgcactaccattaccaccgtccatctccaggcacccattaaacacattccccattgccctctccctgcagtctctgggatggcagagcttccaaagggcattttaatggttaattgtccattattctaggagcagggacctcaggcacttgagctagatggaatgactcttctctaatcacccatctctttatccattgagtgctcattggtagccatggctgagaaagggaattaaaaatgaaccctttaatcagttcttatatcttgtcagaaactctaataaactactgggtagaaaataagaatgtcatttgcctaaagatgaaaatcccacagatttttaatgaagtgagagcctcaaccctctgtgactgcacagatctgacggtgggtggaacctgcccagcggaagggcaaggcccggcagtgggctggctgcgttctgtgccgtgagggcaggcccagtccacccttgcctctcttttatgttccgcaggttctcctcatcctgactgccctacagccctccatcttctcagtcttggccaacggtgggcagattgcttgttcgcctccctattcctctaaaaccaggtctcaaggtgagcacgttaagcctcctgtcccatcgtgggatggatgagacggggagagtcaggaaagaaggggccccagaacagacattaggccagcctgacttctgctcagagtgttcagaagggatcttcgggaaatcccaacagaggctttaaggaaactatgacctctctgatcacacagaagagaagtgaaaccccacagcttgaggccagccctgagggccaacccaggaagccatgggttcagtcctcagctcctgggagaggaatgggaatggttaaaaaacagaagcccatgttgattgaacacacataagaaatggactgtatgccagcctcagagcacagaagtagacagccaacttccggttctggctctaccattaacccgctgtgttatttatgacaatttcgtatccctaagtcctgatttggggataaactggagaaagtgttgctcaactcccgtgcccgggctgctagtaaaataccacctctgtaactcagcataacctacgctgtatttcaccctacactgcagtgatgaattgccacctcctcatactggagacttttctaatgactgtgctgacacgaatgtactaccgaaggaaagaccacaaggttgggtatgaaactttctcttctccagacctggacttgaacctcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttagaataaaattgctttggatcttgcctggaaggtgttttaagttttgtaataaacaagatgatgtctgaaaatgtgtaactgggcaccttgcctctgtccatgtcactattaacccttcaaggttgtatattgctggctaggtgcgacagctcatgcctgctatcccagcactttgggagcctgaggcgggaggatcacttgagcccaggaggttgaggctgcagtgagcaatggttgtgccatacactccagcctgggtgatacagccagaccctgcctctggaaaaaaaagaaagcttactgagctttcctaaagcagatgaaaagaagagtatatagtattgtgtctggcataagaaaaggagaacttggtgaggtgaaatagcaccagcccagagtcttgaagaagccaggggccctggagaacagatggaaggtgacctttccctgacaggtgtgctactacggcaccaaccacgcggggccctggtggtctgggtcagcctcactttgtgggacaatggcttttgagtcttcagtgacaagctagaaaaggaatctcctgacactgtggtcatggagcttgatttctaaggagagagtcagcacgtggaagcaaaggcaccgagagtccaagtaaaagtcccaaatccataaaatgcaccacacaggtcaaaacacaggacacggccgggcgcgggggctcacgcctgtaatcccagcactttgggaggccgaggcaggtggctcacctgaggtcaggaattcgagaccagcctgctcaacatggagaaaccccatctctactaaaaacactaattagccaggcgtggtggcgcatgcctgtaatcccagctacttggcaggctgaagcaggagaatcgcttgaacctgggaggcggaggctgcagtgagccgagattgcgccactgcactccagcctgggcaagaagagcaaaactccgtctcaaaaaaaataaaaataaaaaataaaaacaccactggacatggaacatcaggtaaaaccacactgcctttatttggctaaagaacaaaatccaaaataactcagaacaaactaagaacagacaggaaaattacagactgaaccccacttgaggaagacttccccacggactcacactggtgatggggcgaacgttcaagacgaagccagcagtcctttccaagactcttttgtcttttagggatcctcaatacaaaacaacccaactaatccaggatatgtgttcaaaacagtcagttttccccctcaaaaggcgggaaggcccacttcaaacctccaggaacacaacccaagtcatcccagtgttaaacctggtgcttccgttttctgcctcaatccgagcgctaacataaaatcttggcagacaacaatctttcttcttcaagaaaattaacatttaatggtataatcccaagaacatgttctacttatttacttggaaaaatagaagctagggaccactctttatccgatggcagtctattctatgagagaaaacaagaacaatcattgttatgactttgaaaaatagaacctttaaaaatacttatattggtaagcttaaaaaaatatcatcagttaaaaacattaagggggctttctttttctacctgtattggttcaacttctggtgagaatgtgtgctgatagaaaatctagaagctatggcttttagggaattaaagaaaagcagcaaaatataattgatttggaaagattttggataagtgatctggaacaggattaaaaaggcaaagagctcttgaaaataagctacccatagtcaaaataatccaggaagggggaatgacgccctatgaaccactgtggaaagaacatctagagatggtctgaccagctgtgcagcctccaaaaaaaaatcactatcgctcaggtgcagccccccaaaaaccaccatcactcaggtacagcctccaaaaacaccaccatcactcaggtgcagcctaaggagtcatcagtgatcagaaagtggctaagtttccttagcctccctcatattttttctcttcttcaggattttcaacctcctcacatccctaactttcttacccaagcctcagcaatataatggtctttggctctagctatcagcaatagctgcaagagcacaaatgatcccttcctagtcctctaaagtgtcaacctccattcttcagtgcttctgaatctagcataagaccaagctttccgtccggcccaccggaaggcagtggctgcgccggcacctccccggctctggccttctaatgtctcacacacagaggctctgctctaaggccaacacttctggctctctcatcttggccacatttggcccacccatgttgactgctttctcgtgtgtgattcagggaaacagctccatagcctcaaacgttaatatctgaagatttagatcccaggcattgtggtggtgtgcacacctctaacctcatttaattaggcacagatgaccacattatgcaacttcccaacagctttctccatctacccgtgctagtccagcacctcagaccacatttaccccaaagtatctaacaggccacactataaaagattttagctttcagtcagacaaatagctttcagtcaaaacgattagactgaggtggtagaagctcaccaaaaggggaaagggagtttcccaataacatgtacgtttgctggccctagcagtctcagaggcctgtcagcctgcaggtcccgttccaagcacagggcatgccaagagcagcccactgagagcagaggaagagggctcaaacatttgggacccagacaatatatttaggaggtatggctccaatagggagggaggaggaaaaccacgttccgggcatctccctgtctatccaaatacacttgcataatgtgcacttggaggaaccaagcagatgggcttcagcacagacttcactgccacaccacaccagggagaataagttagacagaaacaggcagcattcccaaagagagaaggctgacgcagaaaagttcaaagatgagactatgtaacactgggtaacacaggaaaacactaacttcagctgtttcaaagacagacaggattccaagccaaagcttgtatgaccagatttaagagtaagaactgcgcttcaaagaagagttagaaatgtcgttgtcataggcgatcaggataacaagaggcttcattctccctcgcctctgtgacgctctttctgggtgatccaagttttgttttttttctagttgattatttctctttatttctgtatgtgtgtgtggtttttgttttgttttggagacagagtctcgctctgtcacccaggctggactgcagcggcaccatctctgctcactgcaacctccgcctcctgggttcaagggattctcctgcctcagcctcccaagtagctgggattacaggtgcccaccaccacgcctggctaatttttgtatttttagtagagatggggtttcaccacgttggtcaggctggtctcaaactcgtggcctcaagtgatccaccagcctcagtctcccaaagtgctgagatgacaggcgtgagccaccacgccttgcctgggtgatccaagttttaagaaccaaggtagtcctgctgtgcaggcaatgattctagcctctgaccctcaggcggaaaactaggtgttaccagaaagtgtttagggagtggactatgagatgctcacagtcctagcagaggcaaggaaagagaaaatgtggttttcttagctgaaaacactaaaattccacccccacaaggggtatttatgagtgacaggggtggggcctggacataagcaattttcccctggatctagccacaggattactgatgggtgatgatctgctaggccgcgtagctaagcagctaaggagacaggaggccagggctttaaaagttagagcatgctcaacagcaagtgctaagcattagcattctttgatttgaaagtcaagtgttgaatccccccgggcaagccaacaaggcagatggaaccacaaccaccaggcgtgtgtgaaaagtggggagaaaacctaccacactcttgtcacgtgagggtatgctctgtggcttgctggaggagcagcagagggaggtccctgccagctgcagctctcagaggaaaagaaagatgtggagcactggttccagggaagaatgttctgaagagggacagaggtcaaggtgataaggctgttgctttagaaaggaaggtgtttcctatgcttttgcctttacattctgtgcaaatctctctaatatggctatgaccaaaatggattaacatcaagttccaacagcagacatttacaaagtatcctttgtaaaaggctaggtaatattaatagcattcaaataggagtagcagggccaggcacttactcccagtaggaaactaatctcaatcgacttggtataggattgagtattgtcccgctcctctcctcatcattgtaactctaaaagtgttccttccttcgaaggtagatggcacgaaagagactgacaaaagctcccaaagaactgggtcacagagttttctgagaagatgaacacagcagaaacactgcagttgatgccatgggtctgcttccatccccatcagtgtcttcatggaccccattgggtccaacaagaaactcctcagggagtaagaaaagttaggttcagatctccttcccgcagccacaatgacactggtgacagcagtacgttcaggggatttgtgactgtaactctgcttttcgcttttccttaaggaaatcaaaattaagatatttctccacaaattacccatcagcgtggctcatttcgtgaaggacttggcaagccacatagcttcagaacggaaggcaaatgctatagtataccgggaagaaaaggcctctgcgtattacactacctccttcttctgcccactcctcaggggcaaaaaattagttctacatttgaaagacgaattttttaaaaaattaatgaaaatgacaatttccctgttgagatcacgtgaacataaacagtgaaacaaagcccttgggggggggtaaatggatgcagagcaggcttctaaggtgcagtccccctccttcgtgtgggtgagtgatgtcacttgcaggacaggctgtttgggttcccccagtcctaggtcttctttccccagttgtctttcctttgtagctgtccttaggtttagtgttggggtcacaatttggaattcaacagagagcttctgaaggtaatgggacagaaagggaggacaggaaaggagggaggaaacattagtcttcttcatcctcactgatatcataggctgcagccttgtgcctggagagatttgctggggagcaaggtggggaagtcttgccggagaagggccatcggaaagagggggagggggagcgctcgcgagtagggctgctgctggggctctgcttcgggctgatggcctgcagcatccggcccttcccctctttcagcatatgtttctgcagaaaccgaaaggaagagtcagaaaaacaccgtggatcctacttaatcatcactgaagcatctaggactgggatagtctatgctgtactatttatttaagggttctcccctgctgtcatcacccgggaaattccccattcttcctcaataatctagtctaggattattctaatttatccaaacaccttcacagacagatccttcctgatatctaacctaggactcacttgctcaatcttttatttggttgaaaagactgctactcctcaaagacagaattcccaccttacctggggttcctgctgcagctacttgtagtggaggctgctttctttttattgttctttattctttcctttccttctatctaaaatcataccacagataaaagctgggcaaggcgacttgcttatcttgtcaccagactttaaggttgagagagagctggcaaaattatctaggagaatgtgtaacgtctttctgtaaaggtttcaaaaaccttgctggggacagttgaaagatagttctgcccagataaggggatagactagataacttctcagtgtcgatgccccttcctgctcaatgattctgtcattctttccacaacatggaactccctacattgtccagtgggaaagaacataccagtgctccttccggaccaaacatttccagaaaacttccaatgaattctcgggacttctcctcccacttctgaatgaggtcaatgcttttttcctccaccttctgaacaaattcttttgacttttcctccacatctttcactttcttctttactttgtcaaccctctcctgcaagtggtatttcttctcctagataaagaaataactcttctgagaaataatgctcatcctaaacttctctaccataagagaacgaaaaaacatggctcaagcactcaattgacactgttttcagtctagaattttgctttgctttaatctaccccactctcagcataataacagataagatatgctgtggatgcacacacaagaagtggtaattctaatattgtgggcatttgggaataaactaaaaatataggctatacccagtaacaggcacgtagccaaataaagtcagagttttaaagataaaacataaacttggaacataaacatgcgcagcatggcccgaacctcattccagacggagatacagaggcagctaaaagatcactgcacaatactgccaagaataaactaattacaatagattgaaagagaaaatactagatcttttacttaattaatctgcttattgtactggatttttcccctctatcactggcttattctattattttaaatgaattgtgttttttgctttttgttcctttagtattttaaggtccatttactcatttgcaaaatgatgatactcgttggtcttaccaactttgctaaagataaggaaaatggtataaaccctccggtggaagggaagggagtatttagtcaaatgagaagtatccttggccaggcacagtggctcatgcctgtaataccagcactttgggaagccgaagtgggaggactgcttgaggccaggaactcgagagcagcctggacaacatagcaagacctcatctctactaaaaataaaaatataaaaaataagctgggtatggtggcctgtgcctgtagtcccagctactcaggaggctgagatgggaggagcacttgagcccggaggtcaaggctgcagtaagccaagattgcgccactgtactctggcctggatgactgagtgtgactctatctcaaaaaaagaaaaagaaaagtactctcaaaatttccagatcataaagagaaaagggattatgtttagaatttttaaacacctgatttttatgggaaaaataaagctatagtaagtaaattaacaagagctagggtttatctgcctagataaatcatatttagatgtaatcattttatccattcttatagcacaatttacagagatgggagtaggtcagggagcatggtaaactggttatgtagaagacattaaagttagcagctttcttctttttaaatcgattttattgaggtctaatttacatacaaaatgtatagtgttggctggatacggtggctcatgcctgtaatcccagcactttgcgaggccaagggggtccgatcgcttgaggccaggagtttgagaccagcctggcaaacatggcaaaaccccatctctgctaaaaaaaaaaaaaaaaaaaaaaaaaaaaaaaattagccaggcctggtggcacatgcctgtaatcacagctattcaggaggctaaggcaccaggagacagaggctgcagtgagccgagatcacgccactgcactccagcctcggtgacagagcgagaccctgtctcaaaaagaaagaaacactacatatatatatatttgcatgaatttttttagtttttttgtttgtctgtttgtttagagatggggtctcgctatgttgcccccagactggtctcaaactcctggcctcaagcagtcctcccgcctcagcctcccaaagtacaggcatgaactaccatgcccagaaaaatatatagagtttctaaaaggcaatattaagctaagataaacttaactttcgtcaatccaaatttaaaactcaggtctgtgtgggaagtggtgtgtcgggtgtcactatccacacgaggagggctcatagcctttcgcaggttcccaagacatcatccaaccgaagaagagagaggaagtttaagagacaccgttttccatttattgacagaaatactgcactatataaattactcatttatttagttggctgtatggctttatacgaatgtgttggtaccagaccgtaacggcagaaactgtctgtttcattctttttgtgaacagttaacatagtggtaattcattcactgaacttttgggagtgatcatcaaagccaactgcaaagccagttcagctgagatggagtgggaggtgatatgtctcctacagagtcagggaactctggggtaaggctggaactcacgttgataaagctgacattgagctcctttgctgtgtagcccctctgcaggttccgcctcgcatacacatcataatcccgcacaattcgggtgatgatgtctgatgtggagataccttctgtcctctgtgttggagcaaacatgcctaactcagaaacacatacagacaaacactgtgaggttctggttagctcaggtattaagactaaatggaaattgggggcaacattcctttcctttcctcaaaaagcagaatctgttattactaaatgaaactgaaagatactgatatacagaaggtagaccgaatcaaaggccagaggtaaggcaaagaagagttacatagccctaatattaagaaaaatatgagaaagggtttcctgaaattaagagagatatccaaagtagatgtttagaccaagaattgatggatgtcatgaactgacgacaaagaattgatgggtgctatgctcatctttaccttttatccaaaatgtggcctgaaagaggatgttgaatttctaatgtacacattttcctctgtaaagcagcaacatggctgaacatctgcagctgccctgagatcccctacagtgaggaagcacagctcactcacctgcctccttgatgtgcttataaacatcatcactgccagcagatgaataaggaatatcatcatgggctacaaaatcaatctgaaaataaggaaacatcattaaaacccatgataactgccattcagaaagacccagtcaatgttctcaggcccagaaaaaggacaataggcagaggccaggcctcagtggacttcatatctctctttgctttgctcataaattctacaatctattcacaaaccacccaacctaatgatttatggagtatacatatgaagttagccagctgcttttgtagctatttctcctagtctgctagaactgttaccctcactctgtataccagtcatcttgctgtggtcaatagggccagagggtttgctggtgaaccggttagtgggtggagcctaggaaagaaggaaatctccctgtcctgggtctggaaggatttggtcaaataagggtttctaaaagtatgagaaaggccaggcacggtggctcatgcctgtaatcccagcactttgggaggccaaggcgggcagatcacgaggtcaggagttcaagactaacgtggctaacatggtgaaaccccgtctctactaaaaatacaaaaaaattagccaggcatggtggcgggcgcttgtagtcccagctacttgggaggctgaggcaggagaattgcttgaacccaggaggcagaggctacagtgagccaaaatcgcaccactgcactccagcctgggtgacaaagcaagactctgtctcaaaaaaaaaaaaagtatgagaaagaggttacttctttcttaactagtttctctcagtccgtgagaaaagagggaatataaaaatagcaaccacgagccctctgactggaatagatacatctattggcctgagaaatacaaaccgaaggccataagagaagttttctccctctcccctctcccttctcccctctcccctctccctctccccacggtctccctctccctctctttctatggtctccctctgatgccgagcggaagctggactgtactgccgccatctctgctcactgcaacctccctgcctgattctcctgcctcagcctgcccagtgcctgccattgcaggcgcacgccgccacgcctgactggttttcgtatttttttggtggagacagggttttgctgtgttggccgggctggtctccagctcctaaccgcgagtgatccgccagcctcggcctcccgaggtgccgggattgcagacggagtctcgttcactcagtgctcaatgctgcccaggctggagtgcagtggcgtgatctcggctcgctacaacctccacctcccagccgcctgccttggcctcccaaagtgctgagactgcagcctctgcccggccgccaccccgtctgggaagtgaggagcgtctctgcctggccgcccatcgtctgggatgtgaggagcccctctgcccggccgcccagtctgggaagtgaggagcgcctcttcccggccgcccatcgtctgagatgtggggagcgcctctgccccgccgccccatctgggatgtgaggagcgcctctgccaggccacgaccccgtctgggaactgaggagtgtctctgcccgaccgccacccagtcttggaggtgaggagcgcctctgcccggccacgaccccgtctgggatgtgaggagcgtctctgcctggccgcccatcgtctgggatgtgaggagcccctctgcccggctgcccagtctgggaagtgaggagcgcctcctccccgccgccatcccgtctaggaagtgaggagcgtctctgcccggccgcccatcgtctgagatgtggggagcgccactgccccgccgccccgtttgggatgtgaggagctcctctgcccggccgcgacccggtctgggaagtgaggagcgtctccgcccggcagccaccccgtccgggaggtgaggggcgcctctgcccggccgcccctactgggaggtgaggagcccctctgcccggccaccaccccgtctgggaggtgtacccaacagctcattgagaacgggccatgatgacgatggcggttttgtcgaatagaaaagggggaaatgtggggaaaagatagaaaaatcagattgttgctgtgtctgtgtagaaagaagtagacatgggagactcaattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcagaaggccgcagggccctctgcctaggaaaaccagagacctttgttcacttgtttatctgctgaccttccgtccactattgtcctatgaccctgccaaatccccctctgcgagaaacacccaagaatgatcaataaaaatacataaataaataaaagaagttttatcctcaggatctatcatttcactacttttttttttttttttgagaccgagtctcgctctgtcgcccaggctggagtgtagtggcacagtctcggctcactgaaacctctgcctcctggattcaagcgattctcctgcctcagcctcccgagtagctgggactacaggcgcatgtcaccccgcctggttaatctttgcatttttagtagacagggtttcaccgtgttggccaggctggtcacgaactcctgacctcaagtgatccacctgacttggcctcccaaagtgctgggattacaggcgtgagccacagcgcctggccattttactgctatgaatatcctttgcaagggcaagaagagatgaatgatactggggatcaataatgttgttcggaggcgtgctaaacttcacttactccttcctgtatgggccaccagccttttgctgataattactaagatcactataccatccccgagagaccactgtagtgtgaagcatgttcattgggactatgtcagagactctcagccagcatctcaattactcatgaacaacttgtcagggatccataggcagcaaagtaaagaataggaggccgggtggatcacctgaggtcaggagttcaagaccagcctggccaaaacggcgaaacactgcctctactaaaaatacaagaaattagccgggcatggtggcgcgcacctgtaatcccagctactcgggaggctgaggcaggcgaatcacttgaacccgggaggcggaggttgcggtgatccgagatcacgccattgcactccagcctgggcaacagagcaaaactctgtctcaaaaaaaaaaaaaaaaagaatgggacaagcaaaactcaaggttgagtatatattgttaacaaagagaaaaggggagttagaaattcctctaacttcatacttctgtctgggcctgtgggctgtggtgctgagaataaacttgcttaccacctttggtgccactggctgctaggtgttgatgtagaaaagccagagaattataaaaggtctgtcctaatcctcaatagttttaataaatatcccctcttcaggcctacccacgtattgctttagaagcactttggctgccttcattctttctgcctcactgaacaatttacctacaacattccacgcgcccctgtagagaactgacaacatgcttgctatttcctcaggcttgggggcctctaacctggcctaatcaatccttctcatcttttgtacccaccttttgcaggaaacctgtggcttttttttttttaaagtagagacagggtctcggtatgttgcccaggctggtcttgagctcctgggctcaagcgatcctcccaccttggcctcccaaagtgcttggattacaggcgtgagccactgcacctggctgaaatctgttactttaatgtgggagaattaaaaggaggtaaggggttgataataacttactgagaaacagtgagaaatatccttgatttctgattccacccaatttctagcataagatcaaagccctgaaatgaaacttaagccaagaaaagtctatgttaatccgtcttatttcctggtaatgtgaccgtcttcagagttcacctggggctatggatattctcaggagactggcatgttctaagggtagatgtgcctatggtgtggggggaaggtctcgtaactggtgagttcagttcccagccctgccagtggtgtaacttgtggcgagttcagttcccagccctgccagtggtgtaatttgtggcgagttcagttcccagccctgccagtggtgtaacttgtggcgagttcagttcccagccctgccagtggtgtaacttgtggcgagttcagttcccagccctgccagtggtgtaacttgtggcgagttcagttcccagccctgccaatggtgtaacttggagcaggttatttggtttctctagcccttgttactcatatgtaaagcggaaatgacaaacacaccacaggattgctgtgggcagaaaatggaatagaatggatgtaaaagtgcttgcaaaccatccagccccatataaacgtcaggggtgactgttatcactagtaatatcactgtcatctcctacgaaacttacataagaggtagaagtaaaacacggctagtggaaaaccagcctacgtgccagcagctttgagagttgaggggattctgaaacaaggaatgggaatatgtgtccagtttcttacccggtgttcggccaggaactcgggtgtcagcgtccagggcgcattcctcaccacctcatccacgtagcggcagtgctggactgcgtcatagcgctcattctcgttcatcaccgtgaagcctttgaagttgtgtgtgagctcatcactgcaaactggttcaccacatcataaattgtgtgttggagtcctctttgcttagcacctcctcagccaccgacctctcccatcttctcccactgcttaggactgcaaccatcttccccaactggaaaaaagtcttctaaaggtggttgaacctgggtgataacgcttttcctaatgcagcgtataccttcaggagcaacactcactaaacagtatgttcatactttggagaagggacagtacaacaggtgaccaagatctttgactctgaaataaacctgctgtgcgtgtctgcatcaattaagtccttaaacatgttttcctgttttattcacactggactggaccacctaacatttccttggcagacttttgtactccagttaattcaaaatgataaactgaaatctaaagcaaatgttttaaagtggacaacggaagtcacggctgctcctgtgaccacagaaactcagctacaagcagtgaataaatgccagatggcacagtcgaggagcttgaagctcctctctccaggtttagtttgctggtacccatatacttcatgtgtgttagagaggctgtactacatccttcatttaaaaatggaaacaagagccagtgtactcagctgagaaagacagactgtactatcatctttttctgcacagcacctgaagtcaccaaatgttttcttacctcccacaatgaggtacgtattagggaaaaggttcttcgcttgcatcagagctcgggcgtgaccagagtgaaataagtcaaatattccatcggcataaactctcacaggtcgctcacctaaatccaaatgaaagaattgatcacaaaaatacctttttttttgtcatttttatttttatttttgaggccgagtctcactctgtcacccaggctggagtgcagtggcgtgatctcggctcactgcaacttccgcctcctgggttcaagtgattctcctgcctcagcctcccaagcagctgggattacaggtgcatgtcatcacgcctgcctaatttttgtgtttttagtagagatggggtttttccttgttggccaggctggtctcgaattcctggtctcaaatgacccgccagcctcagcctcccaaagtgctgggattacaggtgtgaaccaccatgccaagccacaaaaatacattgattcgatatcttgtacttggcaaatggaactggctctgtgtgacagttccatgactgtatactcctttctttttttttatttttttcttgagacggaatctcgctccatcacccagactggagtgcagtggcacgatctcggctcactacaacctgcaactcccggattcaagcgactctcctgcctccgcctcctgagtagctggaactacaggcgcccaccaccaagcccagctaattttttgtattattttttagtagagatggggtttcacagtgttagacaggatggtctcgatctcctgacctcgtgatccacccgcctaagcctcccaaagtgctgggattacaggtgtgagcaaccgcgcccggcccaactgcatactcctttctttaggtgttctctgggtattcaccctgattttaggggtaggttgggttatgaaaaatgactataaagaccttttcattttttttttgagacagggtctcactctgtcatccagcctggagtgcactgatgtggtcacagctcacggcagccttgacctcctgggctcaagtgatcctcccatctcagcctcccaagtagatgggaccacagatggacaccaccatgcccagctaattttttttttttttttttgtagagaccatgttgcccaggctggtctcgaactcctggactcaagcaatcccaccttggcctcccaaaatgctgggattccaggtgtgagccaccatgctcagcctataaagagatttttgacatcatcatctgcactaactgcctctgttagcctggttgtaccaaacttttcaggcacaacaaataacagagaactgtcaacttagaagccaggaaatgatttcccggggaacaagactaattccaaagtgaaataaacattaaaaacagaatcagcataatggtccatcatgctttaaataataaatctaaggagtccatgtaacttattccctttctgtgaataaaggaagagctattttactgcagcagaaactgacaggagcatttacatcatttgggaaagataggtcaaagtgtcatcagatacactatgctgaggttgaggatcagatacaccatgccgaggctgaggaccagatacactatgctgaggctgaggaccagatacactatgctgaggctgaggaccagatacactatgctgaggctgaggaccagatacactatgctgaggctgaggaccagatacactatactgaggctgaggaccagatacaccatgctgaggttgagtaccacatacactatgctgaggatcaggtacaccatgccgaggctgaggaccagatacaccatgccgaggctgaggaccagatacaccatgccgaggctgaggaccagatacaccatgccgaggctgaggaccaggtacaccatgccgaggctgaggaccaggtacaccatgccgaggctgaggaccaggtacaccatgccgaggctgaggaccaggtacaccatgccgaggcagaggaccaggtacaccatgccgaggctgaggaccaggtacaccatgccgaggctgaggaccagatacaccatgccgaggcgaggaccagatacactatgctgaggctgaggatcagatacactatgctgaggatcagatacactatgctgaggctgaggatcagatacactatgctgaggctgaggaccagatacactatgctgaggctgaggatcagatacactatgctgaggatcagatacactatgctgaggctgaggatcagatacactatgctgaggctgaggaccagatacactatgctgaggaccagatacactatgctgaggctgaggatcagatacactatgctgaggttgaggaccagatacactatgctgaggctgaggatcagatacactatgctgaggaccagatacactatgctgaggctgaggatcagatacactatgttgaggttgaggatcagatacaccatgctgaggttgaggatcagatacactatgctgaggctgaggatcagatacactatgctgaggctgaggatcagatatattatgccgaggttgaggaccagatacactatgctgaggatcagatacactatgctgaggttgaggaccagatacactatgctgaggatcagatacaccatgctgaggttgaggatcagatacactatgctgaggctgaggaccagatacaccatgctgaggctgaggaccagatacactatgctgaggatcagatacactatgctgaggttgaggaccagataccctatgctgaggctgaggaccagatacaccatgctgaggctgaggaccagatacaccatgctgaggctgaggaccagatacaccatgctgaggctgaggaccagatacaccatgctgaggctgaggatcagatacaccatgctgaggctgaggaccagatacaccatgctgaggctgaggatcacatacaccatgctgaggctgaggaccagatacaccatgctgaggctgaggaccagatacaccatgctgaggctgaggaccagatacaccatgctgaggttgaggaccagatacaccatgctgaggttgaggatcagatacactatgctgaggctgaggaccagatacactatgctgaggctgaggatcagatacaccatgctgaggttgaggatcagatacatctccttcctgtcttcagggcaatgaatgaaggagaaggaaagtagttctcaggaggtttatgaatttttgttttcaaaaagctttactcataaataagtagattttaaaccaagaaatcatacactgctgaaaggagtatcagcaactttcaagaagggcaattaggtcgtatctatcaaaagacaaacgacaaatgcttatagctgtggcccagcttttctaattctgggaattatctcacagtaaatatagatgttattcattgcagtactgtttataatagcaacagtcaggaaacgacctacatttcaacggaagattgaatatagcataatacacccactaaaaggtgggaggatatataaacaatttacttagatattcacagaaatgggtaatattggtggcctgttatagggataccaggtggctgtgagacaggtcttgagagggagacattttactttatgccctttttgtattttatggatattaaactgtgggaatgtattgatttcacttgatttgattttttgagacagggtctggctctgtcaccctggctggagtgcagtggcatggtctcagatcactgaaacctccacctcccaggctcaaatgatcctcccgcctcagcctcccgagaagctgggactacagcgcacaccaccacgccccgctgactacagcgcaccccgccacgccccgcagactacagcgcaccccgccacgccccactggctacagtgcacaccgccacgccccactggctacagcgcacaccactacgctcagctgatttttgtattttttgtacagatggggtttcacatgttgcccaagctagttgtatttttatttatttatttatttgagatggagtcttgctctgttgcccaggctggagtgtggtgacatgatctaggctcactgcaacctctgcctcctgggttcaagtgactatcctgcctcagcctcccaagtcactgggattacaggcgaaagccaccaagccgggataatttttgtatttttatattcgtatcccatgttggccaggctggtctcaatttcctgacctcaagtgatctgcccgccttggcctcccgaagttctgggattacgggcgtgagccaccatgcccagcccaggctggttgtattgattttataatacaggaaataaaaattttaaattaaatataccaatccaatgaaaaactaagaattaattaatggatttaagagtcagaaaggtcatagctcaagctttgaccaagctttccaaccagctttcttcctctgtaaccttaacttccttatgcctcagttttctcatctatgagagaaagcaggctgggtacagtagctcacacctgtaattccagcaccttgggagaccaaggtaggaggactgcttgagcccaggagtctgagaccagcctgggcaacacagtgaaaccctatctctattaaaattattttttactgccagcatgtgtcaactaaaaaaaaagaagaaaaaaatatttttaaaaagataatttttaataagacaaagcaaaataaaacaaaatttgagcatataatcccccttctatgtcccagaaatcactgcattggctctatgcctattaaaaaataatacattaaaaagatttttgggccgggcacagtggctcacgcctgtaatcccagcactttgggaggccaaggcaggtggatcacctgaggtcagcagttgaggccagcctggccaacatggtgaaaccctgtgtctactaaaaatacaaaaattagctgggtatggtggtgggcgcctgtaatcccagctactcgggaggctgaggcaggagaatctcttgaacccaggaggcagaggttgcagtgagctgagatcgcgccactgcactccagcctgcgagacagagcaagactctgtctcaaaaaaaaaaaaaattgaagtatcccagaagtcacgtccatgaagtaactaacatagttccattttccctaaacaagtccagaggggctatgatctcacactattcgatcctgaaacacaagggatagaatatacaaatgaagactactttgttgtttctttgctactagacagcatacagcagggaaattttgctcaagaaacacattgcctggatggtggcaatagcacagaatgctgttgatcaagtggctgcttgcagcacagctaatcatcctatgttaggccaagtagatcactgaaccttttctcagaccaatcccagatgcgcctcttgctctctccagtgcttccccagcctaccaacatctcaactggccaccattccatcccaagtctttggcaaacccaggctgatatattaaccaaacggccagaaggggtcactgttgaactagtctgggaagaaagctagcgttagccattcttttaccaagtggctattggccaggataaacacacccctgatttaatgtatgttatagtatatataatcatatttatataaattatatacttttaatataatttttcctgtttctattatataatgtactatataatacatatttaatatcatttatatattatgcatatattacatatgtatatatgttatatagatagatagatagattttttttttttgagacggagtctcactctgtcgcccaggctagagtgcagtgacgtgacctaggctcactgcaacctctgcctcccaggctcaagtgattctcctgtctcagcctcctgaatagctgggattacaggtgtgtgccaccacgcctggctaattttttatatttttagtagagacggggtttcaccatgttagccaggatggtctcgatctcctgaccttatgatccacccacctcagctttccaaagtgctgggattacaggtgtgagtcactgtacctggcctatatatatatttttttaatttttatttatgtatttatttattttttaagatagggtctctgtcacccaggctgaagtgcagtggtgcaatcatgacttgccgtggtctagacctcctgggctcaaacaatcctctcacctcagcctcctgagtggctgggactatagatgcacaccaccacacctggctaattattaaaatttttgtagagatgggatctcactgtattgcccaggctggccttgaattcctagcctcaagcaatccttctgccttggcctcccaaagtgctgggattataggcatgagccaccacactcaacctctgtatattattaacagcaactccctttcatgctcaaaaccgtcctgatttggatgataaattatatggtttatgtgggttatgaattatacgctgcaccactggtgactaagtaaccatatgtcctcctttaggcagaagaaacctgggtttcagttaatgatctcttttgatagatttactctcccaaatacctaccaccgaaacattctgttcctaacatttccattgcccttcacactctcccttttccttcctttctctgagttaaacatattgctgatttttttcatctcccaaaagattcctagagctgaccttcttgtctctcaaatcatatttgtttttctctaagtagagaatcttctcctagattatacaacctccctcgtaaaaacctggggagcaggagggaggtgttgaaacttcactagagcaggtgcattctttattgctttattccttgtcctgcactggcatgaatgcagttacctacttggtgatttaacataaaacagtcagacaaaatgagatctaagagaaaaaccagagttcaaattaagctggcaaatttataggctaatttgtggctgtttgttccaccaaaaatacaattattttgctgaaggccttctattctaatgcttacaatgagtagcaccattcccgggtgaggtttgagctgcaattctattccactaatcatccgttttactgtaggggaagccttcgcttcttggttactatggaccttaattgctttatgtacttaatgaagaaactataaagtagataatcttgaaaatgacttatttgtaaaatcctataattctaaaattaaaaacaattataccagtcaggacttgttaattataagctttaaaacttggaaacaggcccggcacggtggctcactcctgtaatcccagctacttgggaggctgagatttgagaactgcttgaacccagaagggaaatgttgcagtgagctgagatcacaccaccgcactccagcctggttgacaagcgagactctgtctcaaaaacaaaacaaaacaaaagatcaacttggaaacagtacacatattttcaaattttatgtaccacaaatgatatatagacaaattagcaacaaactggataatgcaacccatcagatcaaatctaaatgaatagctgattgtaaatgtgtgtcattagagagtatgtaaaaagttcttgctttcaatagcctctactatcacatctgaatgtgaaccctgaactatcttctggcgttttgaagttagacctggctaccattacacaatccatagtctctggttttctttgtcattttaccctgcctccaggagcctacctattacccaaataagggaagccaaactcaaaaatcttatcatgaatcagaaggttgtgatcaatatgaactatatctacacattttttcaaaaggaaaggattctctggaattagcctcttttttgttgaggaccccaaacccacaatacatatacccaagataaggccaaaggataggtgttaaaattcccggcattggccggcgcggtggctcacgcctgcaatcccagcactttgggaggctgaggtgggtggatcacgaggtcaggagttcgaggccagcctggccaacatggtgaaaccccgtctctactaaaaatacaaaaattagccaggcgtggtggtgcacacctgtaatcccagctactcgggaggctggggcagaagaattgcttgaacccgggaggaggaggttgcactgagccaagattgtgccactgcatgccagcctgggcaacagagtgagactctgcctcaaaagaaaaaaaaatttcccagtatgacactgtacatcacttctatttgttttttgtttgtttgttttgagacagggtctcgctctgtcacccaggctggagtacagtggcatgatctcagctcactgcaatctctgcctcccaggttcacataattctcgtgccttagcctcccgagtagctgggactacaggtgcccaccaccacgcccagctaacttttgtatttttagtagagaaggggtttcaccatgttaaccaggctggtctcgaactcctgacatcaagtgatgatctgcccgccttggtgtccaaagtgctgggattacaggtgtgagccaccactcctggcccacttctatttgtatttcactgttcttcagttactacagagagcaaacataccaacacaattaagaagtaaccacaaatatactgtatatgctgcaaatgcacagatttgtggctataaatccctcttattccctggtgtctgtctgagtcttagttcagtcctatatttacagggtagagagaacacttagtaatcagaagaagtgaaaaaggattggaaaaaaagggagaattggggaatttacagagaagaaagaatatttgcctataggactttgtattcataacaaatgctcttggaagtttctttttataatgatctctaaaaccaattgccccacataagaaaagcatctcgaatatatattagtaatttatgtgtcaaaaactgctaattaattatgtaaattaagcatgcaaataaagagcaagggctttgaaaataaagtattttttaaaacctggaaaattataatatcagtaaaaataaaattaagtgacgagcatctcccaacttgggatatttttgtcctctatcaatcggcagcatcatagccagctgacagaacgtagagaggtggtggggaattctgaaggctatgaagaatgtgacaccctgacacatgatttggactttatagaaatagataagatcataactcagctcaagctaatataatatcatattgtttctgttttactgtatctcacagctacaacagcagcccaggaaacaggtgcataataataagaaaaaaaatgaaagtttatggagtggagttacccttctaaatagaacatcaagacaggtgagaagaaccccttcgctgctggcctttgcaagtaaacagagggcagtatatagagagcaggtgtgtatttgataaagacaatggaatgctaaaaacaatagtcaaacaacaaattaagaaggtatttacttacaaggagttcctctgctggcttcttccatagttaccctgacatagggcttactaaagtcaacttcaatttcatcagaaaaaggagctggttgccgtaagcccttaagaaatggaaagtgaaggaaaagaaagttcaactcaatggcatacactgtaatactaaaaaaaaaaaagatgagagaaaggagattgatctctctattatagatggcttcgtttaagagatttcgttattcccgcctgtaatcccagcactttgggaggccgaggtgggtggatcatgaggtcaggagattgagacaatcctggctaacatggtgaaaccaggtctctactaaagatacagaaaattagcctggtgtggtggcaggcacctgtaatcccagctactcaggaggctgaggcaggagaatcgcttgaacccgggaggcagaggttgcagtgagccaagatcagaccattgcactccagcctagcccacagggcaagactccacctcaaaaaaaaaaaaaaaagagtttttgttattcctatgtattttattctacttgatgctgttgtgaatggaattgttttctgaattttatttttggattgttccttgatattatgtaacagtgcaattgatttgtatttgtgtttgtgtaactgaaattttctgtatattgatcttatgtcctataactttgctaaagttaattatcagttctagtatccgttgttgtttcatggattccttagcattttctacatataatatcatgtcatctgtgaatatagttttgcttattcttttccaatctggatttttttttttttttgagagggtccagctctgttgcccaggctggagtgcactggcgccatttcagctcactgcaacctccaactccccgactcaagtgatcctcccacctcagcctcccgagtagctgggactacaggcatacactacccgacacccagctgattttttattcttgtagagacaaggtctcactacgtgcctaggctggtctcaaactcctggcctcaagcaatcattccaccttggcctcccaaagtgctgggattacaggcgtgagccaccgtgcccagcctctggcctgggatttttaactatagtttgtttcttgtgatgtttatgtctggctttgatatctggcctcacaaaataagttgtgaagtgttctctttaccttatttttgtgtaagattcgtattatttattccttaaatgtttttgtggtttttgtaaagacactctgtcaccgaggctagagtgcagcggcacgatcatagctctctgcagcctccaactctggggctcaagcaattctctcacctcagcttccctaatagctgggactacaggcatgcaccaccacacccagctaattttttaactttgggcctggacctgtctttgtgagaagatttttaatgactaattccttttttttcttttttaacttgatataagtctattaagattttctcctttgtcttggttagtttttgcaacttgtctctttctaggaaattgtctattacatttaaattgtcaaatttttggcatgaaattgctcccttataatccttctaatttctgtatggctgcagtgatgttccgttctaaaaagatcgtatcatgattgggctgaatccagagactgggaagatactgttttgttttcaggtaagtgtagattttcaaaattgttttaacattaaaacacgttttttttgtttgtttgtttgttttgttttgttttggccaggtgcagtagctcatgcctgtaatcccagcactttgggaggcccaggctggtggattgcttgagcccaggagttcaagaccagcctgggcaacatgacgaaaccctgtctctacaaaaaaatacaaacattagctgggcgtggtgacacatgcctgtagtcccagttacttgggaagctgaggtgggaggactgcttgagccagggaggcaggggttacagtgagctgagattgccccactgcactccagcctgggcaacagagcaagaccctgtctcaaaaaaaaaaaaatcacttatataagtttagtttaagatatacttaatgatataaatggaaacattctttttttttttttttttttttttttttttgaggcaaagtcttgctctgtcgcccaggctggagtgcagtggtgtgaactcagctcactgcaacctccacctctcaggttcaagcgattctcatgcctcagcctcccaactagctgggattgcaggcatgcaccaccacacctggctgatttttggatttttagtagagacagggtttcaccatgtcggccaggctggtcttgaactcctggcctcaagtgatccacccgcttcggcctcctaaagtgctggaattacaggcttgagccaccatgcccagccaagacattcatttttagatgtgtatgtgttattcttctttgaaatacttttaaaaatagaaccaaggacctagatattaatcaaaaacacaaggaaatactacttcatatcaaccaggatggctatgagcaaaaagacaggcaataacaaacagtcttggtaaggatgtgaagaagttagaaccatcatacattgctactgtgaatataaaataatgtgcagctttggaaaacagttcttcaaaatgttaaacatagaattaccatatgacccagaaattatactgctaggtatatacccaagataactgaaaacatatattaagaaaaaaacaactatgtcaggcacggtaactcacgcctgtaatcccagcactttgggaggccgaggcgggtagaccacctaggtcgggagttcgagaccagcctggccagcatggtaaaatcccatctctactaaaaatacaaaacttagccaggtggcgtggtgcatgcctgcaatcccagctacttgggaggctgaggcagaagaatcacttgaacccaggaggtggaggttgcagtgagctgagattgtgctaccgtactcgtctgggagatagagaaagactctgcctcaaaaaaacaaaacaaaacaaaaacaaaaacaaaaaacttatacatgaaaaatgttcacacttgcattactcgtaatagccaaaaagtagaaacaacccaaatgtccatcaatgaatggataaacaaatggtatgtccacacaatggaatattatttacccataaaaaggaataaagtactgatacatgctaccacttggatggatcttgaaaacattatgccaaaaaaggaagtcggacacaaaagtccacaagttgtatgatttcatttacattagatgttcagactaggcaaagctgtagagacagaaagcagattagtggttgccaggaggtagctggaggggtaatagggagtgactgctaatgaatacagggggtttctttttgtggtgatgaaatgttctggaattagatggttgtgatggttgtacaacagtatgactagactataaactactgacttatatactttaaaatggttaaaatagtgaattttatgttatgtgaattttacccaaattttaaaagatacattggccaggtgtggtggctcacacctgtaatcccagcactgggaggccgaggcaggcagatcatgaggtcaggagttcgagaccatcctgactaacacggtgaaaccccgtcactactaaaaatacaaaaattagccaggcgcagtggtgggcgcctgtaataccagcactttgggaggccgaggcgggtagaccaccttaggtcgggagttcgagaccagcctggccagcatggtaaaatcccatctctactaaaaatacaaaacttagccaggtggggtggtgcatgcctgcaatcccagctactcgggaggctgaggcaggagaattgcttgaactcgggatgcggaggttgcagtgagccgagatcacgccactgcactccagcctgggcagtggagcaaaactccatctcaaaaaaaaaaaaaaagagatattttaagtatcttatctttcacaactgtttcttcagtctttctcacatactgtgtatatttccaggtagaagacaaatacagctgtccttcctggctggggtttaggctgaatccgtttctcctaagtatagggagtgaaacctaacgttgtgcagctataacaaagcagcaaaatctttttttctagagttgtttccagctagaaaaggtagtatttttttaaaacactgtgttattctcaaagaacagtgtctctagaagctgaggtttataaaagtaggactaaatatttctgtgttctcctaaaacacatctccttcattttaacctcaagggaatgccacagtatcgctttcaagtcttaagactatctggtagtgaggtataaatgaaagaacatggggttaggacttggaaaatttagatctaaatcccaactctatcatttaatacctgtgaaatcacagcaagtttctaaagctttcatttcatcttctacaaaatagaaaacaacaatacctgccctacaagtttactatgaggattaaacaaagtagcatccgcaaagtaattagcataatgtttcacaaaagtaggcactcgacgaatttgtcgttagctcatttcctcttgtattctatagaacacagatttcagcatgctaacaaaattaactcctattaatctaagaggttagcttctaaaatgctatataaactttccaaatgcatgcatctaaaagttataatggaaatcaacagtccccaaattatgaattgtctctgaatgcaatattgcttccataacaactttttccagactatattcacacacattatttcactattccttaaaatttcagtgaaaacaagagattctggcatccacactaacaggaaaatggacataattcaaataatatagactagaacttgatattgtcttcccagtacactttttactttctaaggattctttttttttttttttggcttttttttgtgagacagtctcaccctgtcgcccaggctagagtgcagtggcgcgatctcagctcactgcaacctctgccgcccaggatcaagcgattctcctgcctcagcctcccgagtagctgggattacaggcacccaccactgcgcctgcttaatttttttagttttagtagagacagggtttcgcgatgttggccaggctggttttgaactcccgacctcatgatccacccgcctcggcctcccaaagtgctgggattacaggcgtgagccaccgcatccaactctaaggattcttaaatatttttcagcaaaaagtttctgaatgccacagaaaaacatttatttccctttcacccaaacattctgtattaatgataaagggtcctcccgagatcccaattgtttctattttttttattttttaagagacagggtctcactgttgcccaggttggaatgcagcagtgcgatccatacctcactataaccttgacttcctaagctcaagagatcctcctgcctcatcttcctgagcagctaggaccacaggggcacatcaccatatccagttaatttttccattttttttgtagggacagtgtctctctataatgcattgcccaggctggtctcaaattcctggcctcaagggatccttccacctcccaaggcgcttggattttaggcatgagccactgtgcttggcccaattctttcaataatgccacgggaaacgctacagagtcaagaggaataccatgtggtatgagaaagaagggacaaagaacagagctgaaagattccaccccccggggatctgtttttttgttttgttttgttttgagacagagtcttgctctgtcgccaggctggagtacagtggcgcgatctcggctcactgcaagctccacctccagggttcaagcaattctcctgcctcagcctccggagtagctgggactacaggcacccaccaccacgcccggctaatttttgtgacttttagtagagacggggtttcaccatgttggccaggatggtctcgatcacttgacctcgtgatccaccctcctcggcctcccaaagtgttgggattacgggcatgagccactgcgcccagccaggatctggttttaaaaatgaaagaaaagcaatcattctccctgactcctattgccatttcagtgaatgtaaacaatgagctcatctgtccaattactatttggatgtcttataggccctctaaattgaacctgtactaagttaaactctttgtcttcctcctaaacctgcttttcctcctggtatttcttatctcaatgggaagtaccccatctacacaacgtacctaagactgaaacctaggagtcactcttaacaccttttgtccttcatatctcagtaatctccaagaactgtccattttacatcttttttaaaaattacaattttaatttaaaatagagacagggtctccctatattgcccaggctgctctcaaactcctgggctcaagggatcctcccaccttggcctcctgaagggctgcgattacaggcgtgaagccaccatgcccagccgattttaccttctagaaatgtgcaaagtttatctcgcactctctgtacctaatgtcatagtttaagccctacttcatgattctgaacttgtaccccatctcttgttcatttcttgaattccttgtatccttcaaagttcagctcagaaataacccttttgatgacgcttttcccaaaccactgcccctacctcttggtcaaagtcagtctcttgcttctcaagattattttggttgaaatgagattgggaggcctatacttagccataagcagaactatggccatcctgacccaccaacccaggcatctaatacctggtatccttcctactccttttttctcaagagattgactttgtaacttccgtctatttggcacttttcatacgtatcataatttcatactgtatcataattatttgctgctgtttctttctcttttttgtctgtgagttttccaagggcaaggtcatcttttcatccttgcatctccaatgcaactggcaagtagaggttctcgaaacattttggttgaaatgagattgtgaggcctactttgccataagcagaactatggccaatttcccccacagtttagatacttcatgactcattcatacatatgatattctttgtaagttattttattttatttattattatttttattttatttatttatttattttttttgagacagagtctcgctttgttgcccaggctggagtgcagtggtgtgatctcagctcactgcaacctctgcctcctgggttcaagccattctcctgcctcagtctcctgagtagctgggattacaggcgcacatcaccatgcccagctaatttttttttgtatttttagtagaaacggggtttcgccatgttggccaggctggtctcaaactcctgacctcgtgatctgcccttctcggcctcccaaagtgctaagattacaggcgtgagccacttgcgcccagcctgatatatattaagataagctaaacgtcttatgttttgtaaatacttttgtgatccttttgattgaacctttagaaacatctgtatcaataaatgatttatacttatcgacaaaatagccataaagtttttcctagtttttccttcttaactcctttgtctcttttctatccatttcatcctgacccaccaacccaggtatctactacttggtgatccttcctattcctttctttacatgcaaggaaagtactttttctaaagctaatgagctccaccgggtgtggtggctcacgcctgtcatctcagcacttagggaggcagaggtgggcggatagcttgagcccagggcaacagagcaagtccccctaccctttttttttcttttttgagacggagtctcgctctgtcgcccaagctggagtgcagtggcgcgatctcagctcacttgcaaactccgcctcctgggttcacgccattctcctgcttcagcctcctgagtagctgggactacaggcgcccaccactgcgcccagctaatttttgtatttttagtagagacgaggtttcgtcatgttggccagactggtctcgaactcctgacctcaggtgatccgcccacctcagcctcccgaagtgctgggatgacaggcgtgagccactgtgcctggcctgcaagtgcccattaaaaaaaaataaataaactaatgagctctaggctatagaattctactctatgctcacatctcataaaaggaaggtcttgtttatctttacacgtctaccacctactgccatactagcgcattgtaaatatgcaataaaggccaggtgcagtagctcacgcctgtaatcccagcactttgggaggtcgaggcgggcggatcacgaggtcaagagatcgagaccatcctggctaacacggtgaaaccccgtctctactaaaaaatacaaaaaattagccaggcttggtggcgggcgcctgtagtcccagccactcgggaggctgaggcaggaaaatggcgtgaacccaggaggcggagcttgcagtgagccgagatcaggccactgcactccagcctgggcgacagagcaagactccatctcaaaaaaataaataaataaaaatgcaagaaaatcttgcttactcaacccaaatgtcaactggagaatgaataactaaaaagtagtatgtgatatatgatggaatgttatttgtcaataaaaaaaaaatgaagtactggccggacgtggtggcccacacctgtaatcccagcacttcgggaggttgaggtgggcggatcacttgaggtcagaagtttgaaaccagcctgagcaacatggtaaaaccccatctctactaaaaatacaaaaattagccaggcgtggtggcggcgcatgcctgtagtcccagttactcaggaggctaaggcaggagaatcacttgaacctgggaggccgagatcacaccgctgcattccagcctgggcaacagagtgagactctgtctcaaaaaaaaaaattgccgggcacggtggctcacgcctataatcccagtactttgggaggccgaggcgggcggattacctgaggtcaggagatcgagaccatcctggctaacatggtgaaaccccgtctctaccaaaaataaaaattaaaaaaaatcagccggatgtggtggctggcgcctgtaatcccagctacccgggagggtgagacaggagaatcacttgaacccaggaggcggaggttgcagtgagccgagattgcgccactgcactccagcttgggcgacagagcgagactcagtctcaaaaaaaaaaaaaaaaaaaattaagtacttgtacatgttgcagtacgaatgaatcttcaaaacaagctcagtgaaagaagccagccccaaagaccacataccgtatgatgtcatttgtatgaatgtccagaacaggcaaatccacagaatcagaaagcagattagtggcttccagaggctggagagactggggggaaatggggagtgactgctaatgagtacaggccttctttctggggtgataaaaatatcccaggccaggcatggtggctcacacctgtaatcccacactgtggcaggctgaggcaggagaatcgcttgatccaggagactgagaccagtctgggtaacatagtgagaccccatccctacaaaaacaaatttaaaaattagccaagcatggtgatgtgcacctatattcccagctacttgggaggctgaggtgagaggactgtttgagcccagaaagttgaggctgcagtgaactatgatcacaccactgcactgcagcctgggtaacagaccaagaccctgtctcaaaaaaaaaaagaaaaaaattctaaaattggtcatggtgatggttgcacaactctgtgaataaactgaaaaccactgaattgtatactgtaaatgatatgtcaattataactcaataaagctgttaaaaaaagaaaaaagtcttgcttgcttttgttatagagttcaaaggagattcagagctagaaagtacaggtgtacagtgagatggcagaaagtttactagcagacattcctcctcactaaggtgggccaggctgttgggtggatctctgaccattcacctatgccaaatagtctgtgtgtttcagggaggaatgtggaataggtagcagcaagtcactgaactgatttcacatgaatatatgaagcaaagtaatttaaagcattaagactccccagaagaatttaaaaaaaaaaaagattcccagagtctaaagaccaagaaatttaagttttctcagagctcattccactgaaaagactggcttcctttgctttattcctagctacagtgattggctgattagctgacagtatcacctatttggttataacttgttcctactccaagtgatgttgctgaattggtacacaccaccatttctttaatctgaattatctaagaaatattcagaaactaacaatgccctgttttgttgattgctgagtcactttctgagcttatttgctgtagtatgcagaataatgcccccctgcagatggccacacccattccctggagcctgtgactgttttaccatacatggcaaaagagactctgcaggccaggcacagtggctcacgcctggtaatcctagcactctgggaggccgagataggaagactacttgagctcaggagttcaagaccagcctgggcaacatagcaagacccttactctaaaaataaaaataaaaataaaaatagtaagccaggcatggtggtgggcacctgcaatcccagccacttgggaggctgaggcagggaaatcacttgaacccaagaggcagacgttgcagtgaaccgggaccgcaccactgcactccagcctgggtgacaaagcgagactctgtctcaaaaatacaaataaaaataaataaaaataaaaatagtaaagaggctttgcagatatgattaaataaaggaagattattctggtttatctgggtataccgaacgtaatcacaagagtccttgtaagtgaaaaggggaagtaggaggttcagaatcagagcaggagacatggcagaagcaatcgtcagagtgatgtgagcactggctggtgccaagcactaagcaatgtgggaaccctctagaagctggaaaaggcaagaagatggactttcccctggaccctccagctctgccaacaccctgattttagccctctgagacccatttcagatttctgatatccagaactgtaagataattcatttgtatatttgtattatggtaatttgttacaaatgcaacaggaaacaaatatatatacttgcccttatgatcaatatcagccctgcaggcacttgtctatttgtagggtattatttgcttttattgctcaagacagagcattcatttggaataagtattaactgtttcagaatagatttttccctttgggctgggaagctctagaactaagcagtggaaactgagtttgatcaatggctaatagtcaatataggtaaagaaacatacaattctgtcactgggattttgaaacacagatttcataataatattaacaacagtagcttcaattgtgtgtaagtgttctctgacatgtttttattatggaaagttttaggaagggtagcaagctgagacaggataggcagtgtggaggaaagctttaggaagggtagcaagctgagatgggataggcagtgtggaatggggtctttcatctaaggtttggcaataattaggaaatacaaagataattttccagagataaaggagcataaggtaggcataaacggaaaaaggttctcatctaagatacaactagtaacaggatggaggaatgatagagggagaaaaaacagcagaaaagacgcactagacaccatgagatgatacgaagatcaaatcactgcctagagccccaatttttctatttcattagttttatttatttgtttatttactttttatttttatttttgagatagggtctgtctctgttgcccaggctggaatgcaatggtgcaatctcggctcaccgcatcctccgcctcccgagttcaagcaattctcatgcctcagcctcccaagcagctgagattacaggcatgcgccaccacgcccggctaattttgtatttttagtaaagacagggtttcaccaggctggtctcaaactcctgacctcaggtgatcctcccacctcagcctcccaaagtgtgggattacaggtatgagtcaccgcacctggccatatttcaatagtttcagcctaatacacatgcaacttccatattttcctaacacttctttttctaaacccaatgtaaagcttctacaactgagctgtgagtcataatccagtaaaaaggcagcagatttccagtgactgtgaaaatacacttactattccttcttttcattatttcagaagacatgtaacactgatatcatcaatgtcatatcggtttctaccctccccctgccaggttaatctccacttaccactgcacagcgctgcactttggaaggaaccccatcttcttctgttgccccgttgggtccgggcgcctcttttctcctcttccttgcattgaccttggctgaacactgtgcatccatcttcttttaactggtcatagaaagtgaaaacaaaaattttctcattggggtgggaaaaagtttgtcaccagtatttcagagacgttgacgtggatacactcagcaaaataccaattctacagctgcacttcaccaagatgagccaatggcatctggcaaaaccagcgaagcttcacaaaacacaggctctagtagaaatactgaaacgcctctctgtgcaacaatggccacagtgaattgcctgaagtcggaagtcattccccctcacagtgcagcctacatactaactgctcattttaaatcctgattgcatgcaaaagattggaataatttggctgagaaagatagttacacagactctcccactatcctccgcatcatcgatatgacaggtataaggcaatgtgaaggtatgactggtgcaggtagagaaaagagccttttgtaaacggatggctctcaccaagtcctggattaacaaaacacggatttcttaactctaattttttttaagacggggtctcactctgttgcccaggctggggtgcagtggtatgatcttgcctcactgcagcttcaacctcgttagctcaagcgatcctcttgccccagcctcccaagtagttgggactacaggcacatgccaccacacctagttatttttttttttaagagacaggcctcgctatgttgcccaggctggtcttgaattcctggcctcaagtgatcctcccaactcaaactcccaaagacttgggatgacaggcatgaaccacatcactgagtgaatttcttaactctaaaagttctatagatttcagtgaccacttcaccagagttacttgcatgaaaattgtggagtagcataatggtttttatttacttttttattgtttttatttttttaggggtcttgctaggttgtccaggctggagcgcagtggctactcacagccataatcatagcacactgtagcctcaaactcctgagcttaagcaatcctcccatctgagcctccagaatagctaggaccagcataatgtattttttaaatgtccttctccttctttcctttttttttttttgagaaagagtctcactgtgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactctgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactctgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactccgtcaccctggctagagtgcagtggcaccatctcggctcactacaacctccgcctcccaggttcaagcgattctcctgcctcagcctcctgagtaggtgggattacaggcacccaccaccacgcctggctaattttttgtatttttagtagagacagggtttccctatgttggccaggctggtctcgaacacctgacctcgtgatccacctgcctcgtcctccaaaagtgctgaaattacaggcgtgagccatggcgcctagccaatttttgtatttttagtagagacagggttttgtcatgttggccaggctggtcttgaactcctgacctcaggtgatccacccacctcgacctcccaaagtgctggaattacaggtgtgaaccactgcacctggcccttccccttcttttctcagtactcatttccctttcctctttcagggtcttaacacctcaagcttgttcacagtttccagctattaaaaccccctcagggattctccttcccccaaaggaacttatttattattgtctcatttagcagagagtttctagcaactagctattacagcaaagttctgaatattctgtatttcatgtttaagtcacagaatacttggggtgtcacttcgctagccagaaacctctgtggccagtggcacctttgcctgagttttgctcaggcccgccgggctcgttccgtccactcagcctggtaggctatgctcagcttgtgttaccagcacagattccatgcatgccaaggacaagccaggcacggagcggcaagaggtgcacaggcgagccagcacagggtccggccactgcgcacagccaggcacgccagctgccagggggtgagcagctcgaggcgccagctccctgagaggctgcagctgaaccaggcgtactacaagcagcttccactgcaggcactggggaacatggtgctgcccagaagcttggagaggccaggaaccacagagctccaaagagggtgtcacagccctggctcaaggagctcctaggtctgggcttcccaaagggctacagctcttctctttctctctcctctcttctctctttctgttgcccacagcgtggcaagcagtgggggaggggaggacgtgtttcggctctgtttgtgtttcagctctttcagtcccaccatttggcagatcccgagttcttgtcccacgtccaggaagaatgaggtatatggacaactggaggacgagcaaggtgaagaggtgctttattgagcaacacaacagccctcaggagaccccaagcgggtagctcctttccgcagcaggtcgtcccagcatctgtgcagccctcagcggagaggagacccagagtggatagctcctatctgcaggcaggtcatcctgacgtctctgcagccctcagtggagaggagacctggagtgggaagctcctatccgcaggcaggtcatcccatcaagtatggctgagtccagggtttctacgggcttcagcgggcaggaagtgcatgctgattggtccatgggcagccacaggcagcccggaaaaagcatcgtaagttctcattccagtccacagaactggcagcctgggccccaggcttcaggccatccctggcttgaaggtggggcttcaccagggacccgcccatttccgcctaggagcctgtctgcctcctgctgtcatcaacctgctgtccacagcgcccaggctattcacgaaggggcgcctgcaggcctgaatggagctgctctcagctccgccttggcgtcccctcctgtgctgctggacacccaaaatccagagggggccaaggcagaagggggctggcatgtcagcactgcccctagcacacgcaaacccagccaggtcatgacagtgcccaggcttggcctcaactttgctccaaaatcagagcaggcaccaggagcaaggagaggccaggcagtgggagcaggcacttcaagcctgcaggggcaggggaggttcctgggcccccaaaagcacagggaagcccgggtatgtagccacggctgctcccgccctgccaacttggaaacgggcagggcttccacctactcccagctcccagtggctccatggagcgtgcagcacagaccatgcctccccgactgcagccggcatcatggcagcagcccatccagacaggccaccgctgccatcatttagatgttggcttttcagccccctgcagggatagttgcgtttttcttaagtaacacaatttgtacaaataaattactttcttgatactgatgaaattttaggaatcagccagaaattgggggtaggggaaactctatgataaactgtcatctctgcacaagatacggttcagagaaaaatcttcagaacaggtggaaaaccaatgccagacagaatgaggacagtctgctctgccctactgcctctcataagcctgactgagatgttcgtctaaacaactgcaactgtgccttactttctttcctccggctcaactccgagtggcaatatgacaagatctacaagaaactggcctaattcttagaagctgaaggtgacaccccatgagtcatggccaacatgaaaaaatgtcagagtcgaaagtgaaagatgagcaccacctagaaacttcctttcatcacaaatgcaaattaaaatggaagaagggttctatacatttcactccgagttctttcagtgatgatgatcagagcttgtcttcactattgttcttaatgattccttcataatattcagaggtcaatactctcatctcagtggtctgagtgaactactcaaaatgcctaatccatccaattaatgattgttttctaatttgcacagtactcttctgtaagtatctgctcaattcttctaagtgtagagagacaaaatccactatgagaaatataatcagcaatttggcatctggcaagtcaataatatcaggcagtcaaaaatatgagtacttactgcttacaaagtactgtatcataatttttaagtacaaactgaacctggaggacattatgctaagtgaaataagccagacgagaaagacaaataccacaaatgacctcacttatttgtggaatctaaaagagtggaactcacagaagtacagaatggaatggtggttacaagagatggacagaagagggtggagagcaaaaagggagatgtcgagtacaaaaattcagttttgaaaggagaaacaggctgggcacagtggctcacgcctgtaatctcagcctttgggaggctgaggcgggtggatcacgaggtcaagagatcgagaccatcctggccaacatggtgaaaccccatctctactaaaagtacaaaaaatagctgggtgtggtggcgcatatctgtaatcccagctactcgggaggctgaggcagaagaatcccttgaacccaggagacagaggttgcagtgagctgagatcgcaccactgcactccagcctggcaacagagtaagactctgtctcaacaaaaaagaaaaaaaaaaagaatggagaaataagctttagtgatctattgcacagaatggtgactataataaataataatgcagccaggcacggtggctcacacctgtaatcccagcactttgggacgccaaggcaggcggatcacaaggtcaggagattgagaacatcctggctaacacagtgaaaccctgtctctactaaaaatacaaaaaattagccaggcgtggtggcgggcacctgtagtcccagctgctggggaggctgaggcaggagaatggtgtgaacccgggaggcagagcttgcagtgagccgagatcgtgccactgcactccagtctgggcgccagagtgagactccgtctccaaaaaaaaaaaaaaccaaaacaaaataaataataatgcattttatatttcaaaattgctaaaagagtagattttaaatgttttcaccacaaaaaaataagtatataaggcaaggaatttgttaattagcttgatttaatcattccacatgtaaacatatatcgaagtatcacattgtatcccataaatataaacaactattatttatcaatttaaaaaattaaaggccaggcacaatggctcacgcctgcaatcccagcactttgggaggctgaggtgggcagctcacctcaggtcaggagtttgagaccagcctgtgcaacatggtgaaactccatctctacaaaaatacaaaaattagccagacttggtggtgcattcctgtaatcccagctactcaggagactgaggcgggaggatcacttgaatctgggaggcaaaggttgcagtcagccgagatcgcaccactgcactccagcctgggcaacagagtgagactccgtctcaaaaaatgaaaaaaaaaaaaaaattaagtacaaactattttctcaaggaagcttcaattaaggcatggaaaacacacacagagctccacctcaaaaatgcttatgatataaaaatgctctacaggattctaaaaccatggggtgaaagtttgctgaggaataggatatttgcagttacgaaaaattgaccaggtgtagtggcacatgcctgtagtcccagctactcgggaggccgaggtgggaggactacttgagaacagcaagtcaaggctgcactgagccatgatcatgccactacactccagcctggacagcaaagtgagaccctttctcaaaaaaaaaaaaggccacatgcagtggttcatgcctgtaatcctggcactttgagaggccaaggcaggcgaatcacctgaggtctggagttcaagaccagcctggccaacatggtgaaaccccgtttctactaaaaatataaaaattagccaggtgtggtggcgggcacctgtaatcccagctacttgggaggctgaggcaggagaattgcttaaacccaggaggcagaggttgcagtgagccaagatcatgccattgcactccagcctgggtgacaagagtgagactccatttcaaaaaaatatatatatttttttctttacctgcttacactattatgtgtttatactattccttatctgcttacatacagttcttctattttctaaagatgacttttgggttttacattatattctacactgttctttaaactgaagtctttagatccttcggatttaaaataaaacacacccactgctttttgggttttagtgtaagacacttctttatctcatccacttctcaggagatggaaaacatctgggtcacagatattccataatgataaccctaaaagaatttagaaattatgcaaagattactcctcatgactttcctctagaactactgctgtttaaacttttactctgggctgggcgcggtggctcatgcctgtaatcccagcactttgggagaccaaggtgggtggatcacatgaggtcaggagttcgcaaccagcctggccaacatggtgaaaccccatctctactaaaaatacaaaaattagctgagcgtggtggcatgcacctgtaatcccagctacttgggaggctaaggcaggaggatcacttgatccctggaggtggaggttgcagtgagcctaaatcgcacgccactgcgctccagcctgggcgacagagcgagactttgtctcaaaataataataacaataataaacttttactctgtaggtctcacaagtttttttcattttttcccggccttcttatgccatcccaatgttctctcacatctactaacttataaccgcagcaccaaagcatacagaataataactgatgtttaaaatcatggaaaaaggtacccccagtctccctcatgttccaatagatgcttgcccggacacatcacctttgctactgagaaagtgtagagaaaaggtgtgtgggaggatgagggcgtactgaagacagtaaatacatcctaacatcgtgttggcttcttaatttgttacactgaaacttaggtgtacctaaagccacaccaccattacaacatcgataactgcccagtaaccatttggaatacctccaacaatgaggaacaatatttcttggactctcagtttatgataagtgcgcctctgtcatcaaccaataccattcaagtaaggtacagtgatggctctggaaaaggaggtggctttaaatatctacattcaaaggggaaaaaaaatacacgcacacacacaggctgccttaatatccctgtttgtccagcgggcaatgggactgggaaatgatcgcgcctcctcagagccaatacagtaggaggcgaacatggggcagtgcattactcaatgccctgcagactgacccttaggaatgagacaggaagaaaagtatttggagatagaatagagaacctccctcaagagccctactaggatgggccaacacttcctgtttgtttagtggttcatcctccagaacactttctttgtcaaaaaggctataacagcccagtacagtggctcatgcctataatcccagcactttgggagaccaaggcggatggattgcttgagcccaggagttcaagaccagcctggccaacatggcgaaaccccatctctactaaaaagacaaataattagccaggagtggtggcacatgcttgtagtcccagctacttgggagtctgtggtggcagaatcgcttgaacccaggatgcagaggttgcagtgagccaagatcgttccactgtactcccgcctgggtgacagagcaagacctcatctcaaaaaaaaaaaaaaaaaaaaagctaggccaggtgtggtggctcacacttgtaatcccaacactttgagaggccaaggcgggaggatcacctgaggtcaggagttcgagaccagcctggccaacatggtgaagcccggtctctactaaaactacaaaaataagctgggcgtggtggcaggtgcctgtaatcccagctacccaggagactgaggcaggagaatcatttgaacccaagagacggaggctgcagtgagccatgatcataccactgcactccaacctgggtgacaagagtgaaactctatcaaaaaaaaaaaaaaaaagggctgacagccagaatacagcaattgttaagacctgatctttccaactgctgcctattcactccctagataagtcaccttatcttaatcactgaaatttgagcacagactctaaatatggacataaaaacccatcccccaacaccctgcctgctaagtacattagtgtctccaaagtgccctcgaaatacagaatgcagtatctgtgcctgtgatttttactccgactcacaaagacctggtttggtttctgctgactcacctaccagtacacactgcttgccttgttcctccacgttccaacacatgcctgctgaggcacatcagctttgctagacaagtggaagatgtgtttgtggagggaggggtggcactgaggagacactaaggatacagctagtcatatttttccaatgtgaatgtcctgaaggagacagaatctaggtgctggcatgtctatgcttgagtctgaaagatgataggctcctacaagtagttttagggactcctatccagtcctttctttttttttttttttttttttttttgagacagagtttcactcctgttgcccaggctggagtacaatggcacgatctcagctcaccacaacctccacctcccgggttcaagcaattctcctgcctcagcctcccgagtagctgggattacaggcatgcaccaccacgcctggctaattttgtatttttagtagagatggggtttctccatgttgaggctggtcttgaactcctgacctcaggtgatctgcccgcctcagtctcccaaagtgctgggattacaggcgtgagccaccgcacccggcctatccaatcctttctattcaacttccttattgcaaacagacctaccaagggaaagaggagttggactttgcttcctgaactatgtaacaatctaaatatagcagagtcctctcttatccacaggggaaatgtttcaagacgccagcagatgcctgaacccctagagagtatggaccctatatggacagttgtccctcagaatctgcagggcactggttccaggatctcctgcagatgccaaaatccacagatgctcaaaagtcccttatatatataaaacggtgtcgaatttgcatataatctataccccctatatactttcaatcttctctacattacttacaacacctaatacaatgtaaatactatgtaaccagttattatacaatattggttttttatttgtactgttttttattgttgtattggtatttttattgtttttttttttttttttttctgaatattttcgatccaagtttggctgaatctgcggatgtggagcccatggccacgaagggctgactctactttgttttctccctatatacacagagctatgataaagttttatttataaattaagcacagtaagagattaacaggaataactaataataaaacaattataacaatatactgtaataaatgttatctgaatgtggctgttctctctcactctcaaaatatcttactacatcatactcacctattttctgaccgtggctgactgtgggtaactgaaaccacggaaagtaaaactgcgactaagggtgagctcttgtagtagcaagttgcaattacatatgctattccacatttcaaaaatctaactcaaacttgaccaattactacaaggaactatttgcaaaaagatgaggcataatttttcctttgcactctattcctgccttccccatctctaggcctacattatcttccccactaaaacccaatgcccagtatttttctatcagcatatcaatgcccagttccaaagccgagtgcgcaagcagactttacatttgggatgtttctctgcttctaccgtggtggtgcttaatgagctggtgctctaagaggcaagctctggaaactcaagggttaaagtgcatctaatattcctggcattcattaatcctatcatcttgctgtacactcaggtctttctggagataacagtgtaaggacattgccccctatgtaaaggcctttgaagcttgaaggagtatatggctaagcgaaagtagggaaaagagctggactcaagaaccagaaaatctagatcaggggtcagcaaactacagctagctggccaaagatggcccactacctgtttttgtaattaaaattcgatcagaacacagccatgttcactcactgatgtgtttattgtccatggctgcttttgtgctacaacagcagagctgagtagtcacagatactgtgtgacctgcaaaccctaaactatttacaatctggcccgttactgaaaaagtttgctacctctcatcctagatgaaatcaggaccagctttattaataatttggtggcaaattctacctaaatttacccaatctaaagtgaaaaacagtgttagaaatagaattatttcgagtacagtggtgcaatcatggctcactgcagcctcgaactgctgggcttaagtgatcctcctgcctcaccctcccaagtagctaggactacaggcacatgccactacacccagctaattttttgtagagatgggggtctcactttgctgcccaggttggtctcaaactcctggcctcaagcaatcctcccacctcagcctcccaaagtgctgggattataggtatgaactatcacaccaggctgagaacttataaatgtaaaagtgaatttcaaaacatgagcttctctgacagattagttctaaactaaagttcaacgttacttgtcatgagccctataaactgtcacatttaagaccttagctttgaactggatctcttccctctaatttcgtcagagaaacccttattcaacaaacactgagcggcacttactctgtgccagaccctgggttagccactggcacacataataaagcttatacttcttcggcctggacatgtagtagaatatttcaggaaagaaaaaaccatgagggacacatgtaatagttcttacagttgaacaattttactctgccactattctaccagaatatttggtgagtaaactcttgtgtttagaatgtgatcttcctagagtgggttatggaactcatatctctgaggcagggtctatgatagaattcaggaagtctgtgaatttggatgaaaaagactgtatctttattttcacttcagtgatgaacataagctacagcagtaatagcagacttattagacaaatggatttgttaccagtagaaatcatggatattttcataccatatcatacttcttaaattttgataactatatatcaatataattcaatataactggttttctttatagttctatgtattttatttttgcatataaaaacatattccaaaaaggaactctaaaagctttcaccacactgccaaaggagtccataacacaaaaaagattaagattcctgttctacggtcaaaaaataaagaaacataatcacatttagggtaattttctgtatataaaaaaactacctgttttttattaagggtcatatgctcattttctatagagcagggaccatatgtcattatttttggcagccttcacttcaaaactggtttgcaagtagttgtgaatgtgatataacagcctagcagattcatgggttcccctggctcactggcagtcatcctagtccaaacatagaaagcctcaaactaatataactttcaacttgtggtacaagagaattcccaaaagaaagcaaggggcaaggcacagtggctcacgcctgtaatcccaacactttgggaggccgaggcggatggatcacttgaggtctggagtttaagaccagcctggcccacatgatgaaaccccgtctctactaaaatacaaaaattagctgggcgtggtggcgggcacctgtaatcccagctgaggcaggagatcgcttgaacccaggaggcagagtttgcagtgagctaagattgcaccactgcattctagcctgggcaacaaggcaagacttggtctcaaaaaataaataaataaataaatagaaagaaaggagggaaaagacacacacagaaagcctgctattaatatatatctattaacctggtttacgaatggtaaaatacaggtaattcaattatttacattaatgaataaggtaggtaacaaacctaaaagaatgccaaatatgagactcatttctttttatcttctgaggtggcgcttcggcacatgctgcaaacgtaaaaaggtacattccttgaatttactggctaaattgtagaaaggaattaggatttaaattctgccacaaataatccacaaagcaattaacaaaacaaatcacagatgaaacatgtgtttaagtactcatttgacaggaatactgtgaaaagagaggtttaggactaaaaacagaaaggtttacgcttaggaaagaggttcaaggacttagggaaaaggagatgccagaagctgccaagcagataagcaggagggttgacaaggcctaaagtgctgatcccctcactctcccaagtcacccctttttctaatatgcttgatgtgtgataatgtcaaagatgtacaagcagccagccacaatcttgagcaaaaaagggactctcacagtcctgtgataattggcaagtgccctgactttagggtttctccaactggaaacaaatccaagaaaaaaatgacttttacaaaaatgtattctttccaatctatttcaaggtaacacaaactttgatgtaagggagacctatttctgcttgattcagaaagggaaatttctattagtagaaaaatcagaaggtctgcttcagatcagttatgtaaatacttagaaaagcatgatgcttaagtaagaactctactattattagcagatattttgctattatccatcattaataacaatggaaaattatgctttttatttgagcatttcaaaaactaattctcatcagcacttataacatctctaggagaggttattcagctccctagggaaatactgtctaacttaaaggccagacagctctgaattataaatggagtcagatggtttacaaactctatgaaattacatacaaaatttggtaagttcacatatatttcagattattaaagggctgtttaatcataagaagagttacctctggccatggttagaaaatctacaacaagagaaagcaataatgctttccatacatagtcacagggcgagtaaatgttaacatcggagaaagtcaccagggactgctaagtccaggctctatctgacgaggtcattcttcttaagggatcacatatccaaaaagcaggtccccagggaaaataaaaccccactgcttatgggaggagagtcatagactgagggggaatgaagctcattctttatcaaccaggccatcatgctagttttcaaagggaatttgcaaagcaaatcttttgtcctacaaaaagattcatttcattcagcaaagaaaaaagaccctagagggagtactgctgaatcccaagcctcttccacagtctgttaccttgaagcatagatgctgttctagaagaaacccctgggtagttccttttagctatgtagaatgtaagtcaagtaaacatctaatgtgctagaaaaaggtgtaactaaccaatttatttagccaagaaaaggctatcccccaccattctcaactcattcccattcaagaacctatctgaactctattcccctattacagagtgtagggggcaggagtggttatcagattaatacactgtacgataaattaaatgacctcatacttctcctattataaaaagcactggtggcacaatcaatagcaccttctaaaaagagctgtaaggccaggcgtggtggtcacacctgtaatcccagcactttgggaggctgaggttagtagatcacctaagctcggaagtttgagaccagcctggccaacgtggtgaaaccctgtctctactaaaaatacaaaaattagccaggcatggtggcacatgcctgtagtcccagctattcaggaggctgaggtaggagaatcgctttgaaccaggaggcggaggttgcagcgagctgggatcgtgccagcacactccagcctgggcaacagagtgagactctgtctcaaaaataaataaataaataaataaaataaaaagggctgtaagagagaaggaagtagtaacattcactttaatttcatctacatcactcacagccctaaagaaagggaatgtgtaggaaataaagtcagcagctaaagcttcatttacattacccatagtgtggtatcattcctagcatgccaggcttggcctcagtgtacaaatcattgaattagagagctaagtacattgaagtctctcccatgtggcatcccaatcaccattattgacactgcgagtgtcatcattttgtccccctttctttctcatcatggtcatagtttactgctattactgcactaaatcccattctcaatgtctttttactagcaattctctgtacttgccaaatcactaaatatcaagataaataggctctggaggtcatatctgccttcctacttccattttattgttggcagattattttctgcccctatcttgagtttccttcccaacccttgttcctacgctcaaagcttcccgttcctcatgagcagtttctcataccacaaacccctaaatcctcactgcctctataaatatcacaaataccactgtccctttttttttttttttttttgagacagagtctccctctgtcacccgggctggagtgcagtctcacaatctcaactcactgcaaccaccgcctcctgggttcaagcaatcctcccacctcagcctccccagtagctgggattccaggcatgcgccaccacacccgcccagtgtccctatttcaatataatttctggttctcccaactgagatgccgagtttcagctctcacagctagtcacctcaattacattcaggaagcctcctccagttaggccaggctaatacagcctgttcccaattgcatctttgtacttccaaagagttccctattcatagaatcattacattttagaaccaaaagaaaactcagaaatcatccggtccaatgtttttcaaacttttaaagtacattttgcttcttacactttgagatgtacaaaatctattttacatcataatctcatacacacataactcaaacaaatcacatgaaacaatacttacccttactatgtaaacacactgaaagtttctattctattccactttttaaaagaaaagtacaggttcaggccaggcgcggtggctcacactgtaatcccagcattttgggaggcctaggcgggtggatcacctgaggtcagcagttcaagaccagcctggccaacatggagaatccccatctctactaaaaatacaaaaattagccgggcgtggtggcgcatgcctgtaatcccagctactagggaggctgagacaagagaatcgcttgaaccagggaggcggaggttgcggtgagctgagatcgcgccactgcgctccagcctgggcaacaagagcgaaactgtctcaaaaaaagaaaaagaaaaaaagtacaggttccatccactaaattggtttcacagctcaatactaggaagaaacccatagtgtgggaggcattaaactagtccaaacttcccattcactgatgaagaaactgtaactcagtggtgaagtttgtccgtaaaaattaaactcaggcctgttaagttccagaccagtgttctttccactaaagaccttctctgcccagtcacggccaatcacaccccgtgcccaaacacaaccctacagcgccatcgcccatcacggatgccatcctcttctccaagtcagcccctcgaagtcactgctctgggtcggagtcccctcgcggccgctgctcgtgttcccttaggtccggatcccccacagtcactaccaatcgatcagagtctccttggagtccttgccccttgatcatagtcccttgcagtcactgcctcatacttcctcggtccaagtgccgtcgcagccccggcctcgcgctctccgaggtcaccgtgtttcgcattcactgctcctgggtcacagtcccctcgctgtcactggccctcggtcacagtagcctcccagcccctggctcccactgccctcgctgtcacttaccactcttcctcagtcacagtcacctcgcggtcccagccccacagtttgtcctctcaaacagagacgcaaagataggcacacacctgcaactcacgctcccccgagcccggtccggtcggatttctggccggcgccgcgtcactgactagggaagttgaggaggttgcggggagacgcccggggaaggcagctgatggaagagccagccggaagttccgcctacttcccctacctctgtcaatccgaccacgacttctccttgaaaaccacgactcctgacacagtagttccgcctcctcagaggcccccgggatgaagtgacccagcagaaataccagagaccggagacggaatggcccagggtcagcctccacccggaaccggaggatgcagcgaagacgtctccttgaagtgggatacggatgtgaaccggcccaagtgctcgccggtccgtcaagacgcgctgcccggctgctcccgtgtccaactcgggctgtgtccgcccaggcgggcctgtgcgcggaggtcctaccgctgcacctccgcgcctaccgcagcccgcacccccgcacccgggcagccaacgtgcaggaggcccgggcgccttcagcggagacgccccgaccgcggctgcctcgccgcagcgttagcttttacctacgtggggaagtaaggggaatttgcgaccgccagcccagtccgctgaaaacctgtggctgacccaccctcttcctttttctgacccacgttggctccaaaaaaaaaaatccctagggatccactgggagccagttgagcaggagtggattaagacacgtgtcgcagggtgtatggtggaaagaaacgttttcctttgctagaatgaaccttgggaaggatcccttttgattccgtagatgtaagaggctacacaatattatggaagaaggatgtaaaaaaaatgtattattattttttagttaccaactggactgaagtaaaagaccttttaaacttatttacttattcttttatttttttaaaagacggagcctcgctctgtcgcccgggctggagtgcagtggcgcgatctcagctcactgcagcctccgcctccagggttcaagggattctcgtgcctcatcccgagtagctgggattacaggcatgcgccaccacgcccggctaatttttgtatttttagtagagtcggggtttcaccatgatggtcaggctggtctcgaactcgtgacctcaagtgatctgcccgcctcagcctcccgaagtgttgggatcacaggccaccgcgcccagtcaactttttgttgctattgttgttgctttgctttttttattttattttgctttttttgtctacatcaagggtatccaatcttttggcttccctggggcacattggtagaagaggaattgtcttgggccacacataaagtacactaacagtaacaatagctgatgacttaaaaaaaaaaatcgcaaaaaaaaaaaaaacctcatgtgttttagaagtttacaaatgtgtgttgggccgcatgcaaagctgttctgggccgcggcttggacaagcttggtctacatgcttaacttgaaagtggctgagaagaaagaggatgggtataactgcatctgctgaggagtttccagggggaaaaaggatttaaacctgaatttcaaatatgtctttgaacatggcggttagactaaggtaccccaaataaggacagttagctggagaagacaccgcggcctctaaggggaacatcactacaaaaatagagttgagatagtaaccaacatcagaatctcagtcttaagggaggatgaatttcataagaccctgacactgtggacaaagaaaatggatgggtgtttaggctaataagctatgtaagacataggatggcaagagctgagcaaaaacactgtgtgagaaagatgaaggcaacaattcaaaatgtaggaaaaagcagccaggcatggtgtttcatgcctgtactcccagcatattgggaggctaaagcaggaggatcacttgaggccaggagttcaacactagcctgggcaacatagcaaggcctcatctctataaaaaataaaattactgttgggagggcaacatgggcggatcacaaggtcaggagttcgagaccagcctggccaacatggtgaaaccctgcctctactaaaaatacaaaattagccaggcgtgggggcgcatgcctgtaatcccagctacttgggaggctgaggcaggagaatctcttgaacctgggaggctgaggtttcagtgagccaagatggcgccactgcactccagcctgggtgacaaagcaagactctgtctcaaaaactaaataaataaaataaaattactggccaggtgtggtggctcacacctgtaattccagcactttgggaggccaaggcaggcagatcacttgaagccacaagtttgagaccagcctggccaatgtggcaaaaccccatctgtacaaaaaaaaatacaaaaattaggtgggcatggtggtgcctgcttgtaatcccagctactcgggaggcaggagaatctcttgaacccagaaggcagaggttagtgagccgagatcgtaccactgcactccagcctgggcaacagagcaacactctgtctcaataaataaaaaaataaaaataaacattttttaaaaatagccatgtgtgttggcatgcctgtagtcccagctactcaggaggctgaggtggcaggatcacttgagcctaagagttcaaggctgcagcaagttacagtcccgctactgtgccccagcctgggcaacagaacaaggcccattctctgaaaataaaaataaataaattcaaaagttattttaaagatgtaggaaaaagctttatgcacaaataaagccatgtctttattttttataatagtgaaaaatcagaaataagcagaccctcaataaggaactggcaaaaataacaatatggtataacctattgaaataaatgccgctattaagtcatgcatcttaaaatcataatgcaaataaaatgacataaaaactgttcataacatcatgagaaatgaaaaatgagggtacaaaattatatgttttttaaaccttggaaataaaaaacattggtagaaaatataccaaaatttttaccattggttatgtttgaacaattgaaatggcttttcccctacttttttctctgtgttccagtgtaacaagaatatagtagggccgggcgcagtagttcacacctgtaatcccaacactttgggaggctgaaatggatggatcatgaggtcaggagtttgagaccagtctggccaatatggtgaaaccccgtctctagtaaaaatacaaaaattagccaagcgtggtggcacttgcctgtagtcccagctacttgggaggctgaggcagaagaatcacttgaacccaagaggcggaggttgcagtgggccgagattgtgccactgcactccagcctgggcgacagagagagactctgtctcaaaaaaaaaaagaaagaaagagagaaagagagagagagggagagagagagagagacagagagagagagaggaaggaaggaaagaaagaaggaaggaaagaaagaaacagaacatagtgtaacaaaatcaaaacattaaaaatataaggcctaaaacacaacagattcagttgtcaaactactaacatctttattttgtcaagatatttaacaatattaaaaagttcagatttcttcatggtcatgtcttttaccagcttttcaaagattcattcagtagtagaaacagccaaatgctgctacaacgcagaataaactgtcctaaaaaataaatacaacacacacacacatccagaatgttagtactaaagagggaatgagagcagcacaggcaactgaaactaacaccatctcagatctttccaattttttttttcttttttgagacagggtgtcactctatcacccaggctggagtgcagtggtgtgatctcagctcactgcagcctcgacctcctacactcaggcaatccttctacctcagcctccagagtagctaggaccacaggtgcctgccaccataccaggctaattttgtttattttttgtaaagatgaggtctcactatgttgcccaggctgttcttgaactcctgggatcaagcaatccacccatgttggtctccaaaagtgctgggatcataggcgtgagccacctcacccagccaccaattttcaatcaggaagactttttccttcttcaagaagtgaagggtttccagagtatagctacactattgcttgcctgagggtgactacaaaattgcttgctaaaaggttaggatgggtaaagaattagattttctgaatgcaaaaataaaatgtgaactaatgaactttaggtaatacatattcataaaataattattcacatatttcctgatttatcacagaaataatgtatgaaatgctttgagtttcttggagtaaactccattactcatcccaagaaaccatattataagtatcactgataataagaacaacaggaccttgtcataaattctggataagagaaatagtctctgggtgtttgttcttaattgataaaatttacttgtccatcttttagttcagaatcacaaaatgctttccagagcccagtcaaattgcttaaaacatttttaggcatttattacaagatttccacctgcctcagcaactcctgcaccactaacctcacctccagcctggtaatgatgggattaaaacaattccaactcaagtacctgatgattaaccaaaagcaaaattctttggtttagcccagctccctggctccttgggtggataactctgaactgtgttctacgacagtgctgtgataaaggacctgctttgtttttaacttccggtccttcatggaaggatgcttttgtaaaatgcaataaaaataggtaactcagaacatgaaatgaaaaaaaggaacatacaaatacagccccaatttttttcttagattcactgcacagaagattactttgtcaaattgctgtaagagtttctaaaccaacccttatactcagtgtattgtttacctcatcatggacctgtaacaaacaggtcacagagccgtgctggtctgtgcaccccactgtgagtggccctgttctacagcaccacccagagttctccaacaggactgagccctgtcatccagcagttttccgctcaataccacatgattttccctcctttctcatttcctctgcctctactaatgtttcctggaatctcccaaataaagtgctttttttttgagacagagtcttgccctctcgcccaggctggagtgcagtggcacaatcttggctcactgcaacctccgccctctgggttcaagcaattctcctgcctcagcctcccaagtagctgggactacaggcgcccgccaccttgcccggctagtttttgtatttttagtagagatggggtttcaccatgttggccaggctggtcttgaactcctgacctcaggtgatccacccgcctcggcctcccagagtgctgggattacaggcgtgagccaccacacccagcctaaagttttttattacatatttgttcatttgagtattgagtggcccccactggatgttaataggcagaaaccatgcctgtcttattcatcattttgtccctagcccctcaggtgcagaagctgacacataataggagctcagaactatttgttgaatgaatgaattgtatcatctaaagatgcattttttggccaggcccagtggctcatgcctgtaatcccagcactttgggaggccaaagcaggcagatcacctgaggtcaggagttggagaccagcctgaccaaatagtgaaaccttgtctctactaaaaaatacaaaaattagccgagcgtggtggcatgcacctgtagtcccagctactcgggaggctggggcaggagaattacttgaacctgggaggcagaggttgcagtgagccgtgatggcaccaccactctccagcctaggtgacagagtgagactccgtctcaaaacaaacaaacaagatgcatttttttttttttttttgagacagagtctcgctctgtctccaggctggagtacagtggcacaatctcgcctcactgcaacctctgcctcccaggttcaagcaattctcctgcctcagcctcccgagtagctgggattacaggcacccaacaccacacctggctaatttttgtatttttagtagagacggggtttcagcatgttggccaggatggtctcaatctcttgacctcatgatccgcccgcctcggcctcccagagtgctgggattacaggcatgagccaccgtgcctggcaaaaaaaaccatcttcttagcttgactattcccccaaagatagctgataaattaagatttacatagtacttcccactgtccagcccctgatccctagggtagttaagcataaaataaaactttggtggggctgggcgcagtggctcacgcctataatcccagaactctgggaggccgaggcgggccgatcacctgaggtcgggagctccagaccaacctaaccgacatggagaaaccctgtctctactaaaattacaaaattagccaggtgtggtggtgcatgcctgtaatcccagctactcggaaggctgaggcaggacacttcaacccgggaggtggaggttgtggtgagctgagattgtgccattgcactccatcctgggcaacaagagcaaaattctgtctcaaaaaataataaaaataaaaataaaaccttggtgagaccatagaattttagagctaaaagctaccttaaaatcatctacataagcagtgtccatatctggcagtcagcagaatcatggggaactttttaaatattctgattcactgatctaacccctggcctatttgatcagaatctatttgaatagggacccagcgtctatattttaaacaacttcccagatgatccttaggcagtcacagccagtctttgggaaaatgtacttcagcttcctaatgtcactgatacaatgtgagaaaaatccaatgacttacctgaagtcattcaattagaaagtgacagaactggagatggaatccccctcttatttctttttacttttttcttttttctttttttaatttttgagacagagtcttgctctgctgcccaggctggaatgcagtggtgcgatctcagctcactggaacctccgccaccaggttcaagcaattctcctgcctcagcctcccaagtagctgggattacaggcgtgcaccaccacacccggctaattttttgtgtgtgtgtttttagcagagaagaggtttcacaatgttggccaggctgctctcaaactcttgacctcaagtgatccacatgcctcggcctcccaaagtgctgagattacaagcgtgagccaccccacctggcctcactctcttaatttactcaatctagtttctgttctactctaactctgactctatgtattcacaacctgggagtagacgaatagaggatgcaatcctttctggagtaaatataaaataataacttcaatgaaacctcttttatgtgtgtgtgtgtgtcacccaggctggaatacagtggcacaatctcagctcactgcaacctctgcctccggggttcaagcgattctcctgcctcagcctcctgagtagctgggattacaggtgcccgccaccatgctcggctaatttttatatttttagtagagacaggctttcaccatgttggccaggctggtcttgaactcctgacctcaggtgatccgccctccttggcctcccaaagtgctgggattataggcatgagccaccgcgcctggcctgaaacatctttttaaagattcctctttatttttgcttaattttaataaatggctttaagataaagtaataaattttactactaaaaaaaaatgacctttgctcatggaatccctgccatccacatttgtttgcaacttagcaaagtgtgattggttcaaatgaacaaataagtgattttaaaattttagttataaattattactttaataaggattatcaggattgagttttagaacactgatttatggaggaagtggctaaaaataatgtttaaataatatgctaactaaataatatgctattcagaaattcaaacccatgaaaaattatgtcatatgtaaacatgtaagtttccttgcctataagcagcactctaggtttctgctttagtaacacaaaaactaacagtaaaatcatttcattcacaagtcaaagatgaatgactaagacagcagtgtctttccatcccaatcaacagtaaatagtttgatttgcggtgcccacgttcttagaaagggaaaagaggtttccaaatacacttacattcatgaaaacatcatgagtatagttgtcagtgtcagcatcccagaaacagcgagaagccatgctaaaaaatccaagaatgaagaattatcaacaatctaacaaggacctaaacgacacatatctgccacgagaaacagtgttccttaatacattctcatagatctgtacttccaaacctttcacaggtaggtacccacagagtattgtatttgtaccagagagtatactgggtaaaccggagaaactagagtcagatgaagctgcttgcaactagaggtgaccagccaggtactctgacagcctcagaccctacctgatggctacagggatcaatactagagatttgtgtgtgacttttaatgagctcagctcctgcacaataacaggacgaggaaggcacagaaagagcccaacagatttagtccaacctgatcattttatagagtcccagaaaaaggagcaaactctgaactagaattcagtcttctaacgaattataactccaaaaatatctctacagaatgctaaactaccttgaaattggctattctcctctctgcaattcttggataagaaaaaaatattagtcaaaataaaagccaattaaaaatggaaacaacttaaatgcccaataggactggattggtaaatgaaattatggtatttctcaggatctgggagaattttttaaaaaaagaaaaaagaaataatgatgttttctggcaatgaaattctatgtagaccttaaagaaaagttttgcaagacacagtgacgtgtccctgtagtcccagcaactcaggaggctgagacagggagtatcatttgagcccaggagttcagggatgtagtatgtgaagatcacacctgtgaacagccactgcacttcagcctgggagacacagcaggaccctggctcttaaaaaaaaaacaattctgcactttgggaggccaaggcgggcagatcacgaggtcgggggatcgagaccatcctggctaacacggtgaaaccccatctctactaaaaatacaaaaaattagccaggcgtggcggcaggcaccagtagtcccagctactcaggaggctggtgtgaacctgggaggcggagcttgcagtgacctgagatagcaccactgcactccagcctgggagacacagcaggaccctggctcttaaaaaaaaaattccaagaacatgaaaagctattcacaatataatgttgagtgaaaaaaataggctgggcatggtggctcacacctgtaatcccagcactttgggaggctgaggtgggcgaatcacctgaggtcaggagttcgagaccagcctgcccaacatggtgaaaccccatctctactaaaaatacaaaaattggctgggcatcgtggcacacgcctgtaatcccagctactcgggaggctgaggcaggagaatcacttgaacccaggaggtggaggctgcagtgagccaagattgtgccactgcactccagccttggcgacagagtgagactctgtctcaaaaactaataataaataataataataagtgaaaaaaaaattacaaatgttttacatttctattaaacgtatgtgtatgatttatcatgcaaacacttattgagcacttactttgtgccattcactagtctaagtgttttacgtgtattaactcactgaatcctatgaggtactataattttacccatttagtgaatgtgacaaatgaggattagagaaattaagtgtacaaggtcatacaactaggtaacaaagcttggctttgcacccaggcagttcacaacccatacccacagagaaacatacacatataccttatattatattggttcttttttttcctgaaacaaaaggtctcacatatttattactgaacccagcctactatcgcagggcatataagcaaagagaaaaaatatattcccaataaaacacgtccaactgttcagacagtggtgacgttttcagcttgctatagtaagatggccgtgaccttgatacagcgtgaatatgtgtgccagctcacgtgcagttccttatagacccagcttggctgttctgcaatgtctcctttccagttgtgcctgattttattaccagttttcaaccagatccactggagaatgggacgatttggcttttgtttcttggccaggaatcgcttactcttaaaagacttgtgagaagacatgacaagaagcagaatcaagcacacaccacaagagagagttgtttgttttttgagacaaaaatataaaatagtgagaccccaattgttttatttatttatattttatttttattttttgagagggagtctcactctgtcaaccaggctagagtgcagtggcacaatctcagctcactacaacctccacctcccgggttcaatgattctcctgcctcagccttccgagtagctgggactacacacgtgcattaccacgcctggctaatttttatattttttgtagagacagggtttcaccatgtgggccaggctggtctcaaactcctgagctcaagcaatcggcccacctcagcctcccaaagtgctgggattacaggtgtgacttggaaaaagtgtaatggtacagtttgtagcaggctaataatgctcccaccaagaacagtaagaaaagctggataaaatgaatcagggagctgccaaagcaaacaggcctagaggagccaaaattccagaaagaggtgaactctaggaggtaagctgatattccgcagcagatttttttcctggaggatttgccaattcagggcacagggctagatgctgagaatctgggccttgctcaggtaaagaacaaattactgagggaaaatttaactagtaggagagttggcagtctttactttttaaaatttttttatttattaattttactttgagacagagtcttgctctgtcacccaggctggagtgcagtggcacgatctcagctcactgcaacctctgcctccccaggccaagcacttctcatgtctcagcctcccgagtagctgggataacaggcatgcaccaccatgcctggctaatttttttttttcttttttttttttgagatggagtttcactctgttgcccaggctggagtgcagtggcacaatcttggctcactgcaaccacaacctcccgggttgaagcaattatcctacctcagcctcccaagtagctgggactacaggcacccaccaccacgcccggctaatttttgtatttttagtagagacggggtttcaccatgttgggcaggctggtctcgaattcttgacctcaagtgatccaccggcctcggcctcccaaagtgctgggattacaggcatgagccactgtgcttggccctaattttttgtatttttggtagagacggggtttcaccatattgcccaggttggtctccaactcctgagctcaggcaatctgcccgccttggccttcgaaagtggtaggattacaggagtgagccactgtgcccagcagagtcggcagtcttaacaaagctaaggaggtaaaatcagattctggagggaagatcccataaaaaaggagaaagtagaactgagcgtatcacatggtaggttttcttttcaagacatgctgaattcaggccgggcacagtggctcgcgcctgtaatcccagcactttgggaggctgaggcaggcggatcacgaggtcaggagatcgagaccatcctggctaacgtggtgaaaccccgtctctactaaaaatacaaaaaattagccgggtgtggtggcgggcgcctgtagtcccagctactcgggaggctgaggcaggagaatggcgtgaacccaggaggcggagcttgcagtgagccgagatggcaccactgcactccagcctgggcaacagagtgagactctttctcaaaaatagaataaaataaaataaagtaactagtatgactaaatcacaagggtccttacaaaagaaagagggagtaggtgggtcagagtcagagagttgaagatgctgtgctgctggctttgaaattggaggaaacggcttatgggctaaggagttcaggggcctctaactggaacagacgaggaaatggattcagtcttagagcctccagaaggaatgcagccctgctgacatcttcattttagttcaatgaaacccattttggatttctgatctccagaactgtaaagtaatatatttgtgccattttcagcactgagtttgtgataatttgttacggcagcaacaggaaactagtacactaaggaaaaagcctctgacatgaagagcaaagttttatgctgaggagacaagatctgaaagtcagcacctgttggaggtagaggcctgcagaggcctaatgaacattcgaggttcttggttgaaagacttggagggctacaattaagaaacaagggggccaggcacagtggctcacgcccataatcccagcagtttgggaggccaaagtgggtggatcacctgaggtcaggagtttgagaccagcctggccaacatggtgaaaccccatctctactgaaatacagaaattagccgggcgtggtggcgtgcgtctctaatcccggttactcaggaggctgaggcaggagaatcacttgaacccgggaggctgaggttgtggtgagccaagatcatgccattgcactccagcctgggcaacaagaatgaaactctgtctccaaaaaaaaaaaaaaaaaaaaaatagaaacaagggtgaggctgggtgtggtggctcacacctataatcctagcacttgggcacttggggaggccaaggcaggagaatcacttgagccaaggacttcaagaccagcctgggcaacatggtgaaaccccatctcaacaaaaacatacaaaaattagttgggcgtggtggctcatgcctacggtcccagctacttgggaggctgaagcaggaggatcacttgagcccaggagccagaggttgcagtgagctgagatcgcaccactgcactccagcctgggcaacagagttgagactctgtctcaaaaaagaaaaaaaaaagggatgaatttaagatagggcctttttaaaaccacaactctcagatgagttggcacaagaaaagaaaattttttaaaaagataaaactgtaacccaacctcaattcagctcagtacctgaagctaagcggccaatactcttcctgcacagcagaagagagagttaagtcctttctggaagaaaataatatcatctggaggtctataattcttttaagcaatatctaagattcaaactaggcatgccaagagacaaagccatatacatgattatcaagaaaaatacaatggaaacaaactcacacatgacccagataccagagtaagcatataacaacataaaaataactactgtggctgggcgcagtggctcatgcctgtaatcccaacactctgggaggctgagcggggcagatcacttgagatcaggagttccagataagcctggtcaacatggtgaaatcctgtcactactaaaaatacaaaaactaggcgggtgtggtggtgggcaccagtaatcccaattactcgggaggctgaggcaggagaattgcttgaacctggaaggtggaggctgcagtgagcagagatggcgccactgcactccagcctgggtgacagagtgagactctgtctcaaaaataaaataaaataaaataattagtatgactaaaatgtaaaaatagagtggggagggttaaaaaagattgaaggataaagccttttactagataactgaaatctataaaaactaaatgtaaattcccaaactgaaagatacaataactgaaattaagaactcaggttatgggtttaactgcagatcagatgcaacagaaaagaggatgattgacctaaaaggccaatagaaaaatatacaaattggccaggcacggtggctcacgcctgtagtctctgctacttgggaggctgaagcacgagaatcgcttaaacccaggaggtgaaggttgcgatgagtcgagatcacaccactgcactccagcctgggtgacagagcgagactccgtctgaaaaaagaaaaaatatataaactgaagcacagagaggaaatagaaaaatcagaaaaaagcataagagacatgtggaatactgagaaaagaccaaacatacatgtaacctaaatcctaaaaagagagcggagtggaaggggcagcagcagtgttttaaaagagaacggctacctctagggccccaagcttagtttctaatgccattctccaacacattgaacaggggctccttggagaaatggctgaattgtagggctggggtagggaatgaacacagtggagcttctgatagtgctggaaagtaaggaagtgctcaaagaaacccacaatagtagagtcagtgggacacaggaatccactgaaagctctcaatggccaagctggaacaattagaactacaaaataaataaagtagtattgaataatcatccaaagtataaaatatccatgagtccatgttgaaataaatgacagaatacataaataaatgggagaggagagacaaatttcctgtgctgaaaattccaaagaatttacgcagatacgatgcccttgaggaggtgggtcataactccctgctctttcagtgtgggctgcacacgatgatttcctcctaatgagtacaggatgaacacggaggaaatgaaaccgcctttgcaaaatgatgactgagacagtgaaagagatccaacctaaccgactccatcttgcgtctaacctccaagctgcccttgttcattcctgggcgtaggctgaactaacttggggggaaacttaatttatagtttaaaacaaagacggtaacagccctttcccaaagcagacctccttcttgccgggggactagactaacattagtcacaagattagaaatgatggtttaggagccatgcagctggaggctacaagattctgaccctccctacactgctcctaagatcagcgcttgagatattttgcagaccctgcacttgatggatcagctggcaccacccagatggataaactggctcatctgatcttgtggccccgacccaggaactgactcagcacaagaagacagctgactccctgtgattccatccctgatcaatcagcactcccggctcactggctctccacacccaccaagctgtccttaaaaactctgctccccgaatgctgggagagactgatttgagtaataataaaactccggtctcccgcacagccggctgtgcgtgaattactttttctctatggcaattcccctgtcatgatgaatcggctctgtctaggcagcgggcaagtgaacccactgagcagttatagaaagagtaagtttatagtaaagaaacctgagaagcattagctcaggcagggaggcaaagttcatatgaacagtaacatgtcatgttgacagtatgtaccattgatatgatatgacgagaatggcgtcttacctctgtgatcttccttccaaaaacctgtaacctcagactaatcattagcagaaaaatcccagtgaaggaacattctacaaaacacctaaccagtactcctcaaaaaagtcaaggtgatgaaaaacaagaaagtctgagaaactgttaccgccaagaagagcccaaagagacatttaatgtggtatcctagatagaatcctaaagcagaaaaaggacattaggaacaaactagaaatcagaacaaagctttatttgataacactgtatcaatattgtttcattaattataataaatgttccatactatgtagatgttaaccatagggagtccgggtgcggtagatgatgcctgtaaccccagtgttttgggaagccgaggcaggaggactggttaagcccaagaggtcaaagctgcagtgagccacggttgcaccactgcactccagcgtgggcgacagagcaagaactgtctcaatagcataattactattcttacagtaacagggaaactgggtgtggagtatacgctaactctgcaacttttctataaatctaaaactattttaaaataaaaacttggtttttttatttttttattttttgagatagagtttcactctgttccccaggctggagtgcagtggcgtgatctcagctcactgcaacctccacctcccaggttcaagcaattctcctgcctcagcctccaagtggctggggttacaggtgtgcaccaccatgcccggctaattttttgtaattttagtagagacagggtttcgccaggttggccaggctggtctcgaactcctgacctcaagtgatccacccacctcggtcccccaaagggctgagattacaggtgggagccactgcacctggccaaaaactgttttttttaaacaaaggtaatggctaagaattttcccaaactgataaaaaaaatcaacctggctgggtgcagtggctcacactggtaatcccaggactttagaaggccgagcatggtgttggcacctatactcccagctactcgggaggctgaggcaggagaatctcttgaacctgggaggcagagcttgcagtgagccaagatcgcaccattgcactacagcctgggagacaaaagcgaaactccatctcaaaaaaaaaacaacaaaaaaatcaatccatagattcaagagactctgagtgctctaagcagaataaatacaaagaaagtaatagtggctagagaggacataccatcttaaattgaataataaaacttacagctgacttctcaacagaaacaatggaaactagaagacaaggtaagcacttatctacctacctacctacctacctatctgaggcagggtctcactctgtcacccaggctggagtacagtggcacaatcacggcttactgcagtctcaaccttcctgggctcaagaggtcctcccacctcagtctctcaagtagctgggaccacaggcgtgtgccaccatgcccggctaatttttgtatttttttgtagagacagagttttgctgtgttgcccaggctggtctggaactcctgggctcaagtgatcctcctgcctcagcttcccaaagtgctgggattacaggtgtgagccaccacgcccggccctgatgggaaactttataatagatggatccatctgacaatatctgaactccatgatcaaccttaacaaagcaaaaagagatgaccagctattttgtaccttctgagaagatgcaataggatgtatagaaaacagtatttccccaacctcaaacctatggctaattaagactagatctaactacttattttcaagaagtacaggaaatagaagacatattaaacaataccataggtatataatcagcaactgccagaatataggaaactctacaggacaaacaaaccaatttcttcaacaaataaatggcaggaaaaaataaataaataaataactgacagggcacagtggctcacgcctgcaatcccagcactttgggaggccaaggtgggtggatcacctgaggtcaggagttggagaccaacctggccaacatggtgaaaccccatctctactaaaaatacaaaaattacctgggcgtggtggtgagcgcctgtaatcccagctactcaggaggctgaggcaggagaatcacttgaacccggcaggcagaggttgcagtgagccgagatcatgccactgcactccagcctgggtgaggaagcaagactgtcataaaaataaaatcaaatggcaggattaaaagaagaaagagagaaatgaggcagcaaaaacaacacattgaagtaaatttaaagccagatgctgtggtgtgcacctatagtcccagctacctggcaggctgaggtgggaggatcacttgagcccaggagttctagtctgtagtgtgttatgatcacatctgtgaatagccactgcactccagcctgggcaagatagcaagatcttacgtcttaaaaaaaaatcctaatttacatattaaccaaatgcaatgtgtggaccttgtttgaatcttaatttgaaaaaattgtaaaaagaaaataataggtctggcatggtggttcaagcctataagtccaccactttaggaggccaaggctggtgaattgcctgagcccaggagtttaagaccagactggccaacagagtgtgacccatctctgcaaaaaaaaaaaaaaaaaagaaagaaagaaaattagccaggtgtggtggtgcacacctgcagtcccagctactcaggaggctgaggcaggaggatcacttgagcccaggaggccaaggctgcagtgagttgtgatagtgccattgcacaccaacctgggtgacaaaatgagaccctgtctctttaaacaaaaaaaaaagaaaagaaagaaaacacatacatacatatatgaggcatatctgaataataacagcatattttatgatattaaggactgacaatattttagagataataaagatattttatttatttatttttgagacagagtcttactctgtcacccaggctggagtgcaatgacacgatcttggctcactgcaacctccacctcctgcgttgaagtgattctcctgcctcagcctcctgagtagctgggactacaagcgcacgccatcacacccggctaatttttagtagagacggggtttcgccatgttggccaggctggtcttgaactcctgacctcaggtgatccacccgcctcagcctcccaaagtgctgagattacaggtgtgacccatcacacccggcccttctcactcttgtaaaggcactcttactgaattgtccaaaggacagatacctcataagaaatatagatgactaaaacaagaaggaaaatccagctactcacaatactccttcacctctttgttctccaatcactacttgcaccaccattttgtatcggtcaaatcccatttctagaaagaaaaaataaggttatttataagcaaatatgtagtaaaattacttattgaagacaaatttgcccagaaatggacataaacattcaatccacaagtacttaatgaatatggtggtaagcttgggggtcaggaggacgtgaaggcagatcctaactataactcagcaagtgtataacctcagaaagtaatttaacttttcagtttaagtctcccttattaaacaggaatatcagtacctacctcccaagattgttataaggttaggtaagatatagtagtatcttttttttgttttgtttttgagatggattctcactctgttgcccaggctggagtacagtggcacgatctcagctcaccggcaacctctgcctccagggttcaagtgattctcctacctcagcctcctcagtagctgggactacaggtatgcatcaccacacctggctaatttttgtatttttagtagaaaaggtgtttcaccatgttgcccaggctggtctcgaactcctgacctcaggtgatccactcaccttggcctcccaaagtgctgggattacaggcgtgagccaccgcgcccggtcagatatagtaatatctaaagcatctaaacagtgctgttaaatactagtccttcaataaaccttagcttccttcctttttcccctactataagtcagctagtgagctgaaccttcaagatagagaaataaataagacgtttttcttgccttaaagaactcacagtaataaagaactcaaaggaaaatagaaaaataggccgggcacggtggctcacgcctgtaatcccagcactctcagaaggtgaggccagtggatcacctgaggtcaggagtttgagacaagcctggccaacatggttaagccccgtctctactaaaaaatataaaaattagccaggcatggtggcagatccctgtaaccccagctactcgggaggctgaggcaggagaattgcttgaacctgggaggcggaggttgcagtgagctgagatcgcaccattgcacactagcctgggtaacaagagcaaaactccatctcgaaaaaaaaaaaaaaaaagaaaatagaaaaataaattataaattgagtatgcttataattcaaggagtggcatgtatgatgtacatcaggaacacagagccagtgggggcagttcctctgtttgtctgggcagtggcaagaaatcactggaaaagacttcttggaagatgtggccggccaataaactgagtcttgagggctgagtaagaggggaccaggtcagccccatctccccacacgtccgagaacgaggggcatgtgcacagcaggagagcatgggatctccaagaaactgtaagctgttcagtaagacagacaagaaaaaaaatgaagattccagagcaaaacgaggtgatccagcaccatttagctgtttactccagaaactacgttgctaaagcagcaaaatcctgaaaattctcactaacaccaagtctgaagagaaaaaaatggaatgggcatttttgaatctttctacttttttgaccaaggaatagtggaaagagttttaaaaaaacaaaagaagtgaaataagcgaagctgaaagagccagctctctctgatgaacgtgcaggttccaagattacactgtaaacgggacaatctgaagactacaggcaatctcccatgtggggcatgaacctgattcagagtgtgtaaagacagagtccaagttatttttaaaaaacactgcacacaactcagctgagcttcctcctttctctaaccaatcccaaattatacagaaatgtgtctagaataatactcagcccttaaatcacggttctgaggggaaaataaaatagtctcagatatggtggggaggggaacttaaaaaaaaaacccacaccatatcagagcaattaaaaatcccccacatcatatcagagcaattaaaaatcccccacatcatatcagagcaattaaaaatcccccacattatatcagagcaattatgatgtatgggcacaacaaaatgaaatgcagccaaatggcaataaacaaagatgcaatagcaaaaacaaaagagtaacaaagaagaacaaagcttctgctgggtgccatggctcacgcctgtaatcccagcaattttggaggctgaggcgggaggatctcttaaggccagaagttcaagaccagcctaggcagcatgacaagaccaccatctccacaaaacaatttttctttttttcttttttttgagatggagtttcactcttgttgcccaggctgaagtgcaatggcgtgatctcaggtcaccacaaactctgcctcctgggttcaagcaatcttcctgcctcagactcccgagtagctgggattacaggcatgaaccaccacacttggctacttttgtatttttagtagagatggggtttctccatgttggtcaggttgttctcgaactcctgacctcaggtgatccatctgcctcggcctcccaaagtgctgggattacggacgtgagccaccacacctggtccacaaaacaatttttcaaaaaatattgaagaaaagaaagaaacttccagtggaaggaaggaagaaggaaggaaagaaggaaggaaggagctgtgtaagagaaaaaatttggctgggcacggtggcccacacctgtaatcccactttgggaggctgaggcgggtggatcacttgaggtgaggagtttgagaccagcctgaacaacatggagaaatcccatctctactaaaaatacattagcagggcgtggtggtgcacgcctgtaatcccagctacttgggaggctgagcaggagaatcgcttgaacctgggaggtggaggttaaggtgagccaagattgcgccattgcactccagcttgtgcaacaagaccgaaactcagtccaaaaaaaaaaagaaaagaaaagaaagaaaaaaatcaacctaggaagtaatacaaatcaaggaacgaagagttattcctcacaattaattcacaatactagaacaatgtaagcttataaactcaatgaaataagtactcaatcaggttatcaaattttttaactttttttttggagacagagtttcgctcttctgcccagggtggagtgcaatggcaagatctaggctcactgcaacctccacctcccagattcaagcaattctcatgcttcagcctcccaagtagttgggattataggcatgcgccatcacgctcggctaatttttttttttttttgcatttttagtagagacgggatttcaccatcttggtcaggctggtctcgaactcctgacctcaggtgatccacctacctcggcctcccaaagtgctgggattacaggcgtgagccaccgcacctggccaggttatgattttgtttgatttggtttggttttttgagagggaatctcgctctgtcgctcaggctggagtgcagtgggatgatctcaactcactgcaacctccacctcctgggttcaagcgattctcccacctgagccttctgagtagctgggattacaggcacgcaccaccatacctggctaaattttatattttagtagagacacggtttcaccatgttgcccaggctggtctggaactcctgacctcaagtgatccacctgcttctgcctcccaaagttctgggattacaggcgtgagccacctcacctggcctgttttgttttgtttttgtttttttggagatagggtctccctctgtcacccaggctggaatgcagtggggcgatctcggctcactgcaacctccgccttctgggttcaagtgattctcctgcctcagcctcccaagtagctggaaccataggcgtgcaccaccacgcctggctaattctttgtatttcagtagagacgaggtttcaccatgttgcccagggtggtcatgaactcctgagctcaggcaatccacccgcctcggcctcccaaagtgctgggattacaggtgtgagccacggcacccagcctcaatcaggttattaagcaacataaagagatgaaaagaaagaccacggccctagggaacaaacagaatacccagaaaagatcattccagaactaataaattcaaaatggcaagaaaaaagacacaaatgaaaacaattactggtttaagaaaatcacaagtaaatggcaataaaaaaggaagaagcctgggcaaaatggcaaaaccccgtctctacaaaaaatacaaaaattagccgggtgtggtggcaggcgcctgtagtcccagctacttgggaggcggagatgggaggattgcttgaggctgcagtgagccaagactgcgccactgcattccagcctggccaacagagtgagaccctgtctcaaaaaaaaaaaaagaagaagaaagaaattatgggaaagaaaaactaataaatatagaagacaaagatggctcaacataacaatatttggtgtcctgaagaaaaggaagtaacgaatggaataggaaacatattcagagatataaggaaatttcctttatatggaaagaataaagtctgcagattgaaagctataaaatgctcattagaaagtcagaatctttagaaaagctactgagcataaaggtgaagatgaggattattttatttatttatttatttatttatttatttatttattttgagacagagtctcgctctgttgcccaggctggagtgcactggcacgatcccagctcactgcaacctccttcaccccccaggttcaagcaattctcctgtctcagcctcccaagaaatcccagcactttgggaggccgagacgggtgggtcacctgaggtcaggagtttgggactagcaagcccggctaatttttgttttgtttttttgagacagagtttcgcccttgttggccaggcttgagtgcaatggtgcaatcttggctcactgcaacctctgcctcctgggttcaagctattctcctgtctcagcctgggattacaggcatgcgccaccacgcctggctaattttgtatctttagtagagacagggtttctccatgttggtcagcctggtttcgaactcacaacctcaagtgatccgcccgcctcggcctccctaagtgctgggattacaggcgtgagccaccatgcccagcccctaaattttgtatttttactagagacggggtttcaccatattgttcagggtggtctcaaactcctgacctcaggtaactcacctgtcttggcctcccaaagtgctgggaatacaggcgtgagccaccacgtccagccaaaggtgaggattccttaagcagagaacatcaagctgggctcagatttcttgacaacaagttaccactgaatgtcagagggcaatgaagcacaagggtcaagaaaataaattattacctcaaaactatgtatattctacttttgggggtggaggggcgggggatggagtctcgctctgtcgcccaggctggagtgcagtggcactatctcggctcactgcagactctgcctcctgggttcaagtgattcccctgcctcagcctcccaagtagctgggattacagatgcccactaccacgcccggctaatttttgtatttttcgtagagacggggtttcaccatgttggcaaggctggtctcaaactcctgacctcgggtgatccacccggctccgcctcccacagtgcctggattgcaggcgtgagccaccgcgcctggcccatagtatattctactttaaaggcaaaaggcaggcattctcaaacacaaaagaatccagggaatacggcatttctgagtcctttctgaaaacaacttacaacaaaatctcatcatctaggagttgaaataaggaactcttcccagctaattgagaggctgaggcaggagaatcacttgagcccgggaggttgaggctgcagtgatctgaaatcacaccgctgcactccagcctgggtgacgaagaccctgtctcaaaaaaagaaaataaggaactcaacaatgaaaatgacatggtcaaggaactaaacaggaggcaactgatccagttacagaatgaatatgacatgactatgggaaacaggtctacaatatcccattgtcatttgtccatgtatatggacatgtagaagtctgttgtaatgtttgcctagtattaatgattttttttttttttttgagacagagtctcactctgttgcccaggttgcagcacagtggcataatcttggctcactgcaatctccgtccctgggctcaggtgatcctcctgcctcagccacccgaatagctgggactacagatgcacaccaccagcccggctaatttttgtatttttctaagagacagggttttgccatgttggccaggatggtctcgaactcctgggctcaagagatccgcccgcctcaacctccaaaagtgctggaattacaggcgtgagccactgtgcctggccaatattaatgattgtttattggtggtggcattcaggtgatttttctcattttatttttctagtgtttaaattttgtataatgaatgtgtaccattttttacaaaaaatcttaacgatgaaccttcattaaaaagtctaaaaacaaaaatgctaatatactaacagcagttaattctgggtgatagaaatacacaggattgctattctttgtacttttctgtattttttaatttcttaaactaaaaacaaattcagaaaaaaacaataaacacaaatattaaatagtaactgcctttggttaatattttaaaactttaaggggccaggcacagtggctcacgcctgtaattccaccactttgggaggccgaggcggacggatcacctgaggtcaggagttcgagatcagcctgaccaacatggagaaaccccgtctctactaaaaacacaaaaattagccgggcatggtggcacttgcctgtaatcccagctactcaggaggctgaggcaggagaatcgcttgaacccaggaggcggagattgcagtgagccaagatcatgccattggactccagcctgggcaacaacagcaaaactccatctcaaaaaaaaaccttatggatacttttttgtattgtctaggtttattacaacgagcatgtattacttttatgaagatattctttctcttcaaaaaatgatgtcttctaagaagagcagatggaaataggccgggcacggtggctcacatctgtaatcccagcatgttgggaggccaaggcttgcagatctcttgagggtcaggagttcaagacaaaattagccacgtgtggtggcgcatgcttgaaattccaactgcttgggaggctgaggcgggaggatcacttgagcccaggaggaggaggttgcagtgagctgagatcacaccactgcactccagcctgggaaacagagcgagactctgtctcaaaaagaaaaaaaaaaaaaaaaagaacttttcagatcagacggtataacattattaacaaaagagagagaccaggcgcagtggctcacacctgcaatcccagcagtttgcgaggcctaggtgggagaatcacttgaggccaggagctcaagatcagccagggcaacatggcaagacaccatctctacagaaaaatttaaaaattaaaaaattagccaagcacggtggcacaagcctgtagacccagctacttgggaggctgagatgggaggatcgcttgagccaggaggtcaaggctgcagtgagccatgttcacaccactgcactccaccctggacaaaacagcaagaccctatttcaaaaacaaaacaaaacaaaaaaaaacaaaacaatcagagagacaaagagaacagggtaggaaaagcacaaaatatgctctacagatgtagtttggtaggggtcgagggttgagtaagggaagtagctaaggattagggaggagagatggactgcaggtactaaatgccaggctgaggacttgacagcttgggggaagaaacaaccaagaaatacaggggaaaggagtccctgtactttctggtctttctgaatactaagattttttggacagtgttttatttcacatcttcactcttttcccccatctgcaaaaacttacatgagtaaaagtcaccaaataattagagaagacaagacactgaagaaaaagttgtctttaatagaatccacagctaacattctatttacgtttttttaatagagatgttttatttttttattttgcttttttttttttttgagacagagtctcactctgtcacccaggctggagtgcagtgacgcgatctcagctcactgcaacctccacctcctgggttcaagtgattctcctgcctcagcctcccaagcagctgggactgcaggcgtgtgccaccacacccagctattttttgtatttttagtagagacagggtttcatcgtgttagccaggatggtctcaatctcctgacctcgtgatccacccgcctcagcctcccaaagtgctgcgattacaggcgtgagccactgcgcccggcctttattttgctttttaatacacatgaggtcggctgggcgcggtggctcatgtctgtaatcccagcaccttgagaggccgaggcgggtggattacctgaggtcaggagtttgagaccagcctgaccaacatggagaaaccccgtctctactaaaaatacaaaattagccaggcgtgatggtgcatgcctgtaatcccaactactcaggaggctgaggcagaagaatcacttgaacccgggaggcggagtttgcagtgagccaagatcatgccattgcactccagcctgggcaacaagagtgaaactccatctcaaaaaaaagaaaaatagacatgaggcctcaccatgttgcctaggctggtactgaactccagagctcaagcaatcttcctgccttggcatgctaaagtgttgggattgtaggcgtgagccaccacacctggccccaatgtcctttgtttaaagatggagagggggcaaatgggtaatactgactctgtgaagagaatgagtcatttccagttatcaccatgattaccttttaatttatctttaatgttttctgataaatgttttgtaagctgaggcatttcttctggagaatattcagcatttgccagttcctccttgagcacagcatggatacagtctttaaccacagagggcctgaacctgaatggaacaatttgtgaacatccagtcggtgactccacaaccccagcttaccttcataccgcaacttctcccatctttttgtcattagtaccacttaatccttctttttcatattttttattataaaatataaacaaattaagacaaatcataggccacatgtgtatcttcaacctggacctgcactgaacttcaacacattccaactcatgctccatatgaatgtttattaggcaactcaatacatccaataatgagcttctcatactcccctctcccccaaaacaaaatatatacttgttgttaattttgttctgcacgctttcacaaaataaaataaaataaaataaaataaaaaaatacggctgaatggcattctgggcattcagaaccttttaccaagataactgagggtatctttctctgtgttcattctacccaagggaaaaatcctgtatgaaatttgtatcactttttctgtgagttaccaagagaataaaaataaacaaagaaatttgtatcacattataatcaaaattcctgttttccatatttgccaagcaaatatggggtgtgtgtgtgtgtgtaaagttagtgatcttacaaacctagctgagtaccctctgctctggcccgtgagcctgacatttttttcagtgtgtgtgtgtgtgtgttgtgtggtgtgtgtgtgtgttgtgtggtgtgtgtgtgtgtgtgtaaagttagtgatctcacaaacctagctgagtaccctctgctctggcccgtgagcctgacatttttttcagtgtgtgtgtgtgtgtgtgtgtgttgtgtggtgtgtgtgtggtgtgtgtgtgtgtgtgtgtgtgtgtaaagttagtgatcttacaaacctgagtaccctctgctctggcccgtgagcctgacattttttttcagtgtgtgtgtgtgtgtgtgtgtgtgtgttgtgtgtgtgtgtgtaaagttagtgatcttacaaacctagctgagtaccctctgctctggcccgtgagcctgacattttttttcagtgtgtgtgtgtgttgtgtgtgtgtgtgtgtgtaaagttagtgatcttacaaacctagctgagtaccctctgctctggcccgtgagcctgatatttttttcagtgtgtgtgtgtgtgtgtgtgtgtgtgtgtgtaaagttagtgatctcacaaacctagctgagtaccctctgctctggcccgtgagcctgatatttttttcagtgtgtgtgtgtgtgtgtgtgtgtgtgtgtaaagttagtgatctcacaaacctagctgagtaccctctgctctggcccgtgagccttaatcctagcgagggctcgctgcggtggtctaagggcctccagatcccacccgggtaggacttcgcacagatgcagctcccgcgccgggagtgagcccatcctggcacccgtgtgcacagtcaccctcgaatcacggctgaacggcatccgacgcgagtggcttcctgcctctattctacccatctccttactcaggacgccatcgcgggtttcccagggccaaccattcccgccgcgccaccctaagacgcgcccggcgcccaaacactgaggaagcgggtggggtcccctgcggcccctgcagcgggaggggcgcccggacgtcacagcagggccgcccgcccgcctcgcggcctcccgcctcccgccccgcggaccccgcgcgtcccccgcgctccttccgtggcccaggtcccaggcgagctccgcccctcagaccagcgcgctcgaggtcgccccgccacagcccgtcctctacccgcctctgctggaaaacaggccgcagaatataggtgttctcgggctcccctgcgttcttctcagcctcaggcaccccgtcgcccaccgagaaggacactccgatggacgtggccatgccggggcttctcggtccgggcgtagctcgcgatgaaggcctagcgggttgcggtcgcggccggcagcagggaaagcgtctccagggcaacagggccgccctcccgcctcgctgaagcccgcgagcgccccgcacagccgccctccctgcccgcgcctgcgcaccggctgctgggcgggaactggtcgcgtccggacgcgcgacagcttccacccgcctcaggcagtatcagccgcgccgcagtcggaggaaatagacgcggggcctgaggctcctggacttgaggtattaggctggtgcagaagtaattgcggcggccgggtgcgggggctcaggcctgcaatcccagcactttgggaggccgaggcgggcggatcacctgagtcaggaagagttcaagaccatcctggccgacatggtgaaaccccatctctactgaaaatacaaaaattagccgggcgtggtggcgcgtgcctgtaaccccagctgctctggaggctgaggcagaataatctattgaacccaggaggccgaggttgcagtgagccgagatcgcgccactgcactccagcctggcgacagagcgagactgcgtctcaaaaaaagaaaaaaaaaaaaaaaggaaggaaggaaagagacttaggctgcattccccgcttttaaaaatatatatttatttttatttttttaaacgaagtctcgctctgtcactcaggctggagtgcagaggcgcgatctcggctcactgcaacctccacctcccaggttcaagcaattctgcctcagcctcccaagcagcagggattacaggcgcgccccaccacgaccggctaattttttttgtatttttattagagacggggtttcaccatattggccaggctggtctccaactcctgacctcaggtgatcgcccacctcggtctcccgaagtgctgggatgacaggcgtgagccatcgtactctgccgcattccctgcttataagcaccagtccctggtcctgttttagaaggctgttgtatcttggcctctgctagcttcaaaaactaaggcccgatgaggtagctcgtgcctgtaatccctgtttacaggagaggctgaaagggcagggattcctttttttttttttcccacttgagacagggtcttgctctgtttctcaggctggagtgcagtggcacactcaccgctcacttcagcctcgacctcttggactcaagcagtcctcccacctcagcctctggagtacctggaactacaggcgaatgccaccgcgcgtggctaatctttttaatttttgtagagataggatctggctatgctgcccaggctactattgaactcttgggctcaagtgattatcccacctcagccttccgaagtgctgggactacaggcatgagccatcacagccagctgggatattgtttttcgaatcgctgtcatgttctgtactatatgcagttcctgaaagaatggaggcaagaaggagtcagctaaccactgtgaactgtcttagtgccaaggacccacccttctctccttggggtcctgctgacccatcagaatagggctgagccaggatggggcttgtggagatgatgtgtatgagtgtgcatgcacttgtgtgtgcatgcctaacatccaaaactagatataaattctttaaacttttcattagttggccaggcacggtgactcgcacctgtgatcccagcactttgggaggccgaggcgggcggatcatgaggttaggagatcaagaccatcctggctaacattgtgaaacccggtctctactaaaaatacaaaaattagctgggtgtggtggcatgtgcctgtaatcccagctacttgggaggctgaggcaggagaattgcttgaaccagggagtcggagcttgcagtgagccgagatcacaccactgcactccagcatgagactctgtatcaaaaaaaaaaaaaaaaaaaaaaattctgcgtgagttgtgtggaggtgtcagtacctttccccagcaagagaagcttctccatatcaggcatatcctagccatgaccctgaaactaaccagccaagagggaaatgtgagacaagcccaggcaagcttcctggatgttgtatgcaggaataggatgtgctctctggacttggagacttcctgcctgctcaagaggctgtgcctccttgtgtctcccacaggcctctgtgtccaccttccccaccctggcaggcctgctaggccagcagccctggagaggaaagggtgaggtggtgtttgaagggacctgcctcctacgagctctgctggttggactgtcggatgacagaaccgtgcctctgagcctgggagagggaggcacccctgtgttctggaagcccccagtgcttcagcaactcctcactgaggcagaatagtggaggaatcaagctgggatccaggggactgaggaggggatagagcagcacctgggccccacattcccttccaacagagcctggggtgctgtgtttccgggagggttttttttgttttttgttttcccgagacagaatctcgctctgacccccagcctggagtgcagtggcatgatctcggctcactgcaacctccgcctctcgggttcaagcaattctcctgcctcagcctcccgagtagctgggattacaggtgcacaccaccacacctggctaatttttgtattttttatagagacggggtttcaccatgttggctaggctggtcgtgaacttctgacctcatgatctgcctgcctcagactcctaaagtgctgggattacaggtgtgagccactgcacccggcctctttttttttttttttttttttttttgtgagacagagtctctgtcccccaggctggagttcagtggtgcaatctcggctcactgcaacctctgtctcctggtttcaagcaattctcctgcttcagcctctgaatagctgggattaccgacatgcaccaccacgcccatataatttttgtattttttgtagagctgaagtttcactatgttggccaggctggtctcaaactcctgacttctggtgatccacccaccgtggcctcccaaagtgctgggattgcaggtgtgagccaccgtgcccggccagagcctggggttctcaaactcgtttctggggaccgcccaccacttttcttgccagtgcccatcttccaggttcctcccaggctgcttctgcctgccttgtcctcttcctgcctgtcacaccacactctcccaccagcatcttcctcattccgctctgactctcctcaccacccagcccgacctgactgaaaaccccgcagtgggagagcaggaggcccctgcttctaggtgccgtgtgagaagcagctgtgaggtcgggttgggtggctcacgcctgtaatcccagcactttgggaggccgaggtgggcgggtcacaaggtcaggagttcaagaccagcctggccaatatggtgaaaacccatctctactaaaagtacaaaaaaaatagccaggtgtggtggcgggtgcctgtaatcccagccactcaggaggctgaagcaggagaatcgcttgaacttgggaggcagagggtgcagtgagccgagatcatgccactgcactccagcctgggcaacagagcgagactccataaaaaagaaaaagagatttaattggctcacagttctgcaggggttacaggaagcatagcacccacatcactcagcttctggggaggcctcagagagcttttactcatggcagcaggtgaagagggagcaggcgagtcacatagtgagagcaggagcaggcgagagagaggccagaggtgccacacgcttctaaatgaccagatctcgcgggaacccactatcacaaagacagctctgagccgtgagggatccgcctcatgatccacacaccttctgccaggccccacctctagcactggggatcacaattcaacatgagatttgggtgaggacagatatccaaactgtgtggacagaggtgatgctcctctacttgttgaactcttgaacactagtgaagagaatgctggtgtattagtctgccaggctgctgttgcagaataccatgaactgggcacttaagcaactgaaatagattttctcacagtgctggaggctagaagtccaagatccaggtgccagcaggtttggtatctcctgaggcctcgcccctgcgcttgcagacagccgccttctcactgggtccttacagggcctttttctttgagccagtgtagagagctctgttctttcttcctctttttataagcacaccagtcctatttaattagggtcccaccctatggcctcatttaatcatttgttgttgtgttttttttttttgagacgaggtctcactgtgttgcccaggttagtctcaaacccctggtcacaagtgatcttcccacattggcctcccaaagtgctcagattacaggtgtgagccattgcgcccagtctcatttaaccttaattactaatttaaaggtgccatcatggccaggcgcggtggctcacacctgtaatcccagcacttttggaggccaaggtgggcggatcacttgcagccaggagttcgagaccagcctggccaacatggtgaaacccccgtctctactaaaaatacaaaaattagctgggtgtggtggcacatgcctgtaatcccagctactcaggaggctgaggcaggagaatcacttgaacctgggaggtggaggttgcagtgagccgagatcacgccactgcactccagcctgggtgacagagcgagactgtctcaaaaaaaaaaaaaaaaagtgccaccaccaaagactgtcatattgggggttagggcttcaacctacagatttggaggaaacactatttagtccacaataactggagaagttgaatttagaagatgggggttggggccaggcacagtgactcatgcctgtaatccagcgctttgggagaccaaggtgggaggatcacttgaggtcaggagttcaagaccagactgggcaatatagcgagactccctctctacagaaaatttaaaaattagccaggtgtagtggtgtgtgcctgtagtcccagctactcggaggctaaggcaggaggatcgcttgagtgcatgggttgtaggttacagtaagctatgattgtgccactgtactccagacaggggaacagagcaagaccctgtctcagcaacaacaaaacaacagggagatagggggtcaggtgctgacttcaccttaacttcactgtgtgcttttacagcaagcctgttaccctctgtgagcctcaacttctctatgtgtaacaaatggccaactttatgggattgtcaagaagctgaaatgagaccctggctggaggatattttatggactataaattcctaaacaattataataacttagttatttatcctatccatggatcacctggaagtttacaatgtgatttaaaatgcattctatcattccaccgacctgcagtgaattttgttgtcattattactccagggatacctaaaggggaagtttgtttataattcgtacccactccttgtagaaaggattcaagacagccgatgatgaaaacacccatgcttgcaagtgaaggttctgcctgtcacttctcgcagaggctgcagaaaaggcccaggaggctgttgatgacatgaacgaccaccaggagaagctggagcaggctgatgcacagaagggcggagaagagggacacgtgccagacaacagctgcagagggctccaggcagacggagttccagagcgaacggtcatacagataattcctatcccaaaaaataaggagaccaggggtcaggcgataagtaaggaaagccaaacaggcaaccccagtagaaaactggggtctcccctgaccgggtcatgggactgggctcatgagggtgaccgttactgctccatttgcaattttctgagtatcagaggagcaagatgctaggatgtgtgacccaaaggagcttgtagttcgtctgtgtgtctttttgtctctctctctctctctgtctgaaaagaccaagcccaagcctccacccatttacctactatgcaggtctttgaatgggtaaccatatttccaagcttgtgtctgattgaaggatgaaacatcaaacatgcaaaaaggaccatctttcagagcaactccagaagtgacaaagcaaatcagggctccaagtaaagccaggccacctgacaacagagcagtaagcacctgcggagggaggagaaacactgagctaagacggggtcgcagctggggagcctgcggagggaggagaaacgctgagctaagacggggtcgcagctggggagtctgtggggcggtctgcacaggtctgacttctctggtctcagtgttcttccgtcctgtcatgggggagaattctgtccatggcaccccctttgaagcataacccatggtggggaggccgtgaggggtttctaggagagaaaggaccaagaagcagaatcgcaggccccggatctccctgaccgtgagttcgcctgagctgctcagcagcttggcatcacaaaccttttgcacattacagccattcagcctctgagctaaagaagaagctaccacaggcccaccactgactcttctaaggaaaagctgcattttcaaaagttccaggttcccaactctgattcttctctatttcaaatcaaggataaaaaaaaggaagggagggaaggaaggaaagaaagaagcaggaaagaagggaaggagagaagtgggagggagggaaagaagggagagaaacagcgagagagaagctgcagccaagctctgaaatgactccacttctgtcgctgtgtttctccagctgagagctttcttggccatcagtctgtgctcccactgccctcccagaaaataactgggtttccttccttgacaggtttctagcctgcttctacattggcttctttctcgttccttccttccttcccttccttccttctttctctctctctctttctttttgagacagagtctcactctgtcgcccaggctggagtgcagtggcacgatctcagctcactgcaacctctgcctctgagttcaagcgattctcctgcctcagcctcccaagtagctgggactacaagcatgcgccaccacacccagctaatttttgtatttttagtagaaatggggtttcactgtgttggtcatgccggtctcaatctcctgaccttgtgatccacctgcttcagcctcccaaagtgctgggattacaggcatgagccaccgtgcccggcccatattggattctttcttagggttctagatttttttctccctcccccaaaaatgcctattttaaaaatgtgaataacacctacatagcgtttttctgcagagtcatggagtcattctcccactgaggtcaagctggtttggagttggggagggatcagacaaaggtgcatagtaagttttgactctgagttaaaggagtcaagatgaatcagtaagcctagggcagtggttcccaaaatggggtccctgcccagccgcatcacatcacctgagaacctgttagaaatgcaaaacttccccgccatcctgaatcagaaactctggggagggagcccagcaatccgtgttccggcaaaagccctccaggtgattctcatgcacattcaagtgtcagaactacgtgccacggggaaaaccagaatgagaacagacagtgaatgaaatgtgcaagtgtttatttatttatctatgtacttatttatttatttattttgaaacggagtctcgctctgtcgcccaggctggagtgcagtggcgccatctcggctcactgcaagctccgcctcccgggttcaagagattttcctgcctcagcctcctgagttgctgggattacaggcgcccaccaccacgcccagctaatttttgtatttttggtagagacggggtttcaccatgttggccaggctggtctcaaactcctgacctcaggtgatccgcccatcttggcctcccaaagtgctgggattacaggcgtgagccaccgcgcctggcctatatttgattttttaacatgtaactgagtcagtgggcttcccaacatgtgggctgcagatatcagagcaggctgtggagttaccataaggccacagattcatgtctgagaacgagtgtgtgtgtgtgtgtgtgtgtgtgtttgttacacacacatatactgagatctttcaagtttatacagttgctgctgtaattaataaggtagaaatttattctgggcctcagtttatctgtaaaatggaggggttagattagaatctagtgattagatgatctctggaaaactttcctgttctaagaaaatattagttaaaataactaggaaaatttccatcaatgacacatgattacagtgtcataactcatgtccatattgtccaacaccctaagagagtaacagtttctcacactggtacagacgtctgggtcctcacactggtacagacgtctgggcttcactaagcactactcccttgacttgatcagctcccattttacagatgaaagcctgaaactggaaagatgaagcaacttgcccaagaacttagcgttactgagggtcacagtgaggacctgacttcaggccccaagaccaaaattgcctctttaccgccctgcctctagagtaatagaggtggagacattctgggtgttagaagagtggaatctggtgcttacgcttcgacagagcccactcttactgaagcagccgtatctccagcccatcaaggagatgaggatagctgcagtgagtacctgcaggagagagaagaatgttgagatggggaaatcgactttgccggctgtttctaggtgctgcccacagctgttagagtggctggcagctcacatgaacgcagtcctgttgactctgactctggggacccacatttgtatgacgagcctgatctaacgctgtggatgttaactttcacacccgacctgcctggtcccaagctaggcttcctgtctcttagagcttctacagacccaagatcagcttgttagaataaacttttctgcaaggaatcaaaacactcttcccatgccaccttcctgctccccgccggggtctctttgagagttcacgttcagggaaccccggacacttaccatgaggcctcctccccagagcccagttcccagcatggcatgcctgccaaggaggcccctcaacaggtaggtgacatcccagttaggaaggaggagtgccacgttggccccagcagcaaacagggctgcagtcccaaggctcagtcccaggatacgggagcaagtccgtgagcttgcctgcgtgcagggagaggacaccatcctggaacagatagaaagggagtcgcagcagctctgctgtggggggatggggaagggaactccagcagcatatcatgggtgagggaaacagactacagaaaccgccaccttccagggtcagaccaatgagagccaagcaacctgcttaaaaactctgctccttaggaatcttccccagtgactaggatttaattgtttccttttctgctaacccctgttcacacatacatagtttgcattccatcatattttgtttatgcctctattacagccagtgattatttctgacaaaaagaaatgtttaaaggtgtcttcatgatgtccattgtctccacttctattcaacgttgtactggtcctggccagtgcaatacgaaaataaaaggaagcaaaagccacacagataggaaagaaagaagtaatattgtcggccaggcatggtggctcaggcctgtaatcccagcactttgggaggctgaggcaggcggatcacgaggtcaggagttcaagaccagcctggccaacatggtgaaaccccgtctctactaaaaatacaaaaattagctgggcacggtggtgggtgcctgtaatcccagctactggggagactgaggcaggagaattgcttgaacccgggaggcagaggttgcagtgagctgagatcatgccactgcactccagcctgggtgacacagcaagactccatcttaaaaaaaaaaaaaagtaacattgttattattcacagataatgtgatcacattatgtagaaaatcctaaagtttattagaattaacaggtgagtttagcaacgtcatagaataaaagattaatatacaaaaattatattgtatttctatatacaagcaatgacaaattgaggattgaaattaaaatatatcatttacaatagcataaaaatataatacatatggatgaatttaacaaaatatttgcaagacctatatagtaagaattgcaaagcattgctgagaaaattaatggagacctaaataaatggagacatataccatgttcctgaaccagaagactcaaaatagttaacatgttctccctaaattgatgcaaagatttaaagcaatatcagtcaaaatcctaggagagttttgttatagaaattgacaaactgaatctaaatttatatggaaatgcaaagcaattgtgaagattagccaaagcaattctgaaaaacaaacaaagctggagaacttacgccatgtgatttcaagacttacaaagctacagtaattgaagacactgaagccacgcgtaaggaaacacatatggactactggaacaggctggagctcagaaacagacccggtccaggaaaaatgattttttttttttcttgagacggagtctcgctctgttgctcaggctggagtgcagtggcgcgatctcagctcactgcaacctctgcctcccaggttcaagcgattctcctgcctcagcctcccaagtagctgggattacaggtgcccgccaccatgcccggtaattttttgtatttttagtagagacggggtttcaccgtgttagccaggacggtcttgatctcctgacctcgtgatccgcctgtctcgggctcccaaagtgctgggattacaggcatgagccaccgcgcccggccaataaatgattttttaagaagatgacaattcagcgggaaaaagtctcttccacaaatggtgccggaacaatgcacatgcaaaacaaaactgccttcactattacttcacaacatattcaaaaattcacttgaaatggagcatgggtctaaaagctttataaaatttctagaataaaacaaaggagaaaaacactgggaccttgggttagataaaggtttcttactaaaatgcaaaaagtacaatccacaaaacatgattaatcagactgcttaaaaatttaaatgtcagctgggtgcttgcctataatcccagctactcggaggttgaggcaggaaaatcgcttgaacccaggaggcagaggctgcagtgagctgagatcgcgccactgcacttcagcctgggcgacaagagcaagcgactccatctaaaaaaaaaaaatcatgctaaaagaaataagccagacactaaaggacaaatattgtatgattccacttatatgaaatattcaaaataacaactttatagagaaagaaagtagactggaggttatcagggactgtggggagggaggagagaatggggagttattgtttaatggttacagaggttttcaggttttgttttgtgttgttttgttttttttttttgagacagagtcttgctctgtcagccaggctggagtgcagtggcgcaatctcagctcactgcaacctctgcctcctgggctcaagcaattctcctgcctcagcctcccaagtagctgggactacaggcatgtgccaccacgcctggctaatttttgtatttttagtagagacagggtttcactatgttggccaggctggtcttgaactcctgacctcaggtgatctgcccgcctcggcctcccaccgcgcgcggtggttttggggtttttttagagatgcagtctcactatgttaccccagctggtcttcaactcctggactcaaatgatcctccagcccgtgcctccagagtagctatgaccagatctgggccactgcccacggtttaagggttacagactttctgtttggggtgaagaaaagttttggaaatagataatggtaatggttgcacatcattgcaaatgtaattaatgtcactgaattatacactttaaaatggttaaaatgacaaatctgatgttactttaccacaataaaaaatcaattaaaaaatttgtgattactcaaatccttatcagtaatcaataggtgaatcaagacaaattgtgttatccatacaaatgagttctattaggtaataaaatgcgtaaatttctgctacatataacatggatgaatctcaaaagcattgtgttaagtggaagaagccagaaacaaaagactactcacatgtttctatatatacgaaattctagaaaaggcaaaacttttaacggagagcagatgagcggttgccatgggctgagaatgggaaagaggattagtatggggcatgggaagctttctgaaggggtggaagcattctgtgtctagattctggtggtgaatacataactgtacatattgacaaaactcattaaactttgcacttaaaataggtgaattttattgaattttaactatatatcaataaagctaattacaattaaaatgtcatatctagataaattataaaatgcctcttccactccttatgttcctctcttttatattttcattgatatgtgaacttcttgttttttagaaaaatatgaattaaggccgggcacggtgacttacacctgtaatcccagcactttgggaggccaaggcaggtggatcgcctgatgtcaggagtttgagataagcctggtcaacatggtgaaaccgtgtctctattaaaaaatacaaaaaaattgctggacgtggtggcaggcacctgtaatcccagctactcgggtggctgaggcagcagaatcgcttgagcccaggaggcagaagttgcagtgagcagagatcgtgccattgcactccagcccaggaaacaagagtgaagctctatctaaaaaaaaaatatatatatatacatatatatatgaattaaaataggactagtaatatttgggcagactcatgtcaatgtggatctgaaaaaagtcagcgtcatgacatccccaggaagtggcctgttcccactgtgcagttcagttacacgtctgtctccccttaaggctcgctatttatttatttatttaatttatttatttattttttattgaaaaaaatttatttttagccgggtgcagtggctcacgcctgtaatcccagcactttgggaggccaaagccggcagatcacctgaggtcaggagttcaagaccagcctggccatcatgacgaaaccccatctctactaaaaatacaaaactagccgggcgtggtggcgcatgcctgtaatcccagctactcggaaggctgaggcaggagaatcacttgaacccgggaggtggaggttgcagtgagccgagattacgccactgcactccagcctggacaacaagagtgaaactccgtctcagaagaaaaaaaaatgtaatagaggtgaggtctccttatgtggcccaggctggtctcaaactccttggctcaagggccctcccacttcagacacctaaagtgctaggatgacaggcgtgagccactgcacttggccacttgaggctcttgacacgcctataacacactgctttgcacctaatcagaaaatatgtgtatagaggccaggcacggtggctcacgcctgtaaccccagcactttgggaggctgaggtgggtggatcacgaggtcaggagtttccgaccaacctggccaacatggtgaaaccccgtctctactaaaaatacaaaaaaattagctgggcatggtggcgggtgcctgtggtcccagctactcgggaggctgaggcagtagaatggcgtgaacctggggggctgagatcacgccagtgcactccagcctgggcaagagagtgagattcggtctcaaaaaaaaaaaattaactgcgtggtggtgtgcgcctgtaatccaagctactcaggagcttgaggcaggagaatcgcttgagcccgagaggcagaggtggcagtgagcccagatcacgccactgcactccagcctgggtgacagagcaaaagagagagagagagaggagggagagagggagggagggagggaggaaggaagaaaggaaaggaaggaaggaaagaggaaggggaaggggaagggaagaaaaaaaatatatatatatataaaagatatggatcagaggctctatatatatgcacacacacatatatatcatatacatataatgtataatgtgcgtatatatgtgtgtacgtacacacacacacacacacaatagtcccccatatctgcaggggatatgttccaagagctccagcggatacctgaaaccacagatcataccaaactctgtatattcagatgcttctccacttatgatggggtcgaactcctataaacccgttgtaagtcaaaatatcctaagttcaaaaggcatttaatgctggcaacacagtagactgtccctgactcacaatggttcaacttacaattttttttttttttttttttttgagacagggtcttgctctgtcacccaggctggagtgcagtagcacaatcattgttcactgcagccctgatctgggctcaagtgatcctcccacctcagtctctcggatagctgagaccgcaggcatgcgccaccatacctggctaatgttttagttctatagagacagggtctcactatgttgcccaagctgatctcaaactcctggcctcaagtgatcctctcacctccacctcccaaaatgttgggattacaggcgtaagccaccacgcccagtcccaatttacttttgactttgtgatggtgcaaaagcaatgagtattcagtagaaaccgtaatcccatcataaagggtaaggagttcactgatgatggagttaggtccctagaaacctgtcgtaaagttggaaacttagaagtcaaaccactataagtagaggactgtctgtactatgctttttcctatacatacatatctgtaataaagtttaatttataaatcaggcatagtaagaagttcgcaacaataataataaaatagaacagttataacaacatactgtaatgaaagttatgtgaatgtggtctttctcattgaaaatattttatgtaagttttttgaactgcagttgaccacagatagctaaaactttggaaagcaaagcttcagttaaggggggattactttacatcacacataaataatgaaatatttcacagcatgaagaattaaacattgggggagggccagggctgaaaaactatctgtaggtaccgcgctcactacctgagtgacgggaatcactcataccctaacctcaacatcacacaatagacacggaacaagcctgtatatgtatccccggatctaaaataaaagttgaaattatatttttaaaatttgcattaaaggccaggtgcagtagttcacgcctataatcccagcactgtgggaggccgaggcgggtggatcacttgaggtcaggagttcaagacagcctggccaacctggcgaaacctcatctctactaaaaatacaaaacttagctgggaatggtggtgtgcgcctgtaatcccagctactcaggaggctgaggcagaagaatcacttgaacctgggaggcagaggttgcagtgagccaagatcgcaccactgcactccagcctggaccacagatcgagactccgtctcaaaaaaaaaaaattgcattaaaaaagaattaaacataatgtgtaaaatatatttgtaacttgtgtgagataattaacacccatgtaaacacaaccaatatcaaacatacgtcattacccatcacatcactgacactcaggtgtgccctctccaatcctgccttctttctggattccttcctaggaactactatcctatatttcatcttcaacatatccttttaaaaacagttttacgacttaggaactcagaattgttttagaaacttgtttagtcgggtgttttccatttttcaagactgtagcttttcttttctttttctttttttttttgagatggagtcttgctctgtctcccaggctggagctcagaaacagacccggtccaggataaataatttttttttttcttgagacagagtctcactctgtcgctcaggctggagtgcagtggcgcgatctcagctcactgcaacctccgcctccccggttcaagcgattgttctgcctcagactccccagtagctgggactacagctgcacaccaccatgcccggctaatttttgtatttttagtaaagacagggtttcaccatgttggccaggctggtcttgaactcctggtctcaagtgatcctcctgcctcggtttcccaaagtgctggaattacaggtgtgagccaccaaacccggccagactgtagcttatggtaaagaagacaaggggaggggtgccctgggagggtgggggtaggagagaggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggatgccctgagaaggtgggggttaggagaagggaggggtgcactgggagggtgggggtaggagagggaagggatgccctgagaaggtgggggttggagaggggaggggtgctctgggagggtgggggtaggagaggggagaggtgccctgggagggtggccagaggacaggggaggagtgcacagggagagtgggggtaggagaggggagggatgcacggggagggtggaggtagcagaggggaggggtgcatggggagggtgggggcaggagagggcaggggtgcttggggaggggttgtaggaaagaggaggggtgcactgggagggtgggggtaggagaggggaggggtgcactgggagggtgtgggtaggagaggggaggggtgccctgggagggtgtgggtaggagaggggaggggtgccctgggagggtgggggtaggagaggggaggggtgccctgggagggtgggggtaggagagaggtggggtgccctgagagggtgggcgtaggatatgaagcaacagtgactcctaccccaggggcccaagggtcctggggcagggtggggtcaggaatcgggagggatggggtgtctcttcccccatcaaccctctggctgacaggccaccggactcctcagtcacagcaaggaacctgtcctgctcctgggagcagggcgcctgtggagaacggccccctcacagcctgcccacactgctgcgatgtccccgcatgtctgcacatcctccctccgagacggtcccatcgtgcagtgcggggcttgcagtgtgtaattctgtgttgaggcaaattaaccacccagggtgttaacaactcacaactttaatccactgcccacccagatgtctgaccggggcccaaggaaagatgggtgtgtggttggcctttcaagcgggtgctctagatcatggggccaggagacgccgttgtgcaggaatgcatttagtgccttcaaatcacggcacctctgagaaagcaccgtctacacacttcagcaacatcaacccccctgacgatctcttctacagaaaacgttcccatcagaaaagtctgttttttttgtttttgtttttgttttgttttttgttttttttttgagacagagtttcactcttgttgcccaggctggagtgcaatggcgcggcctcagctcactgctacctccgcctcctgggttcaagtgattctcctgcctcagactcctgagtagctgggattacaggtgcacaccactacgcccggctaattttgtatttttagtagagatggggtttctccaggttagccacgctggtcttgaactcctgacctcaggtgattcacctaccttggcctcctaaagtgctgggattacaggtgtgagccacagcgcccagcccagaaaactcttaaaggggaaactaaaaatgatggacagcgagggaaaactaccagctggagcatggcttttggatgagtggaattcagagccctggctgtccgccaatcaaacactaaaagcacttgccgcactgcggcttcgtgtgaatttcacccctcctcctgactttattcccctagaaattataacatttggagaaacccttccaaaaatgtgaaccaggaggttagcaaagaggtggcctaatttgatatctgaagagacaagcaagatcagaaggtaaaaccttaaaaccaggctgctggggagttccttgttctgtcctgaggtcctagctaggtgagcacgtcatcggctagatgtccaggcaacaacagaagtgatcggctcaattccatggaggaagagaccgcacattctctacatctgtgtctctccctcgccacccagcaaggcttttctttcattcttccttcagtcggatatttattaagtgatcactacctgacagacacttggggggctagggatataacgatgaaaaagatgtaatccctttccttgaggagcttaaagtctagtggggacactgctgacgcaaaaagcaattctttttttttttttttttttttttttttgagacacagtctcgctcttgttgcccaggctggagtgcagcggcatgctcttggctcactgcaacctccgcctctcgggttcaagttattctcctgcctcagcctcccaagtagctggaattacaggcatgcaccacgcccggctaattttgtatttttagtagtgatgggttttcgccatgtgggtcaggctggccaaaaagtaattctaatcaagtgtggtaagaaatagagcagacatgagcagggcgggagagggcctctaccccagtaatgtcaggtgactatcaggtgatggccaggcggttgttacactgtctttctaaaataatattggtcacagccagcgttgggaaagacagtctcccaatagatagaaaatacctgaacttggtgatcagcagcttcctggtaagagctcaggaattgggcgagtgggctcaagcatctacactaagaagcaaaatggtggagtttagctggtgtgtgtgaccttcctctagtgctgctccgcgggtaagggaaaaacgcctcaagtgagcatgcgcacgacttcagtaaacacactgcgcatgcggcccctcccaagtgcctgtgcggcaggcaggcgccaagtcaagggtctaacagcacatttgggtgtctcaagtcacgcacttggcccttttccaagtgtactttacttcctttcattgctgctcaaaaactttttaataaaccttcactcctgctctcaaacttgcttcagcctctccctctgccttaaacccacttctgcccctcagccgaatctctcccccgagaaggcaaggattgagtttgctgcagactcgctggattcacagctggtaacagtaagtaccaggcaggggcatccaacttaaggtgtcatggaagcacatggaggaacctaatcctatctggcagaagcaaaacgaagcttcccggaggaagggctgcccatgcccaaacttgatggacgatgagatactaggcaggaagagtattctaggtgcaaaggccagaagttgacagactgaggcaacaggagaaggtaagtgaatggcgcaaagtcacacagacgccaagctgcagagccaggctcactggagtggaagcgtgcactctcatctgtgaggctaggctgttccctggccgtcacctcaccctttcatctctgcttacctgcatctggtgtcaagaatcagaatgggagagacagaacctggagaaaggctgcgtcttcagagtggggctccactcctccagctccagggctggacctgaaggttgtctttccaggactctttccaggagggccagggaggctctgtatatacgtagaggtcacccaggcgtgtgtgtgtgcgcgcccccacgcccctgcccacaggcctgcattgaaggcgcttccgctccccggagagccctgtcctgatgacccaccctctgctcattttcatgtgattctaaggcaggaaacgggagacatggcctcatgagctccgctgtcctgatgagtcactggatgcacccgtgagaaacacctcaccctccgctctccccaggcagcaacacttgccacaccccagctgttcctgtcctcatctgccaccccgcgaagaatttcggctctttgacagaacagcaccgagcagggcagccacccctttttcctcatcactctccttaccttgcccttggctgactcgatgtgttgcatggttcctgtactagacgtctaacttttttttttttttttttttgagacagggtctcactctgtcacccaggctggagtgcagtggcatgatctcggctcactgcaacctccgcctcccacactcaagcaatcctcccacctcagcctcctgagtagctgggattacaggcacctgccaccatgcccggctaatgtttgtatttttaatagagacggggttttgccattttggccaggctggtctcgaactgctgacctcaggtgttcgcctcagcctcccaaagtgctgagattacaggtgtgagccaccgcactcagcctcttgttcaagccccaggccactatcatcttgtaccatactctcaccaaattgctgaggattttgtggtgctctctgtgtgggagatccgtgaccctctatggacaagctcctattcaagattcagttcaaacattcccagtgaagtctgccaggatttctttactccgagttaggtacttctttctctatgctcccattgcattttaaacatctagatattatatacagtaaagtgcacaaatcttttcttttcttttttttttttttgagacggagtttcactcttgttcccaggctggagtgcagtggcacaatctcagctcactgcaacctctgcctcctggcttcaagcaattctcctgcctcagcctcccaagtagctgggattacaggcacgtgccaccacgcctggctaattttgtatttttagtagaaacacggtttctccatgttggtcaggctggtctcaaactcccgacctcaggcgatccacccgcctccgcctcccaaagtgctgggattacaggtgtgagccagcacgcccagcctaaagtgcacaaatcttaatgttaaagtctgatgaatttttacatgtataccctggtgaaccagcacagaaatcaagatacaggacattccaaatccccagaggtttcattgtgtcgcctgtcattcgtatcccttgtccccagtgttaactttcattttggctcttataataattgattaggttttagttgttcttgaatttcacataaatggaatcaaacagttttctttaaaaaaaaaaaaaaaaaaggcggttttgctgtgtcatccaggcgggagtgcagtggcacaatcatgactcactgcagccttttgccttcataggctcaagtgatcctcacacttcagcctcctgagtagctgggaccacaggcaagcgccaccacgccagctgattttttaatttcgtgtacagatggggtctcaccatgtagcccagtctggtctcgaactcctaggctcaagtgatcctcctgcctcggcctcccaaagtgctggattacaagcgtgcgccaccgcgcccagcccagtatggcttttgtgtgtggctttcttcactcaatattctatatgtaagattcatccatcatgtaatttatttttcttttattgctgagtattattacattggatattacaactttttctactcttaatggacatttatattttcaacttttgcctgttataaataatgctgctatgaatattcttctgcatgtcttttgaaggaactatgcactaatttttccagggaatattcttaggagtaggattgctatcatagggcaggtgaatatttaattttggcagatattgccaaacagattcccaaagtagtcctaatttacacacccaccagcagtgtgtgacagttccagtttctacacattctcacaaacatttttaattttaggcattgtggtgggtgtttagtgtaatctccttgtgtttgaatttgcatctccttgatgagtaagcaccttttcatatacgtattagccatttgaagatcctctttgagaagttcccgtccatggtttttgcccatttgttatgggttatctttttttctgttttctggttcattataattccaggtatgagacctttatcaggtaaatttattgtgaatgttttcccccagtttgtggtttgactttttactctctttattatgtcttattttattttattttattttattttattttattttattttattttattttattttattttattttattttattttttgagacagagtctagctctgttgccaggctagagtgcagtgccacgacgatcttggctcactgcaaccgccatctcccgggttcaagagattctcctgccttagcctgccgaatagctgggattacaggcatgggctgccacgctcagctaattttcgtatttttagtagagacagggtttcaccatgttggccaggatggtctcaatttcctgacctcgtgatccaccctcctcggcttcccaaagtgctgggattacaggcgtgagccaccccgcctgggcttacttgaagagaaagtactgattttaattaagctccatttatgcatcttcttttatggtcaatatttttgtgtctgcttaggaaatctttgcccacttcccactggagtgtgactcacttcttactccaccgctgtgaggtccttgcaggcagggactaactcttactctgctctgtatattctgagcctcacacagagcttggaacatggtagaagctcaagaatgacttgatgaatgaattaattcgtgcaatgcataattcatgcaacacagtctctgcacagagattttacttccagtgatgaaaacaaacgattactgaggaaacccctgatgcacatacatgagaagggatcgttatgactggctatcacagttccatttttaaaaataaaattggaactcttcattaattttcgtgtcatccttgcacgggaaccacgttaaactaatctgcatcgtcccaattttagtatatgtgttgtcaaagcaagcacagtttaagtcttctaaactgtttatgagctgctttctatataagaatttctgtttttttttttttttttttttttttgagacggaatcttgctctattgcccaggctggagtgcagtggcgcaatcttggctcactgcaacctccacccccaggttctaagcgattctcctgcctcagcctcctgagtagctgggattacaggtgcccaccaccatgcctggctaatttttgtatttttagtagagacggggttttgccatgttggccaggctggtctcgaactcctgacctcaagtgatccacccgccttggcctaccaaagtgctgggattacaggcgtgatccactgcacctggccagcaaaagagatttcgcatgcagtgtctgttagaacatctcatatttaggcaatcagaataactgaatggctgattgccgtatatcactcagattttttttttctctcgatatggggtctcgtactgtcacccgggctggagtgcaatggcacagtcttggctcactgaaacctctgcctcctggattcactcgattctcctgcctcagcctccccagtagctgggattacaggctcacactgccacacccagctaatttaattttttaattttctaatttttagtagagacagggtttcactatgttggccaggctgctctcgaactcctgaccttgtgttccgccttcctcggcctcccaaagtgctaggattacaggcgtgagccaccacgcctggcctagcactcagatttttagatgatatctccatgtccaacccaatggcttatgtagatatcattaaaatgttgcttgtgggacaaaggaaagtgctggaatttgtttttaatcccttaaagtgtcaaacttagtgtggggctggtgatggcagctgtgggtttttgctccttcgggtaaacttgtgatgattaattcaatgattatcttatggacaagacacttctttcttttttttttttttttgagacggagtctcgctctgtcgcccaggctggagtgcagtggcgcgatctcggctcactgcaagctccacctcccgggttcacgccattctcctgcctcagcctcccgagtagctgggactacagcgcccgccaccacaaccggctaatttttgtatttttagtaaagacggggtttcaccgtgttggccaggatgttctcgatctcctgacctcgtgatccgcccgcctcggcctcccaaagtgctgggattacaggcgtgagccgccgcgcccggctgaacaagacacttctttaagaaatcatgtacttgagataaacgggtctcgtaaggctagcgttgggactatctcttcatttccatgtggcgagcctcctagggcaacagaggcacggtcgctgccatgaaagcactgaagcttcacctctttgagacgtgttaataaccgcggagtgtggctctactggagatggagctacttgctgttactttgtcggtgatgctcctagggaggagcaaatgggagtctgaggacataaatgacgaacagggcctgggctgagaaaaccagtcatgccacaaaaggcttcctgaggctgaaagatttgggagacggccaggtgccagtgacccacacctgtaatcccagcacttcgggaggcagaggccggtggatcacttgaggctgtaaccgcccaaggggttcacttgcccgctgtctagacagagccgattcgtcatgacaggggaattgccatagagaaagagtaattcacgcacagccggctgtgcgggagaccgcagttttattattactcaaatcagtctctcccagcattcggggagcagagtttttaaggacagcttggtgggtgtggagagccagtgagccgggagtgctgattgatcagggatggaatcacagggagtcagctgtcttcttgcgctgagtcagttcctgggtcggggccacaagatcagatgagccagtttatccacctgggtggtgccagctgatccatcaagtgcagggtctgcaaagtatctcaagcgctgatcttaggagcagtgtagggagggtcagaatcttgtagcctccagctgcatggctcctaaaccatcatttctaatcttgtgactaatgttagtctagtcccccggcaagaaggaggtctgctttgggaaagggctgttaccgtctttgttttaaactataaattaagtttccccccaagttagttcagcctacgcccaggaatgaacaagggcagcttggaggttagacgcaagatggagtcggttaggttggatctctttcactgtctcagtcatcattttgcaaaggcggtttcaaggccaggaatttgagaccagcatgaccaacatggtgaaaccgtctttactaaagatacaaaaattagctgggcgtggtgtgcacaaccgtagtcccagctactggggaggctgaggtgggaggactgcttgagtacgagaggcggaggttgcggtgagccgagatcgcgccactgcactccagtctcggcaacagagtgagactctgtttaaaacaaaaaacaaaaacaaacaaaaaaagtcctggcgcggtggctcacgcctgtaatcccagcactttggaggcggaggcaggtggatcacgaggtcaggagatcgagaccatcctggctaacacggtgaaaccccatctctactaaaaatacaaaaaattagccgggcgtggtggcacgtgcctgtagtcccagctactcgggaggctcaggccggagaatggcgtgatgaacccgggaggcggaggttgcagtgagccgagatcacaccactgcactccagcctgggagaaagagtgagactccgtctcaaataaaaaaaacaaaaaataaagacttaggagaacaggctagacagatgttccattctggggtatatttggggatctggaggtggtatttgagcaagaaatagaggaagttgatgaaatagaattcactggcagaagagaagatgatacagccagacaaccaggccagctgttttctagtgttccccagatgagagcgacaggactaatcagcctcctgtgggtgggctctaaactcaactgaaagctgacaagagagcacattcccttaattggagggagaaaaaaagggaagatattgaaagagctgccttttataccagaccactgaagaggaagttagggttttctcattagtatataaaaatcgtaaacttccacccacccaaagtagatttctgcctccaacattgcactgaaactgttcttggtctccagtgatttcgtgtctctgatgaacgctacactgtcctctttacttgactctagacatagttagccacaggatccttcttgaacattcttactcttggctcccttgacaccccactctggtgtttttttgtttcttttttttgagacagagttttgctcttgtccctcaggctggagtctggagtccagtgtcaccatcttggctcactgcaacctccacctcccgggttcaagcaattctcctgcctcagcctcccgagtacctggaattacaagcaaccgtgccaccacacccggctaatttttgtgtttttagtagaggcggggtttcaccatattggccgggctggtctagaactcctgagctcaagtgatctgcccaccttggcctcccaaggtgctgggattacaggcgtgagccactgcgcccggctgagatttctcctttaaatagaacgttgtggagtttacttttaggctgagacctaaaggataaaagaaagtgatccgtgctaagacgaggagaactcaagcagaagacatgcctcggctgtggagcaggaaggtgtttgatgttggggtttgagagaaggccagtcagctggcaggcagggggcaaagggggtggcatgaagcaaggagcttgggcattctgagtggaaggagaagccagtatgcggagaatgggtcggaagagagtaagagcagagactactgcagtggtcacgataaaaagcaggtcacttggaccagagtaatggcaatagactgaaaagtagggttaccttttatgcattttggaggcagaagttaaaggacttgctgttggattagagatgggggaataagcaaaagaaaatgacttaagtttctggcaggttcataggtagtggtgtcactgcaggtctgggtggggaggcgtcatcttagatgtaagtgtgatacttccaactataggcgcagtgtaaaaagtcggacatgtgagtctgaagcttggaggagagacgggctggagttggagatgtgagaaatcattggcattatacatggcggttggtactatcagaatgagatcacagagggagagttagagggccaggtcctggggatcaccaccataaagacccaatcaaggaggtgcaggcagtgagaagaaacaccaggcagggcgcagtggctcacatctgtgatcccagcactgtgggaggccgaggcaggtgaatcacttgaggtcaggaattcgagaccagcctggccaacatggtgaaaccccgtctctactaaaaacacaaaaattagccgggcgtggtggcgggcacctgtagtcccagctactcgggaggctgaggcaggagaattgcttgaacctgggaggcggagcttccagtgagctgtgatcaaatcactgcactccagcctgggcaacagagcgagactctgtctcaaaattaaaaaaataaagaattctctactggctccttttctattttttttttttcattctattagaatcagatctgtttttccatgtatgtttatcgtctgtttccaactagaaagtaagttccttgagggcagaggctgtatctgttttgctccccatcacatacatccctattatttggcacatgaggctggagcatggggatgagaaatggttccacaagaaaagggggggcacaaacccatcactgtagaactgtgagctaagcagcagtccctttttttttttttttttttttttttttgagatggagtcactctgtcacccaggctggatgctatctcggctcactgcaccctccacttcccaggttcaagcaagtctcctgcctcagcctcccgagtagatgggattataggcactgccaccacgcccggcttttttcttttttttttttttgagacagagtttcactcttgtcgcccaggctgcagtgcagtggcacgatctcggctcactgcaacctctgcctcctgggttcaagcgattctcctgtctcagcctcccaagtagctgggattacaggcggccgccaccacacccagctaatgtttgtatttttagtagagacggggtttcaccatgttggccaggctggtctcgaactcctgacctcaggtgatccgcccatctcagcctcccaaagggctgggattacatgcatgagccactgcatccagcagcaataacaatttctgtcataccatataatcgtatctcctttttgcccattaatttagtaattatctttccttcaattaagctaagtccttaattaaccattagtaattactgctggtctgaaagaacagacactgaatattcgcccaagtatgtcaaacacagaatcatacttacctaacaagcctagcttacccaatgtttctgtaacaactggactaatatttacagagtgtttaccatgaatgtttgacataccacaaagagcagaaaaaaggctagcaaacgttacacataacaacgggactacaaagtaacctttgtcaatcaatagtaactgacctaaatgagaacgtgagggggcaagcttttggaatctcaattgtattactgaaagtaatatccagagtcttatcttgtaaaaacaacaacacaaaaaaaactaatactgaaaagtttttgtttttatttccaagatcaaatattacaacaggacatttacatgtatttataaaaaaatgcagcagttgaatgtatagatcagaggtttccttgagtttggtccctctctcagcacagtgagctgatgtcttcaaaagacttatcgtcccactcccttccctcccccaccccattgtccccccaccctccccgtttcaagttgcagtattaatataaagcaactgggtacaacacagcaagagtattcacaatttggtacagaccaaaccagaggatccccaactgacagcaagatcctccttctggaaattattacctatagactaggtagatctataggtagatcacacccagttatctaagatttccctggttttagagcaagtggaagttccattgagtcttagccagtagttacaactctgcgttacctaatggcatgtttttctcctcttacaagtttaattttctaccgcctccatgtgtcttcaaatttaaggctttcccaagcacctttattatgacttactagatatacaggagggtctctaatgtgtcttgaacaaaaaaatttagtggatggtccagctgccccttgctcaacaatcccaaagacttcttcccaccactgagaagagctgcagaaatcaacggtatctcctagcaccattggagaaaaggcccagaaaacagaattcgatgtgcattttagggagcacttgccagaaacattacaacaggagcactgtctctgttatcttcttggattcaatcacaaatttagagtacagatgaaatttagagcctgtcctgcattaagaatgcaaatctcagtaagaccacccccacacacactttgtccagaataagttgagccacaaacatcccagggaatctctaaatactgttaggaactgctttagaaaacactttaaagcaaataccccaagttgacttcactcaagcccccaacccaccctcatcatccctatccccctagaaatttcattccttgattaacttctctgagtaagatgtaaagtgaggtttggaaaatgacatgaaacatgaaacatgtttaaaaacacaatcaatgaagacatgccagaactggacatcccaggtgacttcaaatgcattgttcaagccgaactcatacaaagcatgcacagagcctgcacagacactgctgagagtttccagggaacaatcaatacctactcgaaaaaggactttcctgaagggcaaacaaaacaaaacaaaacaaaacaaaacaaacaaaacaaaaagtaacactggatgtttagaatttgttaacaacaacaacaacaaaaaaccattctggaaaaaaagattatcagaggagtgaagaaaaccgtgtctaacagattcatgccaaagcttggatggaagcccctcaaagtctaagtatcgtgttagcatcaactggtactcatttctctatatctaagactagaagattctctcacagctttactgtttcctggcaagtgttttcaacagcctttccagctgaagggacgaacccaggaaagtaacaaggcccaagaccccacatgggtcagataagcagcccctactagaagcttgctactcgttaactgaaaagtggaggccacgcactactttcactctctctagcaggtgaaaggggattttctgatggcaacagtcactccgtgtaaggtttaacttacagggcaataagttatcaaaaagttattgttaaaagcatatgattagtgtcataaacatatttatatttggaattacaccatttgatatctccattaagaatgcaaagctttgagaaaagcatactgtaaaatcatgttgctgcaaacagcaaggcatccagctgagtgtaagcagtctaatgtcatcaaactgaaatggaccctcgtgacgggcactatggaaccagctacctagatagagagaaaaaaggagaatggcagggaacggttccagatcaagaatctctcccttatcagttaagagttccatactgagtctatgaaaaaagcaaattaaaaagattttaagaaagggggaattcaattccaggtcagaatttatctaatgatttgatatgtttcccatttatcatgtctaaaaaatgaatgactcatgctaacccagttagattaataacttcttttgatgagaaaaaatattacttaggtttagtccagcttagcttgactattcttcccatttgaaaacccaaatgacctttagaagggatataaaatacccagagtattgtgatctctagagaggaaatacaattaaacaataaaaacttgctgtttgttgccaaagaattaagtacaataatgcgacttctcatatttatagattaatctgtgattgctcttgggaaaaatactatcattggtatttgccatctctaatcctagaaataaatctggttatcttttgaaaatactttctcattacaggaatgctaaattatgtttattaaagtagttcaaattggattgcccaactttattttgaaatcaatagcaaagaaaggcctgtgccaaaaatcatcatgtttatgagaatatctgcaattttaagcaacacaacagcaactggtaggccacaaagagggtggggtatcacagagctagccattctctatatgaaaccagagaattctccttaactagggagaaaatgagctataaaagtaagtttgcctcaaaaatgtccttcaattttataaaaaatgaagattgttacatattaagactttgaaatggaatttcttaaacatagccaattacactaaaaatcataactattttcagagaatgaatgttaaaaataaatggtggagaagtaaaatggaaagcaggattaaaagatttctaattaagggtctgtcacttcacaggacaactagcaaggccattataatctctatttttaaaaagacatcaagaaattcttgattctatactgtctctctagcaggactgacacacaggtgagtcaaaaaccataaccatcactgaaataccaaatctctatgtaacaggagaaaccgatatattggtatggtattctctgttgggttatctgcagttctaaagaacattcttgccactattctaaaatgtgtacagtgcaacaccatgtttcacggcaagacaataactgaaaagctaagccaggcaatccagtgaagttgaatgtccatagtacacagctgtctttagcctattcatcaaggctggtattaccggaaaactgccatgttcaccagaagagctgtctcttcctatgctcattacattttagttttacaaagactactaattcatcagcctgcaccccatgatttactactgcgtagttacatgatggtcaaaaaaggcagagagacggtaagaatgacataataaagatacattctgtggaataaaaaacatttttaagtcagcctaattgtatctttaaaaagctgtttctgccaaaaccaggtgtgaatcttatacaaatcaatttcccaacaggccagtaaagtactttaagtacacaagtaaaaataaaatttagtgccagcgttagtgtcatatttggttctcatttacattttagtcatactcaacactgattaggcacacagcattaagttttaaaaaataatgaattgtttacaagattattattactagacctataactactatactctcctctttggagatttcagtcatcgcagtaagattaagagcaagttgttggtcaaatgatacctgaacacagaataaaaaaaagagagaaaaaaaaagtaaagaaactgattaaccagcacacttttaattagcctagggataatacgcaatcacggggagagactggaagcatgaaattttggaaaaggacttcagagataatctaatttgttgttctagaaaaggctgagaactattaatctagtccaattatctcatttttcagacgagaaaccagagattaagaagaaagagaagtgtgaaggtaacaactagcagagctgttacccaaagggctctcacacctccagtgccctttctgcatataacatatactatactatgcattggatttgtacctgggtagagaaattaaatctttccttcatttttcggttgctagtggctccctctggtattttccctaagtgtgcaagtaagattcctgcgagctaggaatctttactccgggggatcaatagtgagatccccgcaagctaggaatctttactccagggatcaataatcctttcctacttgggtactggttatgccttagtggcagaacttcatgccccaaatctagaagttacaaaaggtggagctaaagaaaaaggtgagtcaaaagaaaacgtgagctacagtgcttgccacttcagtcttgtttaagactttgctaactaaaacatattcttccctttttctaagtttgaactaataggtaaacatttacatgctctccaattatttcatgtgtagtgtgtctctctaactggataaaacaggcaggaatcatatcttatttattattttttgagacagagtctcgctccattgcccaggatggagtgcagtggtgtgatctcggctcactgcaacctccgcctcccaggttcaagagattcttgtgcctcagcctccccattagctgggattacagacagccaccatgcctggctaatttttgtatttttcagtagagatggggtttcaccatgttggccaggctgatctcgaactcccaacctcaggtgatccacccacctcggcctcccaaaatattgggattacaggcatgagccaccacacctggccaggaattagatctcagatttcaaaatacttccaacttctataaagaactcaatagctaattgttgacttgtaagtcaaggaagtagaattatatacaagatttaaaaacatacacacagagggttcaataatctggtatggatgggacacagaaaacagaattgtagatcgggcgcagtggctcatgcctgtaatcccagcactttaggaggccgaggtgggcggaacacgagatcaagagatcgagaccatcctggccaacatggtgaaaccctgtctctactaaaaatgcaaaaattagccgggcgtggtggcgctcacctattaaaaaaggtaattgtatcttttctgaaaaatgtttaaaaaaagaaaaaattgtttttttacccttttcatttattcttggcaaataatgccacgtggcaattttactttcacatcttcaccagtgcatcattttaaaaaagcaataatcagcctctcaaaataatggcataaataaaaatgtataggcatagtgcaaatcccacaactttaacccaactacttcctctatatttatgggaacaaaactaagtgacactttacaaagccaaacaatgagaagagaatcatctgggtagcttgattctcttgctgaaggagaccacagcatggactctggattccaattctgatttgccactcactagctatgagtcctgaataagttctctatacctgttttcttaacatgggaagaaagtatacattttgtacgattcttcgggagattgaagaggcaaatgtacacaaaagtatctggtgcatgccaattagtattaagtttcctgttcttttctcatttggcactgttgttttctcttctccagttccttccgataccaatttcaaaaaagtattcctctcacttttttcccactagttttcttcttcttcttcttttttttttttaaatttgagatggagtgtcgctttgtcgcccaggctggagtgtaatggtgcgatcttggctcactgcaacctctgcctcccaggttcaagccattcccctgcctcagcctctgagtagctgggattacaggtgcacgccaccacacccaggtaatttttgtatttttagtagagacggggtttcaccatgttgctcaggctggcctcgatctcctgaccttaggtgatctgcccacctccgcctcccaaagtgttgggattacaggcatgagccaccgcgcccggccttcctggtagtttccattccatctccctgtatttttctcttatcactctcgaagtctatctttcttgttcttttcctccctagctttttttttttaaacactcctttcaagctgtgtccaacacccacaaggaatgactatttttaactaatcttactgacctcatttaatctattcaataaaacctctgccctaaggagcaaagaaacttgcagaggaagtaaggcaaactggaagaagcatactgtcagcggattaaattcttgagcaaggcaatactccttatggattcttcccatgtacaatccgtaactcttcccatgggcctttatatcaaccctaagataattacactcctgcctcaaaataaaataaaataaaacccaccacatcttgtattgtagacatcccagctgcatgttaagctgagtgaaagtaccatgctgtcttttaaatcactttatatctacttaatcatcccacagtaacccgagttgaagaagttactttggtttctcataaatgaatatgcacgtgctgaacatatcggaaagaaccacaccctctcactgatgaacacgttggcagttctcccaactgttttatcaagagaagctagaaggtaaagaaaaggaaacagagccctataggaaaaatgattgacttcacacgtttgagcgatttgggcttcagctatgactttgctggagtacagatgggtgccatcagagcacaaagctgagcaaacctctcttcttaccctgtgccctccctgaatttttggatttctgagcttgtctactaccaacaaatgttttaccctccagtgcacctttgacagtatacagctctatttttcaaacggcaagtatgttatccaagttcagagatgcaactgaggaattaacatgaaaaccatctttcactcaataaatcagaagctgctagttaagtaagcctcaagaacctaagaaaaaacaccaaagtgtaagtattactcagtcaccaatctaaagacagaactttgactcaaggtagaaatgaaaccgtaattatataaatatatttataaatatttatacaattatatacttatacataagcacttacacagacttagaaaaaaatttaagaacattaattcaaaaggactcactgaagaataaacagatttttccatgatttccttgaggagatataaaactcattctttagggagagttcctcaaaattcaaccattagaaaccatatcctataactgtgtactagcaacacatggcatctttttttcttcttttcccaaatcccctaattgccaagagagcaatcttaaagtagatgaaaacctaaaggtctctacgcaacatctgaggaacatacgctcctcagataaaagaatcaatctaaatcctcaactgacaaaaaggtccatttaatatttttcattttacaagttaaaagttctagttttgccaccagaatcacgactacccccccttcagaggactccatttaagctcaaaatacgaaatgagcatagggtgaagttgatgtgtaaatggtattctacagattcaagatggcctcttctaaaaacactgaagaaagctttcaccaactctaatttgattttgggttttgttggcagaaaaagcccaagacatctgaaaattactagtaacctccgccatcctccttactaaatgttgtcttctgaatggagttgaaaggtcttccccttagagaggctttccgttttgataccttttgaaagaaaacagcatgcggactcatgttcaattcagtcaccagagccttttagagactattccaaccaggggcaaaaaatgaaccattatttctaaccaaaagaacatggttagcaactctcagctgaatggttttctttttccccagggacatacctaagtatgcctgaaacaacacaggacaatcaataaccatagtggttacaattccaagccattgtactacatgattattgaccagctgccttcctacagatcactgcagactcagacaatggagggctccaaaggaactaatatgctgtgctggcaaaaatagcaagcaccttcctatcccagtcaccacgataggttcacttcatgtccattcttggactagcaggatcaatacagagtaataaggaaaactgtctcaggttaggacaatgaaagtcaccccatgctatatgctccatatttaacactcattctgccaataacacatgtcatggaaatagtccttatagctgggaacatgaaaatcctttgaaaaaggtttttaagtatgatgagcaatcattacaagggatgctttttccacgtaaacaaaagcctggatattttgttaagcgacatttccacatgaagaacacaacaaaaccaaacccatgttagagaatttcttctccctgctaaacacggggacttacaaaaaagggagggttgttcttactctgaatctagccattcctttgcccgaagagtctggggagtaacgttaacatttgatcccaaaaaagtgccgtgcaagagaccacttactggaacacacaattcctgctgctagtactaggagaggtcttatccttacacttcagtttggtcaccagattaggtaagaaagaaaagtgtggggggagggggaggcagaagggtacggagtggggagcgagaaaacagaagaggagaaagaaacaaagggggagaaagagactgattataggagagatcaagaaataagagaaggaaggtgacttgcttgcccaactttggctctgtggtcctatgagccaaaatgcatacttagtgacatgtatctcacaggaaaagggaaaaaaggggtaagctgagagaggtcaagccatggtgttaatttctttcctgtacaaagacagtctcttgaggacaaaggcctgcctcttgcaatgtaatatcatagtccagatgagataatttccttcgaggaaagttggtgagaagttcaaaacgttcatttgggtatcctttagactgcacgtgcttcaccaaagcctataaaaacaagagaaagacaaagccattagacggaaaaagaggaaagagcatattagtgaattaaatagaaaacattctctttttaatcatattagatcagctattaaatgtaagttcttctttcatataaccaaagcttgcccttggggaagggccaatataaacctttggacggggagataaatctgaccccaattacttacagccattaagtgatactgaaatacacagttattatttggctccccaataaatatacccagtcactattcataaaattaaattattgttctcattttaaaacattttatccgttttcctttctcccttttatcaaggaagatatgtccttcattctgcctacacccaatcttgccacctgtgcactgaatctcttcttgccttctcagaaactggaccattcccatcttttgcaggtttcttcaacatctccctctctgcttcccatcaaacttcaacactgcttgcatttcagtaacacagtcttcaagaatcagcctaattatctccagccacagcaaacggccagcaatgcctgacgcaagggattcattcacaggctaagctaagctaagctagtcagactcaagattctgtttccagcagttaaaaacagagggtgtcggggcacggttgctcacacctgtaatccctgcactttgggaggccaaggagggggacagcttgagcacaggagttggagaccagctggggcaacatggcaaaatcccatctcatcaaaaaatatgggccaggcatggtggctcacctgaggtcagaagttcgagaccagtctggccaacatggtgaaatcccgtctctactaaaaatacaaaaaaattagctgggcatggtggtgcgcacctgtaatcccaactacttgggaggctgaggcagaattgcttgaacctgggaggctgaggttgcagtgagccaagatcatgccacccgcactccagcctgggtaacagagccaatcttcatctcaaaaaaagtaaaaataaaaataaaaactagccgggcatggtggtgtgtgcctgtagtcccagctaccgggaaggtcaaggtgggaggagaatggcttaagcctggcaggcagaggttgcagtgagccaaggtcgtgccccacagcactccagcctgggcagagccagatcgtgtctacaagaaaaggaagaaaaaaacaaaaacaacacaaaccaaaaaccacagaaagctcatcagctgtgttagatgaaaatgcccgcagcgtcaccatgatgaaccacgtgcgagctgaggaataaacaaaagccaccagtatgcagagaatggtgtgaagcagagaatcccaagagaaaacctacaggccccagaagagaaacatagagaaaaacagacacagttcttaaacactttgcagttccagctgctggaaaaccactatcctcttcaaataaccccagtcgtccttttccagaagtagtcatttcagttgggtttctattccatgcaggcatgaaacagaaaaatcttcactggaacataccttacgtggcttacctaatttaatctgggaaggaaataaactaattagaattaagattcacaaccgggtgctcccacctgtaatccctgcactttgggaggctggggaaggaggatgacttgagctcaggagttcaagaccagcctgggtaacatagtgagaacccttctctacaaaaaagaattttaaaaaattagctgggtgtggtggcacacacctgtagtcccagctacctgggaggttgaggtgggaggctcgcttgagcccaggaggcagaggttgcagtgagctgagattgggccactgcactccagcctgagcgacagagcgaccctgtctcaaaacaaccaaccaaccaacaacaacaagatgactcaccacagtttgcagttagagatcagactaaacatctaacacctctttctttttttttttttttttaaacagagacagggtctcgctttgttgcccaggctggtctcaaactcctggactcaagtgatcctcccaccttggcctcccaaagtgctgggattacaggagtgagccactgcacctggcctcccacacctatttcaaagaattatcaagcaaagctcactgaacttactccaatgaattagcttctctgcttcgagaaaatgcttccaacgccctgtttcattgtgcttcaagttactgaaggtctgcggcaaccttgtgtcaagtgcctctattggctccatttttcaaacagcatgtgctcactgcctgtctctgtgtcaccttttggtaatgcttgcagttcattattttatctattataatgaactgtgagcagttacctttgatgttactattctgcttttgggcaccacaaaccacgcccacacaagaccgcaaacttaataaagaagtatgttctgactgctccacctaatgggagttttcccatctctctccctctattcaggcctccttattcccggagacatgacagtattgaaagtaggccaattaataacctaccagtgtaggcctctaagtacccaagtgaaaggaagtgtccatcctcaaaatcaatcaattgctaaaaatgatgaagcttagtgagaaaggcacgtggaaagctgagacagacacaaagctaggcctctggcaccaaacagccaagctgtgaatgcaaggaaaagttctggaaggaaattaaaagtgctactccagtgaacacacaaatgataacaaagcaaaacaggccgggagcagtggctcacacctgcactttcagaggctgaggtgggtggatcacctgaggtcaggagttcgagaccagcctggccaacatggtgaaaccccatctccactaaaaatacaaaagttagctgggcgtggtggtgggcgcctgtaatcccagctactcgggaggctgaggcaaggagaactgcttgaacccgggaggcggaggttgcagtgagctgagatcgcaccattgtactctagcctgggtgacagagcaagactctgtctcaaaaaaaaaaaaaggaaagaaagcaaaacagccttactgctgtgctgctgaaaaggagaaagttttagtggtctgtacagaaaaatcaaaccagtcacacattcccttaagccaaagcctaatccaaaacaaggttctaactcttttcaatcctatgaaggctaagggagttaaggaagctacgaaagaaaagctggaagctagcagaggttggttcatgaggttgaaggaaagaagccatctccataacatcaaagtgcaaggtgaagcagcaagtgctgatgcagaaggtgcagaaacttatctagaagatgtagtgaagacagttcacgaaggtaacaacactaaataacagatttaagtttgacaaaacagccttctattggaagaagatgccatcaaggactttcacagctagagagaagtcagtggctgcactcaaaggttcaaaaaggctgactttcttgttagggggtaatgcagctggtgacttccagttgaagccaatgctcatttaacattccaaaatcccaggtcccttaaaaattatgttaaatctactctgtctgtgttctgtaactgcaacaacaaaacctggaaagacagcacatcaatttacagcataacttactaaatattttaagcccactgttcagacctactgctcagaaaaaagattcaacatattactgctcattgacaacgcacctagtcacgtaagagctctgacgaaaatgcaaataaaaatgaatgctgtttccagtctgctaacccaacatccattctgcagcccatggatcaaggagtcatttcaacttttaaatcttatttaagaaacacattttggccaggcacggagccaaatctcaacactttgggaggctgcggtgagaggattacttgagtccaagagtttgagacaagacctggcaacacagcaagaaaccatctctaaaaaaaagaaaattaattgggtgtggtgatctactcaggagggtgaggcaggaggatcacttgagccggggcggggagtcaaggttacagtgagctatgaccactgcacaccagcctgggcataaatacagattcctttgatgaatctgggcaaagtaaactgaaaatcttctggaaaggattcagcagtctaaataccattaagaacattcacaactcataggaagtcaaaatatcaacatgaacagggctttggaagaggttgattccaaccctcatggatgactttgaggggtttaagaattcactggaggaagtcactgcaagtggggtaaaaactgcaagagaactagaattagaagtggaggatggcgatatgactgaattgctgcaatctcatgatcaaacattaaagggaggggggttgcttcttatggatgagcaaagaaagtgatttctggagatggaatctacttctgctgaagatgcttttaacactgttgaaatgacaacaaaggatttagaatattgcataaacttggtggataaaattgcggcaaattctgagaagactgactccagttttgaaagaagttctactgtgggtaaaatactatcaaacggcagcacatgctacagagaaattttttgtcgaaggaagcaactgatgcagcaacttcactgctgtcacattttcagaaactgccacagtacccatcaccccaatcagtcagtagccatcaatatcaagaccctccaccaacaaaaagatgactcactgaagattcaggggatcattagcactttttagcaaaagctttttttaattaagttatgtgcttttttttagacataaagctactgcacacttaatagactatggaataatgtaaacataacttttatatgcaccaggaaaccaaacaatttgggactcgtcttattgcagtggtcggaactgaaccaaagcaagcctgtacttactagcagtttagcttgctctggaagagtgatctgttccctttttccatctggataccgcaacatcagctgtgcttttggtcctaaaggaagggtttaaaaaaaaaaaaaaaacgggatacaggagtttaagacagaatattagtttaaataaatatgtaaataaatacagccattcagcaattactcaagtgttttgctggagtgcagtggcgtgatctcagctcactgcaacctccgcctccctggttcaagccactctcctgcctcagcctcccaagtagctgggactataggcacgtgccaccacacctggctaagttttgtatttttagtagagacagggttttgccatgttggcgaggctggtcttggaactcctaacctcagtgatccaccacgcccggccccaatatctaagtttgaagtaaagtatgtctaaatgtaacttaccatttacatctatcccctccactactccatctgctttttcaggtggcatctccagtatctctgaatccacagctggcaatccttggtggtttgtggctgttccaggatcagttctgactggtggctcagtcagcggccttctattctcctcttttctatgccccaaatctttgtggggagactttctggacttggcaagattctctacctcttcttcttcatcagagccacaaacggatatgaactcctcactgccagaaaaaagttcagattcagattcttcatctgagcggctatcctgttttgtctgtgttgaatcaaaatgtgtttcttgtaaggaggctctgatggcagcttctagctggctgtcttcacttgcatctataaggctctcctgtgagatggagtcataaaacacaggaaaaagaacaagttaaaccaaaaaacaagtcaaacggcataagaaatataatagcttgccattcattattatgttctgctgactgtatcccttctactttaagagcaaggactgtgtcttacacagccaaattggaatggagatatatatatgtgtgtgtatatacacacacacacgtttttgttgttttgttttgttttgtttttgagatggagtctcactcttgttgcccaggctggagtgcagtggcacgaactcggctcactgcaacctcagccttcccaggttcaagcgattctcctgcctcagcctcccaagtagctgggattacaagcgcccgccaccacgcccagctaatttttatttatttatttttttgtatttttaatagagatggggtttcaccacattggccaggctggtctcaaactcctgacctcggcctcccaaagtgctgggattacaggcgtgagacaccgcacctggcacatacatacatacatacatacatacatacatacatacatacatacataaatatatatatacacatatttttttttctttctttttttaagagacagggtctaagttccccaggctggtcttgcacttctggattcaagtaagcatacgcatttttttaaatatcaaaatgaaggccaggccgggtggctcatgcctgtaatcccagcactttgggaggcccaggtgggtggatcaagaggtcaaaagatcgagaccatcctggccaacatggtgaaaccccgcctctactaaaaatgattaagcttagtgagaaaggcatgtggaaagctgagacagacacaaagctaggcctcttgcaccaaacagccaagctatgaatgcaaggaaaagttcttgaaggaaattaaaagtgctactccagtgaacacacaaatgataacaaagcaaaacaggccaggcacagtggctcacacctgcactttgggaggcttgaggcgggcagatcacctgaggtcaggagttcgagaccagcctggccaacatggcgaaaccccatctccactaaaaatgcaaacatcagctgggcatggtggtgcgcgcctgtagtcgcagctactcaggaggctgaggcaggaaaatcacttgaacccgggaggcagaagttgccagagattgcgccactgcaccccagcctggtgacagagcgagactccatctcaaaaaaaaaaaaaaatcaaaacgaacaaaatcaagaaaagtttatctattacctgcctagagaaagacaagaattaaaagttttaactataaagtcaaaacaccattctttaaaatgactaaaacatagagacaaatgtttactttgttcaccactgcattcttcaactagtaattccattaattacaatgaaggttttcattatgataacaagaaatgcaaacttctacagtttttcccttggtaaagttctaatgccacagattttactaaacttaatgaatcacaaaatacgttgtttgagtggaacttacttagctcctgactcaaacatactatagaggaaagaaatcgtaagataatctaaaattgaacactggatatttcaggatattacagaattactgctcatttttaagggtataataatgacattgtgatagtatttttaaaaataaaaaaggctttatcttttaaatatatatgccagagtattaattaatgaaacaatgaattctgagattagcttcaaaataattcagatgtgatgggatacagaggaaagaagactggccatctgctgataattaccgaaattagctaacaaagaggctcaataaactacttcaacttttgaatatgcttaaaattttccataataaataggtaaaaaaaaaaagtgtgagttgctaataaaaaactaaagaaaccacattttggcttttactatcaggcaatcatgtagcaaaaaattaaagggaaaaacatttttttgctggttgttttttttttttgagagaggttctactctgtcacccaggctgaagtgcagtggcacaatctcagctcactactatctccacctgccaggctcaagcaatcctcccacctcagcctcccaagtagctgggattacaggcacacaccaccacacccggccaaaggaaaattttaaagtaaacttcaggcgaacttaccacccctaaaaagcaagtagaggtgtctatgtgacatgcaatggcttaggtggattgtaaatttatagcaatgacattgcacatatagcatgtagctcgattttaaaaattgtggccatggcagacactgtcaggctcctattgaatttcattctcctctgatttccttacttatataaccctatttaagtttataaaacgtgttcaactaaaaaattcattttactaatttctcttgtagctagaaaatagtattgagcaatagcaattcttatcgaaaaattatagaattaaatgcttatattagaagagagaaaggtatcaaattaatgacctaagcttccccaccttaaaaaaaaaaaaaaaaagagtatacatccaggaaaagaaaataaaattaagctcaaagaaaacacaaattaataaatgacctagaaagcaaatacaatagagaaaaacaaaaaaaacccaccaaaatcccaagagcagttttttgttttgttttgttttttgtttcttaagagacagagtcttactgttgcccaaagactggagtgcagtgactactcacaggtatgatcatagcacactacattcctgaactcctgggctcaagcaatattcctgccaagcagatgggactataggcacatgccacaccccagctggttccgtaagatcaataaaactactaagcctctggccagacagtcgggggaaaaaagggaagccacaaattcccaaaaacagaattaagagaggggacaactacaatctctacattcattcatggcatcacgagggactataatgaactctgacaatatagtaaaatgaacaaatccctagaaagatacaacttgctaaagcttatccaagaagaaacagataccaagtagtcacgtatctaccgataagattgaatttgtagtttaaaattttccaccaaaaaaaaactctaggcccatgtagcttcactggtaaatgtcatcaaacattaaggaagaaataacaacaattctacagacactactgcagaaaacagaagaggaagaaatacttctcaattcattgtgaggtcagcattaacatgttaccaaaagcagaaaacgacattataaagcattacatggaagaaaggaaacaacaacaacaaaatgctctcaaaaaaactataaatcaagcaggagaactgcttgaggccaggagttcgagaccatcctggccaacaagatttctatactatcccttagggcttttccttaaataggcactttattataggtgataactgaaggaagtgttcctcacatcttctaaaactatttttaggctgggcatggtatggtggttcatgcttataatcccagcacttcgggaggccaagggaggagaattgcttgagcttaggagtttgagatcaggctgagtaacatattgagaccctgcctccacaaaaaataaaaaattagccaggcatgatggtgcacacctgtagtcctagctactcaggaggctgaggcaagaagattgactgagcccaggagttcaaggctagcaagttttttttttttttaaagttctctcaaggctgcaaagactacagtgagttaatatcatgccactgcagtccagcctgggcaacagtgtgagaccacatctcaaaaaatacaatacaatacaataaatacaatacaatacaataaaaatgttgctaggtgtggtgctcacacccagaatcccaacattttgggaggctgaggcgggaggattgcttgaggccagtttgagaccagcctagacaacatacggaggcctccgtctctacaaaactttaacagcttagctggcatggtgatgcacatctgtggtcccagctacttaggaggctgaggtggaaggatcgcttgagcccaagaggtggaggctgtagcgagccatgatcacaccactgcactgcagcctgagaaatggaacaagatcctgcccaaagaaaaaaacaggacgggcgcgttagctcacgcctgtaatcccagcactttgggaggccgagaagggcggatcacttgaagtcagcagtttgaaaccagcctgcccaacaaggcgaaaccccatctctactaaaactacaaaaattagccagatgcagtggtgtacgtctgtaatcccagctacttgggaggccaaggcaggagaatcgcttgaacccaggaggcgaaggttgcagtgagccaagatcacaccactgccctctagccctagcaacagaacaagactctggctcaaaaaaaggaaaaaaaaaaaaccaacaaaacaaaactatttttatccctactgctatcaaagccaaacagccatgaaaaccaatgtgagattgctgtatctttgcaagttcagtctcttatttgcaaccaatcttgataccaattatcaaacatgtctacctagtaatagtatattctagaaattaagtatagaagtaaattctaggagggccagagagccaggccctaaagctatattaaccaataaaaatgctcaactataccatgacagttgtttcagcaaaaacaaaaaacaccacttccagccggctgtggtggcatgtacctgtagtcctagctattcgggcagttgaggtgagaaggctgcttcagcccaggagttctaggacagtctgggcaaaacagcaagatcccactccaaaacaaaaaacaaaacacacaaaaaaaccaaccactttcactgctatttagacctggatatcagaagccctcccagagctgcccctcaggaagtagacacctttaccactaggcttgccaggtcagtcctcctgcccaacctattcacattgcttccttctaaatccagatcctggggcatctgcctgcactctagctgcaagacagactggcaggagtatgagtatcatgatttcaccaagaagatggaactctcatgtgggaaattatcaaaatataaggaggatatctaagatgctatagccacagtgatagttgtccactagttagattatctttaccatcttaacatcgaacattttatataagatgcttatgaccaattacatttattttcccatcaccacctcctaattatacttactgaacgggcacattttttggggggactgctagaaagtccatccagttgtccatgttcacccagaaatcccgtcacttggtccaagaaagaagatacatctaactggtgccattctactagcttctgacctaaggattaaaaaccaagatctataaataaatataatatctagaatccttctgaacattctccaggatctataaatataatacctagaatccttctgaacactctcattaagtatctctttcagcatatgcatagattaaaaacctggatctataaaggtaatatctagaatctttctgaacattcttattaagtatctctttcagcatatgcatagattaaaaaccaggatctataaaggtaatatctagaatctttctgaacattctcattatctctttcagcatatgcatacattaaaaaccaggatctgtaaatataatatctaggatctttctgaacattctcattaagtatctctttcagcacatgcataaagtgtactgtaaagacatatcctctccaccagcttatgctacatagtgtcttcataacctagaagtcacatcaattatactcacctaacagattcccacccgtaatgatagggcaactatcttatctgctgctatcacttactgccatttaggaagaagagattcagacaaagcaatatctatataaaacaccatcaattaataaaaccagctccaccctctgcttctcaggtgggattacaactagtatctgggcaatcttaatattttaatgataaaaaaaacttttgtcttgttttgtttttttgagatggagtctcactctgttgcccaggctggagtgcagtggcgcgatctcggctcactgcaacctccacctcccgggttcaggccattctcctgcctcagcctcccaagcagctgggactacaggtgcccgccaccatgcccggctaattttttttgtatttttagtagagatggggtttcaccgtgttagccaggatggtctggatcgcctgacctcatgatccgcccacctcggcctcccaaagtgctgggattacaggcatgagccaccacgcccagctggtaaaaaaacttttaaaaaatcccttaaaaaaggtaagatgaacatatcagttattcttcaaaagaacagaactgcacaaacataaaatactaccatctcccaatgttgccagaaaaagatgtcctaaatacatacatcaatagatgtttaaataattataaagggaaaaaaacgaaaccttcacctaaattactgcaattctgaaaacagatccagtcaaatattaaagatcaatcatttaggtaactgaaagacaagtaataggttaaaagctgcgtgctgatataaatcttacctgtccgtgggtccaatatggaaacataggggaaatcccctaacttataaaactgtatgtatctctgaccttcctcactgtcatgataaacctgttaaatcattgatataaaaaaaaaagtcagcctctaagaaaagaaccaactataaccttcttatacaccaacatcaattagctctccaaatatacctccggcctatgtattaagatctcactcctacactaaaaagaaaataaatctggtttgaactccttcaacttcccacttccagcactctctggaaatttaccataaacatattgacccattcctcctcctttcccagttcagatgaggtattattcttcctgctcaagttatctgtcaactatgtcattcataactctcaaccatatacatcttaataaatcacaatatattaagattatgggccaggcatggtggctcacgcctgtaatcccagcactttaggaggccgaggcgagtggatcacaaggtcaggagattgagaccatcctggccaacatggtgaaaccccgtctctactaaaatacaaaaattagccgggcctggtgacaggcgcttgtagtcccagctactcgggagactgaagcaggggaatcgcttgaacccgggaggcagagactgcagtgagctgagatcgtgccactgcactcctgcccagcgacaatgcaagacttgtctcaaaaaaaaaaaaaaaaaaaaaagattatggctccacatggtggctcgcacctataaccctagcactttgtagggcagaggcagaggacagcttgaggccaggagtttgagaccagcctgggcatctccacgagaagtttttttgtttttttttgtttgtttgtttgtttttaaattagccaggtttaatggtgtgcacctatagtcccagcaactcaggagactgaggtgggaagatcccttgagcctataggggttagagcctgcagtgagctatgactgcaccactgtgttccggcctgggtgacagagcaagaccctgtccatttatttaaaaaaaaaaagaaaaaagaaaagaaaagaaagaaagaaaaaaagattataagctcaagagtccagcacagtgctaagcaaagagctgctcgatcaatatttgttgaataaaatacaaggaattttaccattaaagttacattaaatttaggggcctgtaaaatataaacaggcaaattaataacattaatagcatatcttacagtaggggaaaaaattaagctccttcataagtttttattttctataacttttcacaaaataaaaaataaaaaaattgagccggcacggtgattcatgcctataatcccagcactttgggaagccaagggaagcagatggcttgggcccaggagttcgagacgagcctgggcaatatggcaggaccccatctctacaaaaaaaaaaaaaaaaaaaaaattatatgggcatagtggtgcatgtttgtggtcccaactactcaagaaactgaggtggaaggatcatttgagcccaggaggtcaaggctgagccatgttcatgccactgcattgcagcctgggtgacagagcaaaaccctgtctcacagtgggggaaaaatgatacaaggtctgtaaccttatctcattagctgggaagactaaagtgacatgtctaagaacacagagttaaaaagtatcaaactcaagctaaaatctaagtcttagccaaatgcttccaattacctcaagatcttctatacctgcactgtctaatacagcaaccactacccacaagtggctactgaagcacctgaaatcttgctactccaaatggagaaggggtgtaagtataaaatacaaaccatatcttgaagactcaacaccaaataaatgcagatcatctcattatttttgtattagttatatagatatattgatttaaccaaatacattattacagttaatttcatctattttgattaatcttttttaatgtggctactggaaaaatttaaattatgtgtacagcttacaatatatttctactgaacagtacagtttgtttgttttgttttgtttgagatggagtctagctctattgttcaggctggagtgtaatggtgtgatcttggctcactgcagtctccgctacccgggttcaagtgattctcctgcctcagcctcccgagtagctgggattacaggtgcctgctgccacacctggctgattttttgtatttttaggagagacagggtttcaccatgttggccaggctggtctcaaactcctgacctcaggtgatccgccggcctcagcctcccaaagtgctgggattataggcgtgagctactgcccccagccggctttacctttttttaaatgtcttaattcattataacccaattcctttccctcaacaacccacactacaaaagtaaaattctacaaaacttctgattaactctccttctcacctgccagaaaatgaaatgttcccggataatattcttcacagcttcgttgctccacacatcgcggttgaggcactgacatgcaaagtcttgaacattttgaatgtttatcatcagccacttattttgcatctggccacactctttggcctgcaagagtaaagttacacatttgttagaaataatttctacttagtgacagatgtttccgtagttgttcagaggttgttgtctttcattaaaaatactaagtttttgccagatacgacatctagagttttcagcatttatacattctatatatttacttcgcatatgcatttatagctatactgtccatttcaagcactgctcaaatttaaatgaactcatttctcttttatccagttatttgttataatagctgattctctctctctctctctctctctctcctttctttctttctttcttttttttttttttttgagacagagtctaactctattgcccaggctagagtacagtggggcagtctcggctcactgcaacctccacctcctgagttcaagtgattctcccgccgcagcctcccaagtagttgggattaaaggcgtgccccaacacgcctggctgatttttgtatttttagtagagatggggtatcaacatgttggccaggctggtctcgaacttctgacctcaaatgacccgtccaccttggcctcccaaagtgctggaattacaggtgtgactcatcatgaccggtaatggctgaatttttaatgtatgtttaaacatctttacctgaaaaggattcaacaaacttaagatcaacaagtcacgtaattttattctcttgcaacctccatcaacaattttttttttttttgagacgagctttgctcttgttgcctaagtcggagaacaatggcacgatctcggctcactacaacctccacctactaggttcaagtgattcttctgccttagcctaccgagtagctgggattacaggtgtgtgccaccatgcctgactaattttttatatatttttagtaaagagacggggtttcaccatgttggccaggctggtctcaaactcctgacctcaggtgacgcacccatctcagcctcccaaagtgctgggattataggcgtgagccaccgcgcccagccaattatacttctttttaatgaatgcaattggtgtgtatattttactttgttttcttcaacatcatttctggaacatttttaaacatcatattaatctcagttattaggcatatatgctgttttggagaatcaccctaaacattttagtaaaaactgctgagagttttttctcttaagagttgtcttcctaggagtagattccaaaaattgggattacaaggtcaaagaatgtttgagaatgatccccaaacaactctacgattcgtacaacagatatcgatacatcaatcgttagtgcgtactttttgcctgtcagtcccttgtcagcataaagacccatgaaatgctgctgagtggaaaacaatggcagaaaagcaaataagcaaatgctgcctcaaatctttgcctaggaaagaacagtgacacgaaaccacagttttggaataaatttatcctagaacagtattcttttccaaatcagtgtgacatgggaaaatcttaagaatcaatgaatttggtgtaataacaatccaagaacatactggacatcattttgtgggtactgaaaaatgtgagactgagaatatcttctgttttaagaaggtctacatcatctcacaaatagctttttttttgtatgaatcccccagaataaattattttctttttttgttgtttatattttttgtagagacaggggtttcactatgttagccaggctggtttggaacacctagcctcaaatgatcctcctgccctggcctccaaaagtcttgggattacaggtgtcagtcaccccactcagccccagaataaattatcttctaatatttgcttactgattccatgggtgaaaacccaaggtctaaaaagaaatatcctcatattgagccaggaagccgcatttaactggtcaaaggcttattttaaaatatacaaatataataattccttgcttataggaagtaatatttccatttacttccttataggacaaagatttaaaaagtgaatgataaatgaataattaagctgctttaactacagaaacagtatttgaaaataaacggaaaaatgaccatacgttctagagatagactagagcgcacatattcctacagcagggtaaatttacataagtctgccccaaaaacaatgacaagaaaaaaatgtacaaaactgaaaatgaataaaagtccagagtttaaaatggaagagtcacttttttttttcgcttttaaaaatttgtttactcacattcatgctttcattatctcagatttattcattcaacaaatactgagtacctatcatgtttcaggtacagttatagatattaaagtaatagcagttctaaaatataaaaatctttgcctttgtgaagcttccaatgggggagaaacctaatactagcaaaagaaacttggaaatgatactaaccacattgaagatattgttaaaaaattgttactgctaaaaggaagggtgcaaagacacaattttcaaacaaaacaacaatattgggagggaataaaagagtcttgaataggccaggtgcagtggctcacacctgcaatcccagcactttgggaggccgaggtgggtggatcacctgaggtcaggagttcaagaccagcctggtcaacatggtgaaaccccatctctactaaaaacacaaaattagccaggcatggtggtgggcacctgtaatcccagctactcaggagactgaggcagaattgcttgaacctgggtggcagaggttgcagtgagccaagatcgtgccattgcactccagcctgggcaacagagtgaggggaggggaggggaggggagggggaggggagggggggagggggagggggagggggaggggaagggaagaaggaaggaaggaaagaaagaaagaaaaaaaggaaggagggaaggaaggaagggagggagggagggagggaggaaggaaggaaggaaggaaggaaggaaggaaggaagggaaaggaaaggaaaaaggagaggaagaaagaagagtcttgaataagtctagagatctcatgtacaacatgaggactatacttaataatatcgtattatacattgaaaatgtgctgagagcagattattaggtgctcttaccacacacacacacacacacacacacacacacacacacacacacgtaaaaagacaattatggaaggtaaggacaggttaatttgcttgactgtagtaatcattttactatgtatatccaatcttcatgttatacatcttaaatatgtacagtagtctggagcagtggctcacacctataatcccactgccttgggaggccaagacaggaggattgcttaaggcaaggagttcgagaccaccctgggcaacacagcaagaccccatctctaaaaagatttaaaataattgaatatatgcaatttaaaaagagagagtcttaaaaataatctaagtataccaattatgtgaatcaaggactggaggtgagagtgggccatgagaaaaataatctcctcatggaagattatcattgaagaagattactggaatccttggaatctattaggttgttctgaatcaacatttcaaagccattataatggagaccccagagtaaaacagcgggagactaacgtctgtcccagtaccagccagatcaggaaggcatgataaaaaaggatttaggcctggcatggtggctcatgcctgtaatcccagcactttgggaggccgatgtgggctgatcatttgagcccaagagttcaagaccagcctggtcaacatggcgaaaccccatctctactaacgatactaaaattagacgagcgtggtggcgcatgcctgtaatcccatctacttgggtagctgaggtacaagtattgcttgaatctgggaggcagaggttgcagtgagctgggatcatgccactgcactccagcctaggcaacagggcaagactgcctcaaaaaaagaaagaaaaagaaaatgaaggatttgaacaaatttaatatgtttcagtaagtatatatgcataaagtcgagaagaaaatatattaaaatatacacagtacttttttatggaaatggaaattacaattttatttttccttgttcattttctaaatttcaatgatttgtctaatttgaataaaactaaatgtaaacaatataaagtttaatcagaaaaatgttatatattgccaggggcagtggctcttgcctgtaatcacagcactttgggaggccgaggtgggtggatcacctgaggtcaggagttcgagaccagcttgaccaatatggtggtgaaacctcgtctctactaaaatttaaaaaattagccaggcgtggtggtgtgtacctatagtcccagctactcgggagggtgagacaggagaatcgcttgaacccaggaggcggaggttgcagtgagctgagatcgcgccactgcactctggcctgggcgacagagcgagactctgtctcaaaaaaaaaaaaaaaaaaaaaaagaaaagaaaagaaaaaggaaaaattagttactaactaggctcttcttcacattttcggctacatattttcacttgcatttatactaaatacttatgaaattaacaaaatattcttagtaattagagctaggtgcatgtgtaatgggataccaatttaaaatgtgggttttttttcctcatgaaataagaaatattggccgggtccagtggctcacactggtaatctcagaactctgggaggccaaggctggttaatcactggagctcaggagttcaagaccaacctgggcaacgtggcaaaacctcatctctacaaaaaatacaaaatttagccaggcatggtggcacacgcccataatccaggctacctgggggactaagttgggcagatcacttgaacccaggaagttggggctgcagtgagccgagatcgtgccactgcactccagcctgggtgacagagtgagactctgtctcaaaaaaaaaaaaaaaaaggaagaaatattaccgaaattgttctgattctttctgtacaatattccttctggcataatcatgatttcatgaaggctaattaaactgctttagaccccgtggacacacaacagtcaagaaaatgaagtccctgtgttcatacagcttacagcatggtggggaaagaggaaaacgtaggaaacattcccttgcccaggtcagaccatttggcctcagtgctctgctcactcagctggtcttcttgacggtaccagctctttccaacatcagtatgctcacactgtattttccctcagacctccccatcgttcgcattccctcgcttcactaaggtttctattcatatctcatcctttcagaaatcttccctaatcttcctaatacagtcctttctcttcacaattataaacatatgtggaacctacgaaatcaatctggctttcaatttggctgtaagaagaaactgaatttggcaacacggacacatctacttgcaaaggacactagaaatttccagatgcttaactcaattcagaccacacacatcaaatggccctgaacaaaatacagcccccctctctccttcccttattgtattttattctcctttttttttcttttgagacagggtctcactgtgttgctcagggtggagggcaatggcaccaccacagctcactgcagcctcaacctcctgggctcaagcgatcctcctaccccagcctcctgagtagctgctggggaccacaggtgtgcaccaccacgtccagctaattttttcgactttttgtagagacagggttccaccatattgcccaggctggtctcgaactcctgggctcaagtgatctactcccttcagcctcccaccaaagtgctgggattacaggcatgagccactgcatccagctacattttattctttctccaagcaactactataacttgaaatgaatgtcacactctctctctccatcaaagacaaacatatgtattatattcactgttattatatatatgtgtttgtgtgtgtttgttttacgttatttgtttatagtctgtttctcctactagattataaacgctacaatggcaaggattttatataatttaccactatctccctgtggcagaaactgcttataggtaccaaataacccattctccccttgtccctcttacttatagaacctccagtttttaactaagcatctggatttcctagtgtcccttgcaaatgggtgtagccatgctgccaagttatagtagatggaatgtagacagaagtgctgggtacaacttctaggttgttcccttcaagggaaatttgtacccttatcagctcctccctcttccatgctgtttatttttttttaagtgaaagcaagtttattaagaaagtaaaggaataaagtatggctattccataggcagagcagcccaagggctgctggttgccaatttttatgtttatttcttgcttatatgctaatcaaggagtggattacttatgagttttccaggaaaaggttgggcagttccgagaactgagggctcctcctcctttttagacgatacagggcaacttcctgatgttgccatggcatttgtaaactgccactgcactggtgggagtggagcagtgaggatgaccaggtcaccctcatcaccatgttggttttgggggattttagccagcttctttccatgttggttttggggggttttagccagcttctttccatgttggttttggtggattttagccagcttctttccatgttggttttgggggattttagccagcttctttccatgttggttttggggggttttagccagcttctttccatgttggttttggggggttttagccagcttctttccatgttggttttggggggttttagccagcttctttccatgttggttttgggggattttagccagcttctttccatgttggttttgggggattttagccagcttctttccatgttggttttggggggttttagccagcttctttccatgttggttttgggggattttagccacagcttctttccatgttggttttggggggttttagccagcttctttccatgttggttttggggggttttagccagcttctttccatgttggttttggggggttttagccagcttctttccatgttggttttgggggatcttagccagcttctttccatgttggttttgggggattttagcttctttactgcaacatgtttcatcagcaaggccttcatgaccagtttcttgtgctgacctcctatctcatcccatgacttagaatgtctaaccttctgggaatgcagcccactaggtctcagccttattttaccgagcccctattcaaaatggagttgctctgttttaaatgcttctgacatttcctccctcccttttacaagagaacccttaatcctaagggttgtagagggaaaaagattcaacttccgtaacttcttcatgcttaatagggacgatggtattcctgtctattagatctcttgcattcagagtagagaggacctcagtctgaaagcatctgtatggcgagcgccattcctaactcttgagtcccaacagaaggtggtatccttcagccaactggtgctcacagatgattttcctttgggttgggggtatcttcggtatcatcccttctgtgattcgccagaaagatgttactgggccccaccacttaaccaaagttagcctttgggttgggggtttcctcagtattgtcccttctgtggtcgccagaatgatgttactggaaaggggtccggatccagatcccaagagagggttcttggatctagtgcaggaaagaattcagggcgagcctatagagtaaagtgaaagcaggtttatcaagaatgtgaaggtcatgcctgtaatcccagcactttgggaggccaaggcgggtggatcacgaggtcaggagatcgagaccatcctggctaccagggtgaaaccacatctctattaaaaaatacaaaaaatcagctgagcgtggtggcgggcgcctgtggtcccagctactcaggaggctgaggaaggagaatggagtgaacctaggaggtggagcgtgcagtgaggcaagatagcgccactgcagtccagcagtccagcctgggcgaaagagcgagatttcatctcaaaaaaaaaaaaaaagaatgtgaaggaatgaagaacagccactccataggcagaggagccttccatgctgtttagtaagcaaacatggtggtaaggcaacttgaatcatgcagacaagggcaagcaagacctaggggatggcagaacaagacagaaaaaaattctgcaactctaataactttacagagctaatcatcctaatagcctggacttccatcttgcttaagctactgtttgtttgtggtggggtgttccaagatggccaaataggagcagctgcagtctgcagctcccagcatgatcaatgcagaagacggacgatttctgcatttccaactgaggtacctggttcatctcactgggactgggtggagagcgggtgcagcccacggagggcgagctgaagcagggcagcgtgccgcctcacctgggaagtgcaaggggtcggggaaatcatttccctttcctagccaagggaagccgtgacagactatctggaaaaacggggcactcccacccaaataccgcatttttcccaaggtcttagcaactggcaggcaaggtgattctctctcgtacctggcttggcaggtcccacgcccatggagccttgctcactgccagcgcagcagtcagagattgatctgtgaggtggcagcctggctgagggaggggcgtccgccattgctgaggcttgaataggtaaacaaagcggctgggaagcttgaactgggcagagcccaccacagctcaacaaggcctactgcccctaaactccacctctgtgggcagggcatagctgaacaaaaggcagcagacaacttctgcagacttaaacgtccctgtctaacagctctgaagagagcagtggttctcccagcatggtgtttgagctctgagaacggacagatggcctcctcaagtgggtccctgactcccgtgtagcctaactgggagacatctcccagtaggggccgacagacacctcatacaggcggctgcccctctgggacgaagcttccagaggaaggctcaggcagcaatatttgcagttctgcagcttctgctggtgatacccaggcaaacagggtctggagtgaaactcctgcaaactccaacagacctacagctgagggacctgactgttagaaggaaaactaacaaacaaaaaggaatagcatctacatcaacaaaaaggtcatctacaccaaaatcccatctgtaggtcaccaacatcaaagaccaaaggtagataaaaccgcaaagatggggagaaaccagagcagaaaagatgaaaattctaaaaatcagagcgcctcttctcctccaaaggatcgcaactccttgccagcaacggaacaacgctggatggagaatgactttgacaagttgacagaagtagtcttcagaaggtcggtaataacaaacttctccaagctaaaggaggatgttcgaacccatcgcaaggaagctaaacaccttgaaaaaagattagatgaattgctaactagaataaacagtgtagagaagaacttaaatgacctgatggagctgaaaaccacagcacgagaacttcgtgacgcttgcataagcttcaatagctgatttgatcaagtggaaggaagggtatcagtgattgaagatcaaattaatgaaataaagtgagaagacaaggttagagaaaaaagagtaaaaagaaacaaacaaagcctccaagaaatatgagactatgtgaaaagaccaaatctacgtttgattggtgtacctgaaagtgacggggagaatggaaccaagatggaaaacactcttcaggacattatccaggagaacttccccaacctagcaaggcaggccaacattcaaattcaggaaatacagagaacaccacaaagatactcctcaagaaaagcaaccccaagacacataattgtcagattcaccaaggttgaaatgaagggaaaagtgttaagggcagccagagagaaaggtcaagttacccacaaagggaagcccatcagactaacagcagatatctctgcagaaaccctacaagccagaagagtgggggccaatattcgacattcttaaagaaaagaattttcaacccagaatttcatatccagccaaactaagcttcataagtgaaggagaaataaaatactttacagacaagaaaatgctgagacattttgtcaccaccaggcctgccttacaagagctcctgaaggaagcactaaacatggaaagaaacaaccggtgccagccactgcaaaaacatgccaaattgtaaagaccattgatgctaggaagaaactgcatcaactaatgggcaaaataaccagctaacatcataatgacaggatcaaattcacacacaataatattaaccttaaatgtaaatgggctaaatgccccaattaaaagacacagactggcaaattggataaagagttaagacccatcagtgtgctgtattcaggagacccatctcacatgcaaagacacacataggctcaaaataaagggatggaggaagatctaccaagcaaatggaaagcaaaaaaaatgcaggggttggccgggcacaatggctcatgcctgtaatcccagcactttgggaggccaaggcaggcagatcacgaggtcaggagatcgagaccatcctggctaacacggtgaaaccccgtctctactaaaaatacaaaaaaattagctgggcgtggtggcaggcgcctatagtcccagctactcgagaggctgaggtgggagaatggcatgaacccaggaggcagagcttgcagtgagcccagatcgcaccactgcactccagcctgggccacaaagcaagactccatctccaaaaaaaaaaaaagaaaaagaaaaaaacacaggggttgcaatcctagtctctgataaaacagactttaaaccaacaaaaatcaaaagagacaaagaaggccattacatattggtaaaggggtcaattcaacaagaagagctaactatcctaaatatatatgcatccaaattcaaaaagcaagtccttagagacctacagagaagagacttagactcccacacaataataatgggagaatttaacaccccactgtcaatattagacagatcaatgagacagaaagttaacaaggatatccaggacctgaactcagctctgcaacaagcagacctaatagacatctacagaactctccaccccaaatcaacagaatatacatttcttctcagcaccacatcacacttattccaaaactgaccacatagttggaagtaaagcactcctcagcaaatgcaaaagaacagaaatcacaacaaactgtctctcagaccacagtgcaatcaaattagaactcaggattaagaaactcattcaaaactgcacaactacatggaaactgaacaacctgctcctgaatgactactgggcacataacgaaatgaaggcagaaataatgatgttctttgaaaccaatgagaacaaagacacaacgtaacagaatctctgggacacacttaaagcagtgtgtagagggaaactcatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggagatagagacataaaaaacccttcaaaaaatcaatgaatccaagagctggttttttgaaaagatcaacaaaattgatagaccactagcaagactaataaagaagaaaagagagaagaatcaaatagacgcaataaaaaatgatcaaggtgatatcaccactgatcccacagaaatacaaactaccaccagagaatactataaacacctctatgcaaataaactagaaaatctagaagaaatgggcaaattcctggacacatacaccctcccaagactaaaccaggaagaagttgaatctctgaacagaccaataacaggctctgaaattgaggcaataattaacagcctaacaaccaaaaaaagtccaggaccagacggattcacagccaaattctaccagaggtacaaagaggagctggtaccattccttctgaaactattccaatcaacagaaaaaaagggaatcctccctaactcattttatgaggccaacatcatcctgataccaaagcctggcagagacacaacaaaaaaggagaattttagaccaatatccctgatgaacattgatgcgaaaatcctcaataaaatactggcaaaccgaatccagcagcacatgaaaaagcttatccaccatgatcaagtcggcttcatccctgggatgcaaggttggttcaacatatgcaaatcaataaacataatccatcatatcaacagaaccaacgacaaaaaccacatgattatctcaatagatgcagaaaagaccttcaacaaaattcaacagcccttcacgctaaaaattctcaataaactaggtattgatggaacgtatctcaaaataataagagatatttatggcaaacccacagccaataccatactgaatgggcaaaaactggaagcattccctttgaaaaccggcacaagacaaggatgccctctctcaccactcctattcaacatactgttggaagttctggccagggcaatcaggcaagagaaataaataaagggtattcaattaggaaatgaggaagtcgctctccctctccctctcccctttgcacggtctccctctgatgctgagccgaggctggactgtactgccgccatctcgactcactgcaacctccctgcctgattctcctgcctcagcctgccgagtgcctgggattgcaggcgcgcgccaccacgcctgactggttttcgtattttttggtggagacggggtttcgccgtgttggccgggctggtctccagctcctgaccgtgagtgatctgccagcctcggcctcccgaggtgccgggattgcagacggagtctcgctcagtcagtgctcaatgttgcccaggctgaagtgcagtggcgtgatctcggctcgctacaacctccacctcccagccgcctgccttggcctcccaaagtgccgagattgcagcctctgcccggccgccacccagtctaggaagtgaggagcgcctctgcccggccgtcatcccatctaggaagtgaggagcgtctctgcccagccacccatcgtctgggatgtggggagtgcctctgccccgccaccccatctgagatgtgaagagcgcctcggcccggcagtgaccccgtctgggaactgagaagtgtctctgccccgccgccacccactctgggaggtgaggagcctctctgaccggccgccccctctgagaagtgaggagcccctctgcccagcagccgccccgtctgggaagtgaggagcccctacgcccggcagccgcccatcagggaggtggggggcagcccccacccggccagccgccccgtctgggaagtggggggggtgggggcgcctctgcccggccgccccgtctgggaagtgaggagcccctctgcccggccgccaccccatctgggaggtgtacccaatagctcattgagaacgggccatgatgacgatggtggttttgtcgaatagaagggggggaaatgtagggaaaggaaggagagatcggattgttactgtgtctgcgtagaaagaggtggacataggagactccattttgttctgtactaagagaaattcttctgccttgggatgctgtttatctatgaccttacccccaaccccatgctctctgaaacatgtgctgtgtccactaagggttaaatggatgaagggcggtgcaagatgtgctttgttaaacagatgcttgaaggcagcatactcgttaagcgtcatcaccactccctaatctcaagtacccagggacacaaacactgcggaaggcagcagggccctctgcgtaggaaaaccagagacctttgttcacatgtttatctgctgaccttccctccactactgtcctatgaccctgccacatccccctctccgagaaacacccaagaatgattaataaacactaaaaaaaaaaaaaaaaaaaaaaaaaggaaatgaggaagtcaaattgtccctgtttgcagatgacatgattgtatatttagaaaaccccatcgtctcagcccaaaacctccttaagctgataagcaacttcagcaaagtcttaggatacaaaatcaatgtgcaaaaatcacaagcattcctatacaccattaacagacaaagagccaaatcatgagtgaactcccattcacaattgctacaaagagaataaaatacctagaaatccaacttacaagggatgtgaaggacctctttaaggagaactactaaccactgctcaacgaaataaaagaggacacaaacaaatggaagaacattccatgctcatggataggaagaatcaatacctgaaaatggccatattgcccaaagtaatttctagattcaatgccaaccccatgaagttaccaacgactttcttcacagaactggaaaaaactactttaaagttcgtatggaacctaaaaagagcccacattgccaagacaatcctaagcaaaaagaacaaagctggaggcatcatgctacctgacttcaaactatactacaaggctacagtaaccaaaacagcatggtactggtaccgaaacaaatatatactatatctgtttcaaactatactacaaggctacagtaaccaaaacagcatggtgctggtaccaaaacagatatacagaccaatggaacagaacagaggcctcagaaataacaccacacatctacaaccatctgatctttgacaaacctgacaaaaacaagaaatggggaaaggattccctatttaataaatggtgctgggaaaactggctagccataggtagaaagctgaaactggatcccttccttacaccttatacaaaaattaattcaagatggattaaagacttaaatgttagacctaaaaccataaaaaccctagaagaaaacctaggcaataccattcaggacacaggcatgggcaaagacttcacaactaaaacaccaatagcaatggcaacaaaagccaaaatagacaaatgggatctaattaaactaaagagcttctgcatggcaaaagaaactaccattagagtgaacaggcaacctacagaatgggaaaaaatttttgcaatctacccatctgacaaaaggctaatatccagaatctacaaagaactcaaacaaatttacaagaaaaaaacaaacaaccccatcgaaaagtgggcaaaggatatgaacagacacttctcaaaagaagacatctatctatgcagcgaacagacacatgaaaaaatgctcatcatcactggtcatcagagaaatacaaatcaaaaccacaatgagataccatctcatgccagttagaatggcaatcattaaaaagtcaggaaacaacagatgctggagaggatgtagagaaatagggacgcttttacactgttggtgggagtgtaaattagttcaaccattgtggaagacagtgtggcgattcctcaaggatctagaactagaattaccatttgacccagcaatcctattactgggtatatacccaaaggattataaatcatgctgctataaagacacatgcacacgtatgtttattgcagcactattcacaacagcaaagacttggaaccaacccaaatgtccatcaatgatagactgcattaagaaaatgtggcacatatacaacatggaatactatgcagccataaaaaaggatgagttcatgtcctttgcagggacatggatgaagctggaaaccatcattctcagccaactatcacaaggacagaaaaccaaacaccacatgatctcactcacaggtgggtattgaacaatgagatcacttggatacagggcagggaacatcacacactggggcctgtcgggggctggggggctggggggctgggggagggatagcattaggagaaatacctaatgtaaatgagttgatgggtgcagcaaaccaacatggcacatgtatacctatgtatcaaacctgcatgttatgcgcatgtaccctagaacttaaagtataataaaagaaataaataagctactgtttgttttttttttttccagtctctctcacatgcagtcaaacccttactcttgatcacctagaactaggtcctgcaacacaaggcctcaataaatatgtattgagtgaacaagtgaattaatcagtctctctcatctggttagcatgagccagaaagaatccttgaacatgacctacctctagttacactagcttctaagcctgtaaaactgtggctcacatttacatctaatatgaggaacaaacctatgggccctccttggtcagccaaagagtatccctctaatttttaacatttatctttctaaacttcaatgacttaattttgcttgttatctccctaattgttataaaactaatacatgtatcattaaccataatgaaatacctgcttttggaagggaatatttatttcatttaaagtcttgcagatggttaagtataatattatcagtgaaaaaaaaaatggactgctgtaaacacaggccatgaaatacaaggcaaaaaaggtgatataacttaaatttcaggggacaacatcaaaagagattcgtattttcccttaatgaccaagcagaaaagtaactgctttttcactccaaagtgaccaaactaaatcaagcttagttactgcattacgtcctagagcaactcataagctaataaaaatagaacacgtgccaaaacaaactaagatccttttctgcctttaatattgctgctattctctctctcaatggctgtagtatcaccagaatactagaaaggataggcagctgccatgttgagaccatgaaggaaagatgaagaaaactgaggagacatctaacctgacatctttgagcttatgaatgaacagcaataatttcttcaactctaggcttattactgacaaaaagaaagcattgtttggtcaaattatcatcatttgggttttctgttacatgcagccaaaccactttcaaggttttctgattcagaaaattgaaactggagagcacgctgatatggtttggaaatttgtcccctccaaatctcacactgaaatgtaatccccagtgttgggggtggggcctcgtaggtggtgtttgggtcatgggggcagacccctagtgaatggcttgaccccttgctcctcgcaccatgtgctacaccggcttcccctttgccttctgccatgactgcaagcttcctgaggcctcaccagaagcagatgtcagcacaatgctttctatacagcctgtagaaacgttgagtcaaaatatacctttttctttataaattgcccagtctcagggattcctttctagcaatgcaagcaaactaacacacaagcttacattgaaattccttctcctaaatacttcatgtatgacagtgtaaaagtatatcaaaggacacatttaaaaaaaaataatcataacatattcaaatatgcagctgatatacatcggttgtttattttaagaaatggggtttcagctcatgcctgtaatcccagcactttgggaaccaaggcagaaggatcacttgacaccaggaatttgagaccagcctggggaacacagcaagaccccctctccacaaaatatttttaaaattggccaggtgtggtagtgggtgtctgtagccctacttatttgggaggttaagaccaggggatcaattgagaccataagttggaggctgcagtgagccatgattttgccactgcactccatcccaggtgacagaatgagaacctgtctcaaaaaaaaaagacaaagaaaagggaaagatagggtctcactatgttgcccaggctggagtgcagtggttttcataggcatgatcatcacacaccacagcctcaaactcctgaactcaagggatcctcccacctcagcctcccaagtagtagttagtttggggcacctgttgggcttgatacacatcattcttgcagttattctttggcctacagggtcctaacaggtaagacttaactgaaggctgggcgcggtggctcacgcctgtaatcccagcactgtgggaggctgaggtgggcagatcatgaggtcaggagtttgagaccagcctggccaatatggtgaaaccccgtctctactaaaaatacaaaaaattagccaggcgtggtggtgcgcacctgttttcccagctactcaggaggctgaggcaggagaattacttgaacctgggaggcggaggttgcagtgagctgagatcgtgccactgcactccggcgagactccatctcaaggaaaaaaaaaaaaaaaagactcaactgaaatgtaactgatttacatctatggaaatgctattgtaattcaaaagagcattaacatgttaatcaacacgaaaaggcaagctgtttgaacacctcaacagaagagtatctaaaatctttactaaactccttcatttaacatatgtgttcctcctaatgcaagagaatgggtcccaaggattattaaaaagaatgatctttcctctgccctaagtaagtctgtaagttagcatacaaccaagtaaacatactctggaaagtttttgtttgggtttagtcacgataaaaccaagaagaactgagggtgaatgtgttctccaattagagatattcttttcaaacacattacgatccgcacagaaatatagacaaaagacacctatcaacaatttacaaatggctaacaaaccacacacactattctcagtagtagtcaaagatatatgaacaagtgagatattttaaaaagctatcaaaatggcaaagattctaaaatgacaccgcacaaggctaataaaaggatttcatcaatctcatatactgctggtagaaatatatttcatatattgctggtagaaatataaatcaatgtaacctttaggcatatcatgtagatatacttattataatgccaattccctatacactgacaatggttttttgttcttataaaaataaaaaatgccactgaaggccaggtgcagtggctcacacctataatccaagcagtttgggaggctgaggcaagaggattgcttgaacctaggcattcgagaccagcctgggcgacacagtgagaccctgtctctaccaaaaaaatttttttaattagctgagtgtggtggcacatgcctatagccctagctactcgggaagctgaggtaggaggatcccttgagcccaagagttcaaggctgcagtgagctatgattgtgtcactgcagtccagcctggacgacagagcgagacctgctctaaaacaagtaattttttaaaaaaaggcattgaaaatgcaaaaggattcatagttaaggcactgactctccaacaacttactgtttcaaagctgcctttatgcatcaaatcaatgggtggccggaatagatctgcaagggtagttaatttcttatcgatagctcctccatttcttaattcttgttcttgccgaactataatacagaaggatgaaagtttcagttagccataatcatgaatcacactgaaaaaaaaaaaaaaaaaaacacaaacttctgtcaattgaaggaattgctgtcaatatgcttgacctcaaatacaaagatctaatgttgactctgaaaaaaaaaaatgcaaagggagataagaggaatcttaagacttggtggtattccctatcccaaggatacaaagaaaattaactgaaaatattcacttaatcaaagtaacctcttcacatattcagaaactaactgtaacatgggagaggctgagtgcggtggctcatgtctataattctagaactttggatggccgaggtcagcagatcacctgaggtcaggagtttgagatcagcctggccaagatggtgaaaccccgtttcaactaaaaatacaaaaaaaaaaagccgggcatggtggagcatgcctgtaatcccagctactcgggaggctgaggcaggagaatagcctgaaccctggaggcagaggttgcagtgagcagagatcgcgccactgcactccagcctgggcaacagagtgtgagactccatctcaaaaaaaaaaaattagccaggtgtagtggcgcatgcctgtagtcccagcactatgggaggctgagatgtgcggatcacctgaggtcaggagttcaaggccagcctgggcaacatggtgaaacctcatctctactaaaaatacaaaacttagccgggtgtggtggcacaagcctgtagtcccagctacttgggaggctgaggcaggagaatcgtttgaacctgagaggtgaaggttgcagtaagctgagatcatgccactgcactccagcctgggtgacagagcgagactccatctcaaaaataaatagtaataataaaaaaaagattatgacagtagagatgatgaccactgttgtcaccttccactggaaggacacaggattccctagatgacttgagtcagtttaggttccccatcaattctctccaaagtcacaagacctatctgtgcctcaatgaactcattctaaataaactacaaaatcaagcatggtccaagggtttctcatatatcctaacctaactgtcctttctttaggattccattgctaaatcaatactaaatcctctaaaagcataagaccaagattctcattctaatttattacacaaaaatatttcaaataactgtagccaaaatattaatagtggctgctttgggtggcatggcttttcctcctatttttcaatctcttataataaccattttcattatatattcctttcattgacagaagtcaggatcctgagggaaatcagtttattttattatagtaagcattttaagtgtttattcacaagcgaattaagtttatcaattaccatatttcctacattatctccatctcctttactatttttctataaccaaataggttagaatttggaacaatttagctcaggggagaattaatcacattctggatccataatttcactttttaaagaaggtgaaaacttaaaagtaattgggcctaatagtaatcatctttgtctttttaataggaagagaagagggagatgataaactggtccatagatacctactagtttcagtctgaaaatcccggaaaccatcaaaaattgaacgtgcaggccgtcgtcttttaggagctttggggagaaaaaatagaattgaaaattttttaaattaattttgaaacaattctaaaaatgtccttatctaaaagtatttttttaataaaacatatgaaacccttcacgaactgcatgtcacccttgcacaggggccgtgctaatctctgtctcgttccaattttagtaaatgtgctgccgcagcgagcacagtatttcttgttttaaaacactcaagattcatatggtgccttccctcaaaaaataaaaaagtttaaaaactttcaaatcattcatgtataattaatccaaacatcttccatccagtcatcttgtattacaaatgagaaaattcaggcccagttacaatagacttaatcaaacttgtgtaaaaagtttactatcggctgggcatggtggctcatgcctgtaatcccagcactttgggaggccaaggtgggtggatcacctgaggtcaggagtttgagaccagcctgaccaacatggtgagcccctgtctctactaaatacaaaaaattagccaggcgtgatggtgcatgcctgtaatcccagctacttgggaggctgaggcaggagaatcacttgaacctaggagacagaggttgcagtaagccaagactgccattgcactccagcctgggcaacaagagcgaaactccatctcaaaaaaaaaaaaaaaaaaagtttactatcctggccaggcactgtagctcacacctcctgtaatcccagcattttgggaagccaaggcaggtggatcacctgaagtcgagttcaagaccagcctgattaacataatgaaaccctgtctctaataaaaatacaaaaaaactagccaggtgtggtggcacgcacctgtaatcctagctacttgggaagctgaggcaggagaatcacttgaacctgggaggtggaggttgcagcgagccaagatcacgccactgcactccagcctgggcaagaagagtgaaactccgtctcaaaaaaaaaaaaaagtttactatcttaatatccaagtggtgatatcaggaagaaagaagattttgaggatgatgccacgtagagatgaagccacacacatgctgcagatatccaattcaggttagccctgttgtatagagtaactctacattctaaaccataagacttaaggactatttcttagggattggattggacccacgtgcagaaccataaagacaaaaaacatctttaattctggaaacttttttcacagttacacaatggtttaatgacagaaaagtaaacagatccacctaaggtattccactacccctgtagagtgtctattacccagtctttaagtattttacagataaggtgtagaatgctagaatcaaaatgttatcttcctatatctatgtgttcttaaacctaaacaaattaccagatcatttatgtacattacaataaataaaggcttttcatgattccctcaatatgggtaagtaactaagttggcttatggcaaggctggccagcatgtaaccagaataattatctgttaataaatgattagtatcaagattagacagagactacagaatccccttaacgcgtgtcaaaacatctttcccaataactcgtgtttgtgattacataggataattctttatatccagaactaccgagtaaaaggcaaaacaaagcaacaaaaaaatgcacaacatattaaaaacttcatttttgtttaaaacatatattcatatgcatatcattcctgtgtatatgtgtatgtttttatgttaaacaatcacactatcatctctgggaaaagagattttgtaatacactgtcatgttttattttatttttttttgagacagtgtctcactctgttgcccagctggagtgcagtggtgtgatcatggctcactgcagactccatcctcctaggctcaagccatcctcctgccttagcctcccaagcagctgggactacaagtgtgcagcaccatgttcagtttttttgtttgtttgtttgtttgtttttttaagagacgggcatgtcactatatcgcccaggctagtttggaactcctgggctcaaggaatcctcccatctcatcctcccaaagtgctgggattacaggcaccagccaccatgcccagcctgaattaattaatttatttatttattgcgacagagtctcactctgttgcccaggctggagtgcagtggcatgatctcagctcactgtgacctccgcctcccaggttcaaggcattctcctgcctcagcctccctagtacgtgggacaacaggcatgtgccaccacgcccagccaatttttgtatttttagtagggagggggtttcaccatgttggccaggctggtctcaaactcctgacctcaagtgatccacccgcctcggctaccaaaagtgctggaattacaggagtgagctactgagcctggcctgaattttatttttaatttaaatattgcaccctgtgtcgctctctaccttcctccctccctcctttcttcatttctattcaagaaaaagcaagaaatgtcatacttttcaatcttagaactatttttgatcaagagctcctatttcaaatgtacatggcctctagcaggaataatatagcctgccaaagaatgcctctaaaactagttatctggccctggtgcagtgatgtgcgcctatagtcccagctgcccaggtggctgatgtgagaggatcgcttgagccaaggagttcgagtacagtctgtgcaacatactgacaccctgtctcttaaaaaaaaaaaaaaaaaattaactttttaaaaataactagatatctgaaactttttaactgtaacaattaagaaactggctggaggctgggcatggtagctcacgcctgtaatcccagcactttgggagaccgaggtgggtggatcacgaggtcgggagattgagaccatactggctaacacggtgaaaccccatctctactaaaaaatagaaaaaattagtcaggcgtggtggcgggtacctgtagtcccagctactcgggaggctgaggcaggagaacagcgtgaacccaggaggtggagcttgcagtgagctgagatcgcaccactgcactccagcctgggccacagagcgagactccatctcaaaaaaaataaaaaataaaaaccaaggatgtcttagaataagaatagctgcctaagaaagtatattattttaggaaggtagcacataaaaggtaattttcttctacttttaaactgccaaagataggttagtcaatattccacatcacctttccaacctcccccttctctataagggactgatctccgtatactcactagttcctcttattgctatccttctacccaattccttttacttcttgggctaataaccctcttcccatttgtcttcccttcgtttaccctatttctaagcaaaaacctctcctcagaccacaccacctctagccctaagactattactgctacctgccttttcaatgtggtctcctggctcttccaagccgtctgccacaaggaaacatcagtcctctgtcctcactctactgcccacataatagaagtactggtcactgaagccaaagagactaagctataaagagctaaaagaaattcaggagcttcaaagtcagcataggggagggacaggtggagaaaaaatgtagtgagaagagtggcactgttttacatgtccacatatctgttcgtatttggcttcagagaagacatctggatcttcagatctgcttctgcattcctttagatctgctgctattcttttagttcaagtatagaaagaaaactaaaatttactctcacgcagacacgcagttgtaaaagggagtagtgggctttttgttttaaaagatgggggtctcactatgttgcccaggctgaagggcagtggctattcacaggcacaatcccactactgatctgcacctgctccgtttcctcttccttaggtcatctggtgtcctccactgctggcaggtcaccatattgattccgaacttagtgcagacacccaatcagcatagggccctacagccaagaactcctggggctcaagccatactcccgcctcagcctccagagtagctgagactacatgtctgtgccaccatacccagcagggaggagtgttttaaagtcttagatgattgtggatattcctctttaacagtacaccaatacttaaccaatggtagtttcttagaggacagctgcaaagtggaatctgaaatcttatcaatgagtttttcatactgtttcattaaaacccactgtactatgtggtaggcagtgtctaagacagcccccaattttccctgtctcccagtattgataacctgtgggtgaataccttgagtacaggcaggattgaacagaatgtggcagacatgatgggatttcacttccagattacgttacaaaaagacagtggcttccgttttgggctgccctctctggctctctcatttgctctgtgttaagaatggatgcccccaggcaatagccacatgaatgagtttaggagatcctcctccattcaggctttgagatgaatggtagcctagctgacatgttgaccacacctttgtaggagaccctaaccaaaggccacacccagattgctgacccaaagaaactgagataacaaacgtttgtttttttcaggcagtttaattttggaacaatttttcactcagcaataaatatctaatacaattcatctcgcagtctgaatggatcttttacctatgcacaattttgtagtatcatgcattggttattcaaaaatacttgtttactgagtaatgcaaacatttcaaatattaatggtttcattacacagtattttaaaaatcatctgtttcatgtcaccactgatcttatcagaaagccttcaagtactgggaaagtatcaagctcacaaaggtgggtacaaaaaattttctaaaatcctgttttttgcctgaaagctcttttgtaatttatcattgtttttgagatgaggtctgtcatcagtaggctgaagtgcagtggtgcaatcatggctcatgccttgacctcccaggctcaatccatcttctcacccctcggcctcctgagtagctgggactacaggcatgtgccaccacacccagctcatttttttcttaattttttgtagagatgggggtctccctatgtagcccaggctggtgtggaactcccaggctcaaacaatcctcccgcctcagcctccgaaagtaatcccaaagtgttcggattacaggtgtgagtcaccacgtccggccaaacctcttttttaaaatcactgataacaaacactctcagttgtattgaagtaacaagctcacattttcaagaaaatgccaactgtcaaagtgtaaactgatagtctgtcagcgatttttcaagtaaaaagaatgttccatgaaaaaagctgcctacttcagctcgctactctaacaatcacacaagtgcttttccttaaggtaatcatagtacttcattatgccaaagtgctttgtgcatacatcctatttcaaacaatattttaaaactgtgtactcaaggatcaggatttaatgaaattaatcatttttattgcttcatcaagaacattattaaagaaaactgcttttaaattaatttattatttttttttgagttggggtctcaatacgttgcccaggctggtctcaaactcctgggctcaagcaatcctcccgcctcagcctcccaaagtgttgagattacaggtgtaagccactgcaactgtcctatttatgtttcttttatagacagggcctcactctgttatacaggctgcagtgcagtggcatgatcatagttcactgcagcctagaactcccaagctcaagcgatcctcccacctcagactcccaagtaactaggactacaggcacgtgccaccatgcctaacgaatttatttttattttttgtagagataagagtcttcctatgttgtctgggctactctccaactcctggttgcaagtgatctgttcaactgtggcctcccaaaggactgggattacaagcatgagccactgcacctggccctgccttttagattttttttgtaaacttcaaatatgcagcagtgaagaattcactatctagtgatacagcctgaagccaccacatgaattcaaccaagatgccagcagtctgactcatcattgtttctgaactatcagtctaaatgtcaccacaatgaaaataatttgatgtccagtataatggtgcatgcctataatcccagctacttaggaggctgagataagaagatcacctgagcctaagagttctggcctgtagtgtgctatgccagtcaggtgtctacactaagctcgacatcaatataattacctcccggaagtagggggaccaccaggttacctaaggaggggtgaactggcccaggttggaaacagaggtcaaaactcctgtgctgatcactagtgggatcacgcctgtgagcaaccactgcactccagcctggggcaacacagcaagaccccatcttgggaaaaaaaaaaaacccttagtattattacgtaagttgttttaactttacagacaacctgaaagggaatattagggacctgagcccacacctgaactgtgatttaaatcaatactgtcttaagaaaatagtttctaaagacccatttcaagttataacgtctaataatgaaaggtaagaatgacttcctaactgtaaaaagtcattctcagtgtcgtccttactgtacaccaattcagagataaaaaaaggaagaaagcggccaggtgtggtggctcacgcccgtaactccaatatgggccaaggccaaggccaaggcaggcaggaagcttgcttgagatcagttccatagcagccagggcaaacagcaatgccctgtctccacaaaacaaaacaattagccaggcgtggtggcatgcacctatagaaggctgaggtgggaggaatccttgagcccaggagtttgagactgcagtaagcaaggattgtatcactgcactccagcctgggcaacagactccatttctgcaaaacaaaagaaaaaaaaaagagtaaagtggggcttccaaatggaattcttctgcctctgttcaaaagcaatacagcacagaatttacttcctatagtcctacaaagacgctgtattattccttgcaataaagagaagataaagcttccaagggcattactcttttgctccaaatctattcctagcatttatatttttaaaattatgagcaatatggtatattaacagcataatgactatctgcagtgagcagtccagaaagcacttcattacactacagtattcagactttacagctttcctcttgccttttatttccaaatctagacagtatattcttttgtttcttgctataataaacaccaaagctgccaagttaaaaacatttatctcggccgggtatggtggctcatgcctgtaatcccagcactttgggaggccgaggcgggcggctcacctgagctcgggagttcaagatcagcctgactaacatggagaaaccccgtctctccaaaaaaaaaaaaaaaaaaaaaaaaaaatatatatatatatatatatatatacacacacacacacacacacacatatatatatatacacatatatacaaaaaataaaaattaaaaaaataaataaaaaggtttatctcataaaaactctcaactaaagtactttatcaaaagacatacatataattttattcatccttttgttacaacgtatatttcctcctcttagtttaccgatgaaggctatgtatgtattatcctaagtgaattaatgcaggaacagaaagccaaataccggacgttctcataagagagagctgagtacaaacagacacaaagaagggaacagacaccagggcctggttgagggtggagggcgaggattgaaaaaaatacctataagccaggcgtggtggctcgctcccgtaatcccagcactttgggaggttgaggccagaggatcgcttgagcccaggagtttgggaccagcctgggcaacatagcaagactccatctctattttaaaaaaaaaaaaaaaaaaaaagtaaagaaaggaaagaaagaaaagaaaagagaagagagaagagaagagaagagaagagaagagaagagaagaaaaactacctattgggtactacgctcattacctaggtgataatctgtacaccaaacccacgcaacatgcaatttacccatgtaacaaacctgcacatgtaccccaaacctaaaataaaagttggagggaaaaaaatttgtatgtctcttgtactcaattgtatttatttatttattttgagagagagtcttactctgctgcccagactggagtgcagtggcagtatctcggctcactgcaacctcagcctcccggtttaagcaattctcatgcctcagcctcctaagtagctgggattacaggcatgtgctgccatgcctagctaatttttgtacttttagtagagatgggattttgacatgttggctaggctggtcttgaactcccggcctcgagtgatctgcccacctcagcctcccaaagtgttgggattacaggtgtgagccacctcaacacaaagtatttctctgcattaactgttctcaatatatactatatacagttttctgtcttggtctgcccaagcagattgtaattccatcttgtatttttttctatataaactcatgattaacacaaactctttggcttacaaaagggaaataaatgcttaacgataaattaatctgattaaatgtcccattctctatcgccagtctctatccagattcatatcacaatttttcacatgaatgaggggttactgtgcccttcatccacatgaggaacagcacttctacaaactaagagagaaggtaaggcatatctagagagtaaggatatggcagtcaagtaggtatccagaaaataaaaataatcagaatcttttcattattcattcccattacaaggcagtaattctttttgctaacgtccctccttttggcattttccaacaaatatcaatttttaacatctgcttcactctttgtgagtcaactgtgcaactttcttgacaggactatagaaaaaataagaaatgacaccacacttctaacagtctcctagcaagccttcacatcttttgatggtttcattaaaatcctaaagaacaaaatcaaataaggctaagggaaaaaagtgaacttaccaccaaataatggttctggttccaccagtatttcctgcttttgaggaattggggcacgaacttcttctctattaaaaaaaaatgggaaaataaaaaatgaaaactgttttctgctacctgtttgctttctgtaaatactgtgaatatattcaaattaacgtagtgacttttagaagcacagtaataataagtttttgtgttgctatttttttgggggggcggtggagacagtgtctcactctgtcgtccaggctggagtggaccgacacgatcttggctcactgcaacctccacctcccgagttaaagcaaatctagtgcctcagcctccctagcagctgggactacaggcatacaccatcacacctggctaatttgttttcatatttttagtagtgacagggtcgcgccatgttggccaggctggtctcaaactcttgagctcaagcaatccacccacctcagccttccaaagtgctaggattacaggcatgagctactgcatccggctgataaatgagttttagatagtttccacataaagctcaagtggaaaagagtacctggcatatatagctcaaatggtttggaaataaaaacaatttccccttccctctcaagtttcctaccttaaattctgtcagaaaaaaagaaaaaaattttcccccaaaaaatcaggcagaaatgaacagaaaaatataggcttaatagaagcaatatcacattactactatatcaaagaataattaaatcacaaggacatattaaaataaactttaaaaggcagtgaatttcatgctaattatgaaagaggctaacaggtatgatcttggattatttactaaaaagatcctaatatacagaacaaaaaaagtaattactcatcttttaaaagcctattttcttcaaagtttacattcatagggtttactgataatccatctcttccaataagaaaaaactcatttagatatactgtaaaaatggtgtgtgcctttaaagattagtttattttaggttgggcatggtggctcatgcctgtaatcccagtactttgggagaggaggcaggaggctcacttgagcccaggagctggagaccaaccttggcaacatagtaagactccatctctaaaaaaaaaaagaaaaagaaaaaaaaaaattactttgttttacagttgtaactcaactattgaactttgctgattaatgttcacagcaaatagtaacttcctaattcattatcttcctgcttataagtattattatataagcatgcaaattccatataaatttatgttagccctaatggtttttttttttttttttttgagacggagtctcactctgtggcccaggctggagtgcagtggtatgatctcggctcactgcaagctccgcctcccaggttcacgccattctcctgactcagcctcccaaggagctgggactacaggcgcacgccaccacgcccggctaattttttgtatttttagtggagacggggtttcactgcgttagccaggatggtctcaatctcctgacctcgtgatccgcccacctcggcctcccaaagtgctgggattacaggcgtgagccaccgcgcccggccaatggttttcattcaggtgttctgaacagtattaactaaagatcttgtttttgacatttaagtgttggaactccaaaacatcctttatgaaatgaagtaggaatactcatttgtcaataattacatcctgtaatcaaagaacaaccagttaaagaaatttccaataaaccaagtgacaaaaggataattcaaaattatgttaagtaccctttcctactgctcacacacaaaatttcgataatctgaagaaacagacgacacatctataagagtaagctctgtcaatcctttcatcaaaaggaaataggccagccaggcatggtggctcacacctgcaatcctagcattttgagaggccaaggcaggtggatcgcttgagctcaggagttcaagaccagcctgggcaacaaggcaaaaccccatctttacaaaaaatacaaaaattagtcaagtgtggtggcatgcgcctatagtcccagctacttgaggcgccgaggttgcttgaacccgagaggaggaggttgcagtgagttgagagcagtaagcagagatcacacccctacattccagtctgagttacagagcaagactgtgtttttaaaaaaagagttaattatcttaagaaaactggtgcacacagtggctcacgcctgtaatcccagcactttgggaggccgaggtaggtggatcacgaggtcaggaaatcgggaccatcctggtcaacgtggtgcaaccccatgtctactaaaaataagaaaattagccgggcgtggtggagtgtaccagcagtcccagctacttaggaggctgaggcaggagaatccacttgaacccaggaggcagaggctgcagcaagccaagatcacacctctgcactccagcctggcgacacagagagactccgtctcaaaaaaaaaaaaagaaaagaaaaaaaaagaaagaaagaaagaaaacttttacctaaacaaaactttccattattgttatacctcgctttacagtgtgtgtgtgtgtgtgtatatatatataattgtctcaatctcagacaactcagttgttctataaacaaactttaatctgatgaaatgcatcaattagaggggtggattaagtagtacacttgtccttacacgaaaagacttgattactacattatctgagggtatctgtaccaagactgtcagctaccaagaatggaaggatggaacagaaaaaagtgaataaagaaaatcacactttaggaattaggagccattatcaaatgttaatcaattagcaatacaaactatctaagccaagttatatatagggcaattcattaggaaaagatattcatttatcaaaactatttttcaacacaattgagaaaacatgttttatacaatgaggataaatatgctctcccaaaacaactatgaatatttgctattcaagtttctgtattaggtggttttttgtgttttttttgttttttgttttttttttgagacaggaggcctcactctgtgtcatccaggttggagtgcagtggcacaatcatggctcactgcaacctcaacctcccaggctcatgtgatcctcccatctcagcctgccaagtagctgggactacagtcgcgtaccaccacacccggctaatttttgtattttttgtagagacagggttttgctatattgcccaagctggtctcaaactcttgggctcaagccatcctcctgccttggcctcccaaagtactagaattacaggcatgagccaccatgcctggactttttttttaaatattaaggttttcatactgatttctgttaagagtttgagctatattgggagcgaaatacatggccaacattaacagaaaaaactctacacaatattatttttattatttttttgagacagagtcttgctctgtcacccaggctggagtgtagtggcacgatctctggtcactgcaacctctgcctcctgggctcaagcaattcttgtgcctcagcctcccgagtagctgggattacaggcgcatgccaccacgcctggctaatttttgtatttttttttttagtagagacacggtttcaccatgttggtcaagctggtctcgacctcctgacctcgtgatcagcccacctcggcctcccaaagtgccgggattacaggcatgagccaccgcgcccagcctagcttcaagcatttttcatagcaactcaaaacatttctgtgacaatgtagaaaaacctaaaattgggaaatctgaactttactgggctctactgctacttaattgctgtgtagcttggggaaatggctatgcctctgcttccttattggtaaaatgttgataatgccatccaataaggtgtttgtttatttgctgctgccgtgaggcacacaggccctgctggccacgggccaatcctagcagagcaccaccacacactccaaccaaccccatctccccgacttcacagagcctacacggttcctttgaggattaaataagcaagacagtactctaaagaatttaaagtatgtaactacaaaaatttccacttcatactttttcagaggctttcagcctttcatttatttcaaaaccagagaatcgacctagctttgataaaaatgcaactacttaatttaggcaatggatagctcctgacaacacataataaattcatactctgtgtgtggtctgacagtagagacacttgctgaactggtactgggctcttcagcgattcctccaccatccaaaaacatagtgactgccatttccagattattgttgcacgcttcaagcatatgttttcctacactttcacttgcacctgaaacagtaaaaagacaggaaaaacgttaaaaaaaaaaaaaaaaaagacagcctctttcttcagctcatattagaattcccaagtaaattaatagtatttttcccttttagaatgaatgactttcttgtgaaatacacagagctagaaaaaaatgtagacattcttgaagtgaaatacagagctagaaaagaatttagcagcattaaagagtaatcatccttcataataaaacaaaaactaaataaagcattttttggccatttctttggccatttatttaaatggccaaagtatatatttgggaataagctgaaaaaagataaagaaaaatgaaagactacattctagaaagttagaaatgctttgttagaaagaatacatttcagttagcatttctgtttctgttaaaaagaaagcatcaggctgggcgcagtggctcacacctgtaatcccaacaccttgggaggctgaggcgggcagatcacgaggtcaggagttggagaccagcctaaccaacgtggtgaaatgccgtctctactaaaaacacaaaaatttgccaggcatggtggtacacacctgtaatcccagctacttgggaggctgaggtaggagaattgcttgaacccaggaggcagaggttgcaatgagccgaagtcacgccactgcactccagcctgggcaacagagcgagactctgtctcaaaaaaaaaaaaaaaaaaaaaaaagcatctttaataccaatggcaaagaagtgagatggaacattttttgtctaagacataactaagtcaaaatctggtaagaaatgtcaatcttcatcatttaaaaatgtccctattacaaatgtactcatttgtaaataaagtaaagctaacagagtctgctaaatgaaatgtaaattggtaaggtcctttaagacaacaattttacaacatgtattccagaaacaaaaatactcattccttttttgactcagtaatttgggcttctagtcaaaagaaaataaaatctacataaaatactatatgcataaacatgttcatacacatgtccagcatagcttcagtttatattgaaaagttggaaataacataaatgtctagtgatagaatgtaaattgaacattttctggccactaaaaagcacctcaagctttccatttgggatgatttttcttctatctgaattatgtcccttagaatctccttctcttggtggtaaatgctcttaagtttttgtctgcaaatgtctttatttcgctgtcattcctgacagttttactgggtattccatttcaaagctgacagctattttctctcagaatattgaagacagcattccaatgtcctctggcttctgttgttgctgctgggaaatcagttgccagactaaagaaaaatgtttttatagcaatctgttgtttctagttgcttttaagaccctctgtctttagccttctgcaatttcactctgatttgtcagggtgattttatttatcctctttggaattcaatggacttctaccacttgaagattatcttttatcaattctgaaaaattcccagtgatttatatttgatcgttgtctcgccccctccattcatacttatttcctctgtaactccaattagatgtatgttacaactcttcactctaacccttatgtctcaacctttctttcatatgcatattgtctctttgagctgtctatggtgcattgtgggtaatctcttcaatgctatcttccagttcacacattctccctttagctgtgccaatctgtttcttcacttgctcactgagcttttgatttcagctaattttttataactagaagttctgtttttgtttacgtcctcatctgcttgatcatgttttggagatccttaattcctactattccaatctttcatttcttcaaacatattaacccaacttattggaatcactaatcactaaggaaaaaaataaattttctacagtttctataggtcactgtttcttgtttctgctggatcttgctcactgtgtcacagtttttgtgtgatttgtgatttttttactgtgatgtcatgtgccttgaaattttaatctacagaattctgaagcctgggttgaaggtacatttcctcctaagaggatatgatttgacagactttgcaaggcacccacaggcactaccaaactgagaccactttaaatacacttctgacttggaggtttttcaagaccacatgagaaatgtgactgtaacaatctttgttataaattctctgtgaagatgttcatctccatacatcccctccccactgccaaggtagaagcgtcctactctctgctttatgaaggggaggagccttctttcaggcccctttccttgctaaggccccaagctttctttcctgtgacccatgagtctaccaaaagggaagttcaaagccatccagtgtggacagattccaccagacctgctttaaaggtagctaatttctgcattcttcatttttagcctggtgctaaccaataatgtattttaaaagaaactttttttttttttttttgagacggagtttcactctcatcacccaggctggagtgtaatggtgcgatcttggctcactacaacctccacttcagggttcaagcgattctcctgtctcagcctcccaagtggctgggattacaggcgcctgccaccacaccgggctaatttttctatttttagtaaagacagggtttcaccatgttggccaggctggtcctgacctcctgacctcaggtgatccacccgccttggcctcccaaagtgcagggattacaggagtgagccaccacacttggcctaaaaaatgttttttaaatacatacattcttcagcactttttttctcagcagcagggttactcatgttatcactctacattacccttactgcaagaaatggaagtgctaactctactcttaatgtctctcatttgttttctcttctgtactactgtctctaaggcaaatccttaatacttacctcaattacttcaataggctactaactgatcattattccattttctaccttgctgcagagggtatctcccaaaatacaagtctcattatatcatccctctgtttaaaatcacttcatggcagccaggcacggaggctcacgcctataatcccagcactttgggaggccaaggtgggcagatcacgaggttaggagttcaagaccagcctggccaagatggtgaaaccccatctctactaaaaatacaaaaattagccaagcatgtgagcacacacctgtaatcccagctactcaggaggctgaggcaggagaatctcttgaacctgggaggcggaggttgcagtgagctgagattacaccactgcactccagcctgggcaacggagcaagactccatctcaaaaaaaaaaaaaatcccttaatggctttcttctgctgcctgcagtataaattcaagtctttatgatctggaaagccctttgtgatcaggcctcagcttatttctctggctttgcctttcttcttcctcatcctacacagtttactatagtcaaactaaattacatgcttagaatgcccttatcctccccatcgtcccctcatctagttcatgcatgctgaaatcaaccgaaatgttactctgttgatctgtgcactagcctacctgcccgttcccatccctgtgataatgttctattatatccatggatatactactagtaaatgctggttccttttctggctcccccaaaagaatagaaggttcttgaacagaggaactggttttcttgccttggtatctcccagcacctggcatcacactttgcttgcatgtgatcaatgtctgataaacttagtgatatctcatagtactttaactcattagctacatactagagagagggagtaggccttagtcaaaaccactggcaacccttttataacaatttaattttgcactttgtgcatatacttatgttttaaaattaatttataaagcagtacagttatgctgtggaaataaatagcaaatggatacgctggattcatggatttaagataaatttaaagagaagtgaaaataacaggcttcaaaaaactagcagatggccgagcacagtggctcacatctgtaatcccagcactttgagagaccaaggcaggcagatcacctgaggtcaggagttcgagtccacctgaccaatatggtgaaaccccttctctattaaaaatatgaaaattagccggacgtggtggcaggcgcctgtaatcccagctactcgggaggctgagacaggagaatcgcttaacctgggaggcggaggttgcagtgagccaagatcgtgccattgcactccagcctggggcacaagagtgagacttcgtctcaaaaaacaaacaaactagcagatgacatggagtagctatagccttttctgatagctgataaagatatatatttaaggtgcaaatgaaaacaaccaaataaactcatttcataaaatatgactgaaaaaaggcggccggccaggtgcggtggctcatgcctgtaaacctggcactttgggaggctgaggtaggtggatcatttgagctcaggagttcgagaccagcctggccaacagggtgaaaccccgtcttctactaaaaatacaaaatcagccaggcgtggtggcaggtgcctaatagctcccagctattagggaggctgaggcaggaaaattgcttgaatccaggaggcggaggttacagtgagctgagatcacaccactgcactccagtttgggtgacagagcgagactttgtctcaaaaaaaaaaaaaaaaaaagaaaaaagaaaaaagcatgaatatacaacgtgtgtaataatgttaaatcaataaatattaccaaagaaagcacctgatcatttcacttaaatctctagaaacgcaaatagttgacggtcaactgttttttttagtaccagcttatacccattaaaaaggctactattaaaaaacaaaaaataacaagtgtgggtgagcatgtggagaaactggaaccaccatgcactcttgatgggaatataaaatggtacaacgagggtggaaaactatggagattcctcaaaaagctaacaacagaatatgatccagtaatttcacttctggagatatacccagagaactgaaagcagggtctcaaaaatatatttatatgcccactttcataatagcattattcacagtaggtaaaacatggaagccacccaagtatacatcaacacatgaatggataaacaaaagtagtatattcatacaatggaatctcatggagccttgaaaaagaaggaaattcggacatgaatgaaccttgaggacattatgctaagtgaaataagccagtcacaaaattacaaacgccatatgattctacttatgtgagacatttagagcactaaaaatcgagtcagaaagtagaatgatggttgccaggggctggaggaaggtagaatgaggaacagggagttcttgtttaatgggtatagagtttcagttttacaaaacaaagagttatagagagggacggtggtaatggttacacattattaatgtatttaataccactgaactgtaccctgaaaaatggttaaaatgggccaagcacggtggctcatggctgtaattcagcactttgggaggccgacgtgggcggatcacttgaggtcagttagagaccagcctggccaacatggtgaaaccccgtctccactaaaaatacaaaaattagccaggtgtggtggtgggcacccgtaatcccagctactgggcaggctgagggaggagaaccgcttgaacccaggaggcagaggttgcagtgagccgaggttgctccattgcacttcagcctgggcaacaagagcgaaactctgtctcaaaaaaaaggttaaaatgataaattttgttatatacgtgttaatacaatttaaaaaattgaaaaaacaaacaccctttttgggaaatttagagaaaatcgcctttcatttggggtctgccttttatctaggtatatatggtaatttaagttacacagaaccagggaggtttttcctttaaaagagcttcatacattactcaaatttgagaaacattcttagacccttctttctcccccgagtgaacatcccatcagttaaccaaagagagctatagttccttctagttaataccactcctaaccaaccttttctatgtccactgctacagtcttagttcaagccctcaacatctcttacatgaattactgtatctcacacctcatggccccctttgatatagtcatccctccagtatccatggggcactggttccatgactgtccaaggataccaaaatttgagaatgctcaagttcttcatataaaatggtacagtatttgcaaacaatctatactttaaatcatctctagattacttatagcacctaatacaatgtaaatgctattacattgtacctaatacaacgtaaacagttgttatactatagagaataatgacaaacagaaaagtctctacgtgttcagtagagatggaacaatgttttctttttccctgaatattttgtttcttttttgctggagtgcagtggtacgatctccgctcactgcaacctctgcctcccaggttcaagtgattctcctgcctcagcctcccaggtagctgttctgttgccaccaccatacctggctaatttttgtatgtttagtagagacagggtttcaccatgttggccaggctggtcttgaactcctgacctcaggtgatccgcctgccttggcctcccaaagtgctgagattatttacaggcatacgccactgcacccggccttttccctgaatattttcaatacgcaggctaaattcaccaatacggaacccatgaatatggagggccagatgtaccttcgacacagcaaaataatgtaagttcaattgtctgtcttcctatttcaacagttctgtattgctgattgaaaaagttttaatccatctcaagctgcatacaagatttgttccttacccctcccatgttatatccctctactctcatctcacctctgtaccattcccttcagccacatggacctaccggcatcatctaggcagttcccttggtaggactttataaaaccctatctttgcatgatttggatagtggttgggacaacaaaccaaacacccacctttctgttacgttctgaacatttcctctgcctcctcactctgaagcaggaacaaatatatacttttccattgagtcataatctttacccttgtctctgctagctgctctgtctctcagactttaaaagctcactcaactagcgcagatctcacttttctcatcccagttacattcttcctaagttctcagtggagctgaaccaaaagttaagttgtagtatatacaaatttaacattctaaccaacagaaaacactttaaaaaatgaaatatcaaaacaaaaacacaaatgcaactttttgaaggaaaggaaaagttctaatatccccacagccaaccttatgtaactaaatacaaattcttggggcaaaaacagcacaaatttgataaacaatttcaagacacatatgctaccatattcttactcataaaacctgaggctttgtttcagtgtttccctaatatttgtacattgcctccagttacattgtgttgtattatcatacttcttttttttttttttttttgagacagagtctcgttctgttgccaggctgaaaagcagtggtgcgaatcttggctccctgcaacctccacctcctgggttcaagtgattctcccgcctcagcctcccgaggagctgggacaataggcgcacgccaccactcccagctaatttttgtatttttagtagagacgggatttcaccatgttggctaggatggtctcgatctcctgaccttgtgatccgcctgcctcagcctcccaaagtgctgggattacaggcgtgagccaccgcacccagccatattatcatacttcttgaatgctggactatacaagttcagcaggctgggtgcggtggctcacacctgtaatcccagcactttcggaggccgagacaggtggtcacgaggtcaggagctcaagaccatcctggccaacatggtgaaatcccgtctctactaaaaaataaaaaataaaaaaattagctgggcatggtggcgcgtgcctgtaatcccaactactcgggaggctgaggtaggaaaatcgcttgaaccagggagtcaaaggttgcagtgagccaagattgtgccactgcactccagcctggtgacagagcgagacttcatctcaaaaaaaaaaaaagttcagtgactactgtgctctaccattttaatttagacagcagctaaaaattaaaggtttcttacaggaagactactttcggctgcttgttctagcagagatgcacaatctgttaacatctgcgtcccaatgaaccctaaaactagcttctcaatgtatggaccaaactttcttttcagagaattaagtggccaagttcacactattttggctcttgtctaagtgctcacaccgcattacagcaccacaaaaaagcagaaagaacatgttgatggtgaagtgaaactcacttctgccataacagcaaccaatgctggctactttcattcacaaacttatctggtcataggaaattcaacttacaccgggtgcggtggctcacgcctgtaatcccagcactgtgggaggctgagcggggggcggatcacctgaggccaggagttcaagaccagcctggccaacatggtggaactccatctctacaaaaattacccgggcacgatggtgggtgcgtgtaatcccagctactcgggaggctgaggcgggagaattacttgaacccaggaggcagaggttgcagtgagctgaaattgcgccactgcactcctgcctgggcgattgagcaagactctgtctcaaaaataaaaaaaaaaggaaaaaggaaattcaacttaaaaatgccactgcatacaaatattgttgccaccctttctaccacccttcatctaccagaactccaatgccactgccaggggaaccatttagagaatttgtgggttctgatgagaatcagaacttgtgaagtcaatcctcaagcaagcaggcctgtcaacattttagtctgcctagcccaagtcttttcctaagtgcagtttttttccacgttattatgctacctaaaatacttccaattcagagattaatttgggtaaacaaacattctatttaaaaatatgaagacttactagagttaaggatgtatcaatcatttcataacataaattaattcaatcatattgccttctcttaaaagctagtaacaatacatttagagtcgatatacagaggaaaagggtgttgatttagaagaagagggatgtaagtagctttagtgtcacaagtgcctttttggggagaggtaagaaaggcctgcagtaccacgtgagggcaacttagggcaggaaaagacactgaacacctggagccacagacacagcaagaagttaaaataaatgtacacacaggcgcggcggctcacgcctgtaatcccagaactttggggggccgaggcgggcggatcacaaggtcaggagatcgagaccatcctggctaacacggtgaaaccccgtctctactaaaaatacaaaaaattagccgggcgtggtggcgggcgcttgtagtcccagctgctggggaggctgaggcaggagaatggcgtgaacccggcagcggagcttgcagtgagccgagatcgcgcgactgcactccagcctgggagacagagcgagactccatctcgaaaactaaataaataaatcaaataaataaataaatgtataaaaacctttgcctccgccctgtcttatgcccagtaacaaagagaaaatattcttcaaattcccttctgtactcatgctaaggagcacagaagatatgatttaataagagcctgggaactactcagctaaacctgggttcgaccttctacttctgtcattcactagtgtgactctgagtaagatactaatttctctaggcatcagtttcctcagttataaaatggggatttatcaacttcatgaagtgctaccatgaattaaaagaattcagctgggcgtggtggctcacactgtaatcccaacactttggaaggccgaggcagacggactgcttgagctcacaagtttgagaccagtctgggcaaaatggttaaaaaaaaaaaaaaaaaaaaaaaaaaaaaaaaaccatctctacaaaaaagattagccaggcgtggtggcacatgcctgtagtcccagctactcaggaggctgaggtggaaggattgcttaagtccaggagttttgaggctgctgtgagctatgatcataccactccaacctgggtgacagagcaaaatcctgtctctaaaaaaaaaaaagaaaagaaaattcacattaaagaacttgggatacctcttaattagcagttagctattaataaagactggccaggcacagtggttcacttgaagtcaggaattcaagaccagcctgaccaacatgtgaaaccctgtctctactaaaaatacaaaattagctgggcgtgatggtgggagcctgtaatcccagctactcgggaggctggggtgggagaatcgctggaacccaggaggcagaggttgctgtgggccgagatcacgccactgcactccagcctgggcgacagcaagactccattgaaagaaagaaaggaagaaaagaaggaaggagggagggagggaaggagggaaagagagaaggaaggaatgacggaatgacggacagatagtcccaagtttacagtactctatacgtaaatgacatggaagtataaagtgtgaatatatatagcttatggagaaatacatttttgacagtaaacaggcagagaaagacatctcagttttctttttctcactcatctgatgctatgaacatgtgtctcattcaagttgaacactcatttttttaaaagcagtacaatgaagacagcaaaaacctattacactagaaaaaagtgaatggtatgcatagagaacaacatgatacacgaaagggatctgcttcaaagacatctataacagcactccagtgtgactgagaagcactgagaggtgatagggaggcagtagaaaactaaatacaagtacagtatgtatgtattctagaatttctaaagattcacaggtctatagagctaaacattaaaacagaaaggattctacagagaatgacattacgacacaacaaataaaaccatagtaacggaagtaacaactgtaatattttggggcacatgatgtcaacactcagggtccagagttagaggatagggaaagactactttgccatcctatctacaatcttcacacaatcatttaatgcgagaacctaacctttagggagcatattcctgagatggtgctaccataccactggtaacaatctgaggtcgagcgcggtggctcacgcctgtaatcccagcactttgggaggccgatgtgggtggatcacttgaggccaggagttggagaccagcctggcccacatggtgaaaccccatctctactaaaaataaccaaaattagctgggcctggtggcgggcgtccacctactagggacgtcccagctactagggaggccgaggtggaagaatcacttgaacccagaaggcgtaggttgcagtgagccaagatcacgccactgcactgcactctgttgcctgggcaacagagcaagaccctgtctctaaataaattaaataaataaataaataaataaataaataaacaatgtgacaggatgacttccatctttggagtctgtcaggatagtgaactgcaagagcgttccaaagaaagtaccactacacatgcagattttttaaaaggaagcacatgctaaatcttggttaagtctgaacaaagccagtgctagaaagaagcccatgaagcaaagtataccatccactttcttaaacaaagccaagctaagccatctgttcccgtatcatcagttgttcttagcgtatcacttagtgaatcatttcagaaacaggagctaactgaaagataattaaaggttccagtggttcttagtgtcgaagcactagaggcattcagtaacatgagagaccatttttggtgtttcatgcctggggagtcggggatactactggcatttcatggagagaggccaggggtgatgtggtggactgaaaaacgtcctccaaaagactactcgaaccttcatttcagacttccggcctccagaaccatcacagaataaatctgtgttaaaccactcaatttgcggtaatttgtcagcagtcaaaggcaactaaaagtattaaacttctggaatggatagaacagtcctactgtaattgccaataacactaccactgagctacacagaggaatatgaagaagtgaaggttaactgaaagggaagaggaaaagtaaggagggctaaatgatgtaagtgagggaacagtgataaacaagtttagtgaagttacacattttacccacattttacctatgcacccaagagggacttaacaatttctgatggatcagctgtaaagaatttggacttctatcttactacagttagaagaacatacctttttttttaagggggggctaataaaacaagtttgacaagtttacgatttaaactatttgcaaacttgttaaaaatgggctttttgggactgggtgcagtgtctcatatctgtaatcccagcactttgggaggccaaggtgggtggatcacctgaagtcagaagtttgagaccagctaacaccgcgaaaccccgtctctactgtaagtacaaacaaaattagccaggcatggtgatgcgtgcctgtaaccccagctactgaggagtctgaggcagaagaatcgtttgaccccgggaggtggaggttgcagtgagccaagattgcgccattgcactccagcctgggtgacagagcgagactccatctcaaaaaaaaaaaaaaattaaattaaattaaaaaacggacttattttgaggctccgatattgtaggcagcagcagggtggcttaatctaatccagtcatctatactccatgacaggagtcctactttgtttctcaccacatgaacccccttctaaaacatcctttatctgtccttctctccatctgttttacacttgctactgaatggcaccaaacggccttccttaacccagctgtggcacacaacttatgatggccattttcatgctgctatctcctagtttatactctaatgcacattgtctacactactctcagtgccaaaagacggacagtgatcatctcttcactaccatccagaaaccaaagtatagcagtcacagagacttttaaaaacaatcatcatcatccctctatagaaatgatagggacaagaggttacttttcggttccacattttccccagcaatgataccaaagtaagctaaactatttgccaaggatatgggagtggatgacagttgtgagaaataagctgaaattttaacctcagtctctaatcctggagtttttaagctttcaaatatcgaaaacatttttaaatgcataccagaaaaaactgagtacagagaaatcgaattactaagttaggggacagataaggcaaacattcattagttcacaaaaggaaccaatggtgcaggaagtagtgctaatggtgggaaatgcatgcgcccaggagccaagatgccagagttccaggccctgttctgccatcacctaggccagtactacccaaatggtagtccttagaccagctatctcttactagtctgtgacaagataaaaatacaaattccagtggaagcattcagaaacgtttacagcaatttgagagagtaattttatgtctgttgaatctcataattaaaagttggggcttgaaagatttatggatagtggccgggtgtggtggctcatgcccataatcccagcactttgggaggctgaggcaggtggattacaaggtcaggagattgagaccatcctggccaacatggtgaaacccccccccagtctctagtaaaaatacaaaaaattagctgggtgtggtggcaggcgcctgtagtcccagctacttgggaggctgaggcaggagaacagcttgaaactgggaggtggaggttgcagtgagccaagatcgcaccactgcactccaccctggcaacaaagcgagactccatctcaaaccaaaaaaaaaaaagatttatagatggtaagttattacatgaaaaatgccccaaatcattagtcacctgagaaatgcaaattaagaccacaatgacataccattacacacttattgaaatggctttaaaaaaaacaatggccaggcacggtagctcacgcctgtaatcccaacactttgggaggttgaggcgggcagatcacttgaggccaggagttcaagaccagactggccaatgtggtgaaaccctagtctctagtaaaaatacaaaaattatccaggcaaggtggtgcacgcctgtagtcccagctacttgggagggtgaggcaggagaatcgcttgaacccaggagacagaggctgcaataaatcaagatcacaccactgcactccagcctgggtgacagggtgagactccatctcaaaaacaaaaaacaaaaaagcccaggcgtggaggctcacacctgtaaccccagcactgtgggagaccaaggcaggagtttgagaccaacctaggcagcacagggagacctcatctatacagaaaattaaaaattagctgggcatggtggtgtgtgcctgtagtcccagctactcaggaggctgaggcaggaggattattgaccccaggagcttgaggctgcagtgagctatgataacacggctgcactccaccaggggcaagagaatgagatcttgtctcaaaagaaaaaaaaaaaagacaattaaaaataccaaatgatggaaagaatgcagaacaactggaactctcttttattactattttttaatacagatgtgggggtctctctttgttgtccaggttggcgtcaaattcctggcctagagcaatcctcccgcatcagcctctcaaagccactatactttccaaagtgactttggaaagtcactataccagaaagtcacaaattatttgtcagcttcttagaaagttaatataactattattatatgatccaataaacacactcctaggtatttatcaaaagatattcacacacttgtacacgactgtttttggcagctttatttataatgtccccaaactggaaagtgtccttcatttgataaatgcataaacaaaccacagtacaaccatacaatggtatactattccccaataaataggaaggaactactaaccatgacaacatgaatgaatctcaaacacaatagtttaagagcaagaagccagactcaaaaggttacatattgtgattacacttacatgacattctggaaaacaggagactaaaaacagactaggctatgggcagcccagcccgccaagtcctcgcctggctgcatgccagcctgatcaagccataaccagaggacacaacagcccaacctagcggggccagtcaccacctggtctggggatcatctctaccacaagcggctgaggcacagctgccctggggagggcggaaggccaggcatgtgggctaaactggcaggtcaccgcaacatgtaagtgtttccacgccagcaaacatttactgagtatctaccacgtataagaacattggcaacaagccctccaacaagccggtccctgagaggagcatgtggacagtgcctgtgtgggccaatggaccctctgtggagctggccccctcatccgctccagattgtggcctggccactgtgcctcttttcttggctgtgatggggcttggggtacttgttcccctcctgcctgaccattaggtgccagctggcttcactgtatccttgggaaactgtggagctgggtcatggaagagtggggacatggcagaggcctgaaactcagctcagagcctcagggagcataaggtggggcatagcaggacaatcccagtcttggagacaagttgcttatctgcctggcctccaacccccatctgacttatccacttgacaaggtgagtggataaacccaaagtaccttggggcacttaaagtcctgcatggatgtgaattttatcaactctaagattctgaagcaccacagggacagaagagagccatcttgaagctaattgtgttagctaaacaaaggactaattagagactaattattccatttacaaaataatttttcactttttttttttttttttttgagacagagtcacactctcttgcccaggctggagtgcagtggcaagatcttggctctctgcaacctctgactcccgggttccagcgattcacctgcctcagcctcccgagtagctgggattacaggtgcccaccaccatgcccggctcattttttgtatttttagtggagacagggtttcaccatattggccaggctggtctcaaactcctgatctcatgtgatccacctgcctcaacctcccaaagtgctgggattacaggcatgagccaccacacgtggccactcctgatgctttaagtgccatgatactctcctggttttcctcctacatctttggtttttcctgagtcttctctgcactttcttctttgcagtcccccggatgttggtgttccttcagcattgtgtcctggagtctactatttcccacactacactccctcctgcaagatgccatcctttctcttttcctaatttttttttttttttttttttttttttaagagacaaggtctctctctgtcacccaggctggagtatagcagcaggagcatagttcactgcagcctcaaagttctgggttcaagcaatcttcccaagtcaaccaggattacaggtgcacaccaccaggcccagttaatttttttttactttttgtagaaacaggctctttgctatgttgcccaagctggtcttgaatttctggcctcaagcaatccttccaccttggcattccaaagtgctgggattaccggtgtgagccactaggcctcgcctcatccatttttataacctttttttttttttttttttgagacagagtctcgctgtcgcccaggctggagtgcaatggcgtgatctcagctcactgcaacctccgccttccaggttcaagcaattctcctgcctcagcctcctgagtagctgggattacaggcacacaccaccatgcccggctagttttgtatttttagtagagacggggtttcaccatgttggtcaggctggtctcaaactcctgacctcaggtgatccactcgcctcggcctcccaaagtgctgggattccaggtgtgaaccaccgcacctagccccatttttataactttaactgccatgaatatgacagatttctcactcttctttctagacccaaatattcatctgcttcaacagctccatctggaagtcctattagcagcaccttaacttatccaaaactgagctaaccatcttctccccacacctttctgctattccataccttcataaatagcactgttacatacctaggtgtccaaaacagaatcctaaacttcattttgactctgatttcttcccataccttttggagtccacttctccgccactaacttttttcaggacaccactatctttcttgggttaatataacagccttctactgatctctgtgcctatctcttctccattatagccaagtaactctttctttaaaaaaaaaaaaaaggtcaaatcagatgtaactccttttttaataaataaaattttaatacattttgtagagatggggtctcactatgttgcctaggctgatctcaagctccaggcctcccacctcagcctcccaaagtgcgggaattataggtgtgagccacagtgcccagtctcactcctctaattaaaacccttgactccccactattctcagaataaagacaagattttttttaacatggcttataaggcccaacccaatctcccatttatctcttgaggtccatttattgcactagctgtgctttactcatttggaattatcaattccctaaaccgattgtctcccctctctcatctctgtctgtatacatgtctgcccaattcccctccaagtctctgcatgtttctcctgcaagaaacatcttccagattttagataaaaaagtatttattctgggaaggttttcttgacctccctcttttgtgctccagtattagctccttaccattctctcactgtattctaatacctattcgtgtgtctctattcctgttaacctttaagctttctgaggacagacaccacgccttgctcacagttgtatccttaagatgtgaaccatgcctggcacgtagcagtctaccaataaatgaatctactagtaagattccattcgcaactcaaaattacctcccttaaatttctgaaacttcagccaggcatggtggctcaagcctgtaatcccagcgctttgggaggctgaggtgggtggatcacctgaggtcaagagtttgagaccagcctcgccaacaagatgaaaccccatctccattaaaaatacaaaaaatttagctgggtgtcgtgacgcgcatctgtggtcccagctgctcaggaggctgaggcaggagaatcacttgaaccggggaggcggaggttgcaatgagccaagatcacagcactgcactccagcctgggtgacaggataagacttcgtctcaaaaaaaaaaaaaaaaagaaattctgaaatgtattccctattgaaactattcttaaaattcctgaagttttctcttaacatctataatactgtgaccacctttccagacacagagaacttaatcatagtttaatattaacccaagagaaaggaaatgttctgtacaaaagcatatgaatgaggccaggcgcggtggttcacaccggtaatcccagcactttgggaggtcgaagcaggaggatcacctgaggtcgggagttcgagaccagcctgaccaaaatggagaaaccccgtctctactaaaaatacaaaatgagccgggcgtggtggcgcatgcctgtaatcccagctactcaggaggctgagacaggagaatcgcttgaacccgggaggtggaggctgcagtgagccaagatcgtacctttgcactccagcctgggccacagagtgagactctgtctcaaaaaaaaaaaaaagaacatgaatggaaattggccataaagttaaataccacaaacatgacagcccctaatttttataataaatatgcactcatcaaccatctgaaagattaaggtctcttctacaactgaggttctataattttctcaagtatgttattgccgctatgcacaaagctctatgaatttccgtaccagtaacctcttgtactcttcttagcctccactttctatgccctcacatttgtccttagactgctagcttatttttcacctgttctatagtgtctatgtatccctcaccttcactccatgaattattctgattacacatgtgcaccagtgtatatgtgtagtggatgtcagcccaaagttggtgctaatggaatactgccatggctcaaaacatttttacttttatttactttttctttttttgagacagggtctcgctctgtgctcgcttcagcagcacatatactaaaattggagacagagtctcgctctgtcgcccaggctggagtgcagtggctggatctcggctcactgcaacctccgtctcctgggttcacgagattctcctgcctcagcctcctgggtagctgggactacaggcgtgcaccaccatgctcagctaatttttgtatttttcggagagacagggtttcaccaggttggccagactggtctgaagctcctgacctccggtgatccacccgccttggcctcccaaagtgcctgggattacaggcgtgagccaccgcacctggcttcaaaacatttttaaaaattgctctttcagaatagatccagctgcatatttttccttcatgttttgagaattgatatgacttctgagttttcaacagtaattcaaagccatgtatgataaatatcagaggagatcaaacagtagtattgtaaaatgtggaatgactataaaagtaacaagactggttttcttatgtagctttaaatgacacagaaagcatcagtggggccggttgcagtggctcacgcccataataccagcactttgggaggctgaggagggcagatcacttgaggtcagtttgagaccagcttgcccaacatggtgaaactccatctctactaaaaatacaaaaatcagacgggcatggtggcttgagcctgtaatcccagctactgcggaggctgaagcaggagaactgcttgaacccaggaggcggagacagcagtgagccgaaatcatgccactgcactccagcctgggtgacggagtgaaattctgtcgaaaacaaaaacaaaaacaaaaacaaacaaaaagcaagcatcaatggtaaaccatactgtatacagcttctcagtgtggttacttcaaaggtcatcacttctcttggctacctgcttatcagtctgaccatgcaaaaaaggtttgtagcataatgttaagtgaaaatttcagaaccgtgtattttagctgggcatggtggcacatgcctgtagtcttaactgctctggaggctgaggcaggagaatcacttgagcccaggcggtaaggatgcagcaagctataattgtgccactgtactccagcctgggtgacagaacaagaccgtctttaaaaaaaaaaaaagaaaaagaaatctcagaaattgtatatactatgatccacaatgtaaaaataagcatataaacaagaagtggaagataatatgtaaaataaatattgctgttgtgagaaggagaattagttcttttcccttttatcaaaattatttcggccaggtgcagtgtcccacgcctgtaatcccagcactttgggaggccaaggtgggtggattgcttgagcccaggagttcaagaccagcctgcacaacaaagtgagaccccatctccacaaaaaataaagaaagttaccctagaggctgcagtgagccgtgatcacaccactgcactctagtctgggtggcagtgtgagacccagtccgtctcaaaaaaaaaaaaaaaagtttttatgatattgtctttttaataatcttttttaatcagccattactgaaccaggcacagtgatgtgcacctgtagccccagttactgggagggctgaggcaagaggatggctgagcccagaaactggagaacagcttgggcaacaaagagaggagacctccatctcttaaaaaaaaaaaaaaaaaatcaaaaatccgtcattaggccaggcgcggtggctcacacgtgtaatcccagcactttgggaggccgaggcaggcggatcacgaggtcaggagatcgagaccatcccagataacacggtgaaaccccgtctctactaaaaatacaaaaaattagccaggcgtggtggcaggcgcctgtggtcccagctacttgggaggctgaggcacgagaatggtgtgaacctgggaggcagagcttgcagtgagccaacatcacgccactgcactccagcctgggtgacagagcgagactccgtctcaaaaaaaaaaaaaacatcagtcattatttcatactcactgaatcagagagagatctgttctattcagtaagaaataagacttttctaaaatctttcaattttccgttctatttctaaatgccaaaaaaagataagactcacatttatttttattttttctttttcttttttttgctcctgcctaaaaagtaaggactcacatttttgatgatgcatttgtttttacaagaatattgagcttccaagtaaaacctttgtgaaatcagagcataagctattaaggtcactaaaataaatataaaataccttttaattataaacactacgattaaaacgtatgtggagagaaccccaaaaaaattttaagacatgtaaaaaaggcaaaaagaaatcaatcatgtgtttctaacggttaatcactatcttgtaaaaagaatcccaaaaattatcaatagaaattcacaatatttgaagaacactcaaaggtattttcgctctgtagatctccagataccactgtctactgattgagggactccaacttgatccagcaatcaagctacgtagacgaacagaaacagaattaaagcaattaagtgagtcaattcaactcaccacacttcggtttttgtgtgtacctaataaaaatgttgcaacagaagaagtaatgtggcgttaaaccaatcagagtttgggaagagtagtaattagcataagaaactgaaaattaattaagtggcttttagggccaggcgcggtggctcacgcctgtaatcctagcactttgggaggctgaggtgagtggatcatttgaggacaggagttcaagaccagccaggccaacatgatgaaaccccgcctctactaaaaatacaaaaattagccgggcctggtgacaggcgcttgtagtcccagctactcgggaggctgagacaggagaatcgcttgaacccgggaggtggaggttgcagtgagccaagatcgtgcctgggagatctgcactccaacctgggcaacacagcgagactgtctcaaaataataataataataataataataagtggctttttttttctttttgagaaatgatcttgctctgttgccagggatggagcgcagtggtatgatctactcaccgcagccttgaactcctaggctcaagcaatcctcccacctcagcctccccagtagctgggactacatgtcggtgccactacatccagctcattttcttatttctgtagagatggggcctcactatgttttgcccaggctggtctgcaactcctcgccccatgtgaatctccagcctccgtctcccaaactgctaggattacaggcgtgagacaccgcgccaggcccaagtggcatcataaaccatctctaggaaatctaaaggattaataatgatattcacttctctatcagattcactgcaaagatttttctatataagcataatgcagcaacactaacttatatacacaataatcttctccatagcaatgatttgtcagacattaggaaatcctttacatatttaatataataatccaatcctttatatcttcaataatccaatcacaaagttcaaaaatattaagagaagttatcatgcaactcctcaccccaattttattgcaaattttactttactttgacctgatgttccatgcccacaagctagataacaatgcgtcaaatatctcgttatcattgcaaagcaaaaaaataaaacttgctttaatataaaacggtaactagtatacaacctgtagtagttaaaacaatataaaattttacttaaccagatattgcacgttaaactctaggaacattaacagtggaaacattctccgcatctaacaaattacgagataaagtatagatccgttgagagggaactaacattctgacctccttccaaaacgacaaactagaacggcaaaattacactcaggcacattggagtactcttctctcaaatcactccacagagaacttcatcatttgctccgccctctaataactcatgcaagaaaagttcagcaccatcagagagaaacaagacagagagaattcatagaatggctttagggcctttcctccaggcggtaagaggatctgcgtgtgtccttcgcaggggtccaaagggagagaacctaggcctagggtttcggggataccgacacccagaaacagattttctctcaaagaagtttctgccgccatccctatcttatcagcaggaggccccggcgccatcgtctccgtctttatgattttattatggggaggtgggaaacgccaccctggattcttccaggcctcccctattcagcttgggggttccccctcattcttccctcaaagcctcagtccctgaggtcctcctcagcaccccccgcttctggcggcctgtcccccgtgaagtgtaaaggcacggccgaacccaccggccttgccgtgaaggcgggagggcccgaacccgccagggccacggcgatggctccgaggggcccagaaaggggaagggcaggccggggaccggggcagaatgacctggccggggaagaaaggaaaaaaggaggtgaggagatgcaccgcaccgcagggctgcacagagaagggaagatgatgaaggaggaggaggagggcggtggcccgggtgcggccccctactcctcccgcccccgggtccccgggccggcgggggcggacggactcggcccattcccaggtctgggctggcggggggttgggggatctccctccacgctactaggagacagagaacgagggtatcgggagcgggggggggctgtctcccgcctgaacccggagaccccgacgccgtcgtcgcctcttcctcaggagggaggacggcagctgtgggtaaagcccgaaggaggaatgcctgaaggtaaggggaagcccggggcagacccgctgcccgctccggaccccactctccaccttccggtaaccgcgtctcttaccggtaatggtggtgaactgttgaattaaccccttcagcgccgaggacgccgcggagcccccgtgggcagccatcttaccgccgccgccgccgccgaacaacaacacagacacacacggactgccctcccccacttcgccgtgcggtgtgcgcaggcgcattgaccgcccctcgagccccgcccctcccgtccccagcggtctgcgcaggcgcattttccgaccgggcccgcgcgctcccagctctcgggttggctgctcggttgctgcctgctcagtgcatcctttttgccattgctggtgccttcctctccgggctccaaggctagcctcgcaggcgcggtgtcgattcctagattccgaaggaagcttcggtctcggcagatagttcttcgcatttcagcttcgcaagctttattgacagagccaactgccgatgacagcatttttctgttttgcggttgtaccgcactctattaggtttcctgcaggtcccatcaaaatgcaaaccctacctcctcgctttgaagcgactctccccgtactcgccccccagcctctaaactaatggcttagctaaccgattgcgacgagtgaaataccagaacccttcatgccaaagaaagcacttagcgcggggttgccacccagtaggttttcataaacgattgtttagtctgctttccttaaataaattggccatcacgtctcccgttagggtcttaatgagaccccaagaggcgtcatttgtataaaaagaaactctgtatatgcagtagaggaaagaaaacatatagaaaggagactggaaaagtgtgctcaaaacgctggtaacggttacctccagagaagagaacgatcgggacgatggtcaaagcggaccttacttcgagtttcttatttatctttttatttttaaacaaacattattggccgggcgcggtggctcatgactgtaatcccagcactttggaaggccgaggtgggagaatcgcttgaggcaaggagttcgagaccagactgggaaatatatcaagaatccatctcaaaaaaaaaaaaaaaaaaaagatattcgtgtgttccttgaataattttaagtattttgcaaaacagttacatgagtggggtgcgctcaaatccaataatcccccaccttgcccataaagttaaaagagattccaagtgattccgtttgttttagcctcccaccttccaacctccacccacatattttgcatcttcataggaaaatggcccaataaaagatgggatgagctgtctgaagaattgacacatcctaagagtaaacatgctattggggagaattaagaaagagccatgtcaaatcaaggggtatagttttttgttttgttttgtttgacagggagtctcgctctgtcgcccaggctggagtgcagtggtgcaatctcagtttactgaaagctccgcctcccgggttcaagcgattctcctgcctcagcctcccaagtagctgggattacaggcacacgccaccacgcctggctaatttttgtatttttaatagagacgaggtttcaccatgttgagcaggctagtctcaaactactgacctcaagtgatccacccgcctcggcctcccaaagtgttgggattacaggcgtgagccaccacacccagtcgggctgtagtttcaagaagatatgattgatgtaaaagaaagcagactccagtaatcccagcactttgggaggccgaggcgggcggatcgcccgaggtcaggagttccagaccagcctggtcaacatggcgaaaccccatctctactaaaaatacaaaaattagctgctgtggtggcgcgggcacctgtaatcccagctacttgggaggctgaggcaggagaatcacttgaacccgggaggcagaggttgcagtgagccgagatcatgccactgtgctccagcctgggtgacagagcaagactccgtctcaaaaaaaaaaatgtattttaagttaaatgacagattggtcctggcactgccttccaggttgctgcagttctctagatgggctgaggaagggcagggatcagtcataaatttcggcagctgattccttcacatttgatgcagaggtgcaaaaacaggcaagggaagaaagccaaatcaagaaagtgttacctctgtctcccttcatcctaaaggctgagtcactagccagccatgcaaaatcaagctccacgtaaaatggtataacaccattaactacaaaaactaaacacagtgattactgtacctccatcagatggagaggccagtaatgagctctgcaggtttatcaggtttatttccaaaatcttataattcagatttaatgatatgattttgattaacagtgcaggaaaaggtgataaagtctgtggcatccacaactccagaaggcatttttttagaaattaaaaaataagataaaagaaaattagacaggtggccaaaaagattccatggtcggggggagggggggaaagaagggaagaaaatgagacagtttccatggataaccagggaactgggaaaaataaataaagaagtaatgaataatacaaccttgaaaagcttttttggattattaaagaatatgaaggactgaccagttgcggtggctcacacctgtaatcccagcactttgggaggccgaggctggggatcacctgaggtcaggagctccaaacccgcctgaccaacatggtgaaacaccatctttactaaaaatacaaaattagctgggcgtgatggtgcgtgcctgtaatcccagctactcgtgtggctgaagcaggagaatcgcttgagcccgggaggtgaagtttgcagtgagccaagaatgagctactgcactccagcctgggcaacagagtgagactccgtctcaaaaaaaaaaaaaaaaaaaaaaaaaaagaatatgaatatgaaggatgggtgtcgtggctcatgcctgtaatcccagcactttgggaggccaagacaggaggatcacttgagcccaggagcttgagaccagcctaggcaacatagggagaccctatctctgaaaaaagaaaaaaaaagtttaattagccaggtgcggtggtgcaagcttgtagtcccacctactctggaggctgaggcgggaggatcacttgggcccaggtggtcgaggctgcagtgagccatgatgacaccactgcactccagcctgggtaagatatgtggaaatcacaaggaacagtggaggatctcatactagtaacagtagaactgtcacaacccatacgtccaaagagatgagaacagagagaagttagagaaatcccaagtgagatttttttgcagagcaaaccaccatgcaagaagcaatgaccttctgtcaagggacataaataagcagcttgaggcaatctcagagaggagctcagggacatagataccctgacctcgatctcctcttctgtctcctgccaggaatccccaatggctgaacccaaatggaagacagagggcacagcaagaagccccttgtagttcccacaggcagccccggggcagagagcaggatggaaaagaggaaattgatggacacaaatgtaaaatggaatggtcatggaaatacattccaaaacttgaggagctttttggtttgtttgggtcttttttgtttcatcttgttttgttttttgagacagggtctctctctgtcgcccaggctggagtgcagtggcaggatcttggctcactgcagcctctgcctcctgggttcaagcgattctcctgcctcagcctcccaagtagctgggattacaggagcaggccaccatgcccagctaatttttgtatttttagtagagacaaggtttcaccatgttggtcaggctggtcttgaactcctgacatcaagtgatccacctgtctcagcctcccaaagtgctgggattacagggtgagccacagagcctggcccgaaactgatggagttttaacagaagctaaaggagaatatataagcttaactggttatattagagaagaagactggaaaataagtagctcagcatttcatcaagaagttaataaaggaacaacaactcagcagacaaggaaaaatgtgaagaaaaaatgctaaagagcagaaattgacaaaatagaatacaaaatacagaagagaggattcataaaaccaaaagctggttctctgaaataacaatatgtaaaacctttgacaggccaggtgtggtggctcacacctgtaggcccagcactttgggaggccgaggtgggtggatcacctgaggtcaggagttccagaccagcctggccaacatggtgaaaccccgtctctactaaaaatacaaaaattagctggacgtggtggcgggcgcctgtaatcccagctacttgggaggctgagacagtagaatcacttgaacccaggagacagaggttgcagtgagccgagattgtgccattgcactcccgcctgggtgacagagtgagactccatctcaaaaaataaaaaaataaataataataaaacctttgacagattaagaacaaagagaaagacacaaacaatattatgaaaaaaagacatagcagacatagccgtggcttgaaaaataagagaatattatgaataattttatgctgatgaattaggaaatagataaatgacagtttcctagaagaaataattaacaaaatggaactcaactatgcatagacttatgaccattaacaaaatgaaatctgccacacaaatgaccacaccccagtgattttacaggagattgctaccaaaaaagttaagaaacagattatcccaaacttatacaaatgcttccagataaagaacaatgggaacaaacagctcattctataagggtagcataaccttgaaatcaaatcaaacaaaataataaatgagaattcatcctcactcatggctactgaaacagatatcttaaattaaatcagaatttagaaatccacatattcacacatacatgtacatattttttttattgggtttacttcaggaatgcaagcataattttacagtaaaaagctcttacaaatggcacagttgctcgcccctgtaatcccagctacctaggaggctgaggtaggaggaccactggagcccaattgtctaggagtttgaagctgaatgagctataattgcaccctgcacactccagcctggacaccagaaactccagaaaaaaaaaaaaaaaacacctctgtcaatgtaattcaccatagtaaaacaaattaaataagagaaattatttgattcatttgatcagacacaggaaaaccattgatataaatgcacatccattcacaaaatgttttaaaaaccttaacaaactacataaagaaacttccttaatctaataaaatgtatctaccaaaaatgcagagtaaacagcatcctagttaataattagacatttaaagtcagtaacaataatgcgttctattattacgtctactcaatattattctagaggttctaaccatggcagtgagacaagaataggcagtaaattaaaaacctatattcaggggccaggcgccttggttcacgcctataatcccaacactttgggaggcctaagtggaagcatcgcctggagccaggtgtttgagagcagcccagacaacatagtgagacctcattgctacaaaaaagaaattgttttttaattattcaggcatggtggcacatgcctgtggtcccagctacctgggaggctaagatgggaggatcacttgagtccaggaggttgagccatgactgcaccactgcactccagcctgggagatggagtgggaccctatctcaaaaaaaaaaaaaaaaaaaaaaaaatctatattcatgtatggaaagactcaatattataaagatgccagttttccatatattagtcagcaaattcaatgtaatttcttttttttttccttgagatggaatctcgctctgtcgcccaggctggagtgcagtggtgtgatctcggctcactgcaagctccgcctcccgagttcaggccattctcctgcctcagcctcccgagtagctgggactacaggcgcccctcacaatgcccggctaattttttgtatttttagtagagacggggtttcaccgtgttggccaggatggtctcgatctcctgacctggtgatccgcccgcctcggcctcccaaagtgctgggatcacaggcgtgacccactgcacccggccaattcaatgtaatttcaatcaaaatctcacagagtttctaagcatttgtgtaaggttatttttaaattcacgagtaaagagtcaacaataatcaaaacacttttgaagtaaaaggacttgtggaagtcttgccctaccttgtattaagaatttttaggccgggcgcggtggctcacgcctgtgatcccagcactttgggaggccgaggcgggtggatcacgaggtcaggagatcgagaccatcctggctaacacggtgaaaccccgtctctactaaaaacacaaaaaattagccgggcgcgttggcggccgcctgtagtcccagctactcgggaggctgaggcaggagaatcacttgaacccaggaggcggagcttgcaatgagccgagatcgcgccagtgtactccagcctgggcgacagcgcaagacaaggaaaaaaaaaaaagaatttttataggccgggcacagtggctcacacctgtaatcccagcactttgggaggccaaggcaggcggacttcttgaggtcaggaactcaagaccagcctagccaacatggtgaaaccctgtctctactaaaaatacaaaaattagcttgggtgggggggggcgggcggttggcacgtgcctgtaatgccagctccttgggaggctgaggcaggagaatcgcttgagcccgggggacagaagttgtaatgagccgagactgagccactgtactctagcctgggtgacaggaacaagactctgtctcaaaaaaaaaattattataaaggtgtagtaactaagactactcacactgtgtggtattgatagggagtgaacaaatccagtacagaatagagagtccacaaacagacacgaatatatacagacagtgcggcagaagtggcatgactaaccaatggaggaagggatgcactgtgacccagggttccaatcccaaatcggatacaaaaatacattatatatttctgaaagatttaaatgagaataacaaaacttgacaactttcttttttttggtgggggggttgaggggacggaatttggctctcgtcgcccaggctggagtgcagcggcgcagtctcagctcaccacaacctccgcctcctgggttcaagtgattctcccgcctcagcttcctgagtagctgggattacagacacgcgccactatgcctggctaattttgtatttttagcagagacaggtttctccatgttggccagactggtcttgaactcccaacctcaggtgatccccgcccacctcggcctcccaaagtgccgggattacaggcatgagccactgcacctggctgaaacttgacaactttcacaagaaaatataggggcttattctagtgatttctaatagaactgctttgcacaacttaaaggggatgccgtccactctgcatcccaggaaatgccatccacacaacacaacataactggacagccttgaagttgtggatcatgaaagtccagcttgaggaaggggaagattttataaagaagacacgaaatcagaaaccataagggcaatgactaataaagttgacttcattaaaattagaaacatctgttggccaggcacagtggttcactcctgttatcacagcactttggaaggctgaggcaggcgggtcccttgaggcctagagtttgagagcagcctggccaacatggtgaaaccccgtctctaccaaaaatgcaaaaactagctgggcatggtagcacatacctgtagtcccagctactcaggaggctgaggcatgagaatcactagaacctgggaggcagaggttgcagtgaactgagatctcgccgctgcactccagcctgggcaacggagtgagactgtctcaaaaaaaaattaaaaaaagaaacatctgtaatgtaagaagtgaaactgggatttgaacccagacaaaatgaattgacagaaagtttggggaggtgatgtgcatagcaattagtattttaaaaaaaagttcaaagaataaaaatatttcagttatttttcagcacttctcaggtgggccaatatcgctaccaccaaaaagacatattatattgtgggacaggcattaagttgtttagggtattggatgttatgtcgggaaaacgaaatttagctagcttaaatagcaaggtgagctagggtagggcctgtgttgggtaccacagggctccagctctgcctctgattctcttgactttcccaggactgtctgagctttgttctaggctggtagcaagacagctgcagtagtctgaagcatcacattcaggtacagtgacatgcaaaggaagaagcatcagctcatctcttctgtgagaaaggacacatttcctagaagtctcctgggagagacattccttcaaaattcgtctgaattgagtctgaattgagtcacaattctgttcctaaaccagtctctgccaagggatgtgagataaacataactggtgtagtaaagcatatggctttgtggaggaaggtggatacctccccaaagtttggtgcttttaaggagaaagaaggaggggaatgaatgttaattaggcaattaacaaaatctgctccattcatgaagcttcactatgagcaccgtgaaacattcccacacttcccttcgttctgattccacctttacctagaatctttctgattgacacttaacttttccagatttcttgatactaggaaagtactgaatgagtctgtcagtcactgaaaacatctatctctcactattaaatttaaaaattgatattttggtttagggttagggttttctgttcctacgatttttgctatttctagaatgttatgtaaatggagtcaaacagaatgcagtagcctttcgagtctggcttcttacacttagcataatgcatttaaagttcctcatggcggtgtctgcgtctgtatctttttccttttcattgctgagtatcagtccatcataaggatgcatcccagtctgtctatccattccccagttgaagggcatttgggttatctcgttaggggcaattatgaataaagctactataaactcatgtacaagtttctgtatgaacataagttttcatttctcttctaaaaacacctacacgaggaattgctggctcatatagtgagtgtatttttttttttttttttttttttgagatggagtctcactctgtcgcccaggctggagtgctgtggtgcaatttcgactcacacaacctccgcttcccgggttcaagcgattctcctgcctcagcctcccgagtagctgggattggagtcacccaccaccatgcctggctaatttttgtatttttagtagagatggggtttcaccatgttggccaggctggtcttgaagtcctaacctcaggtgatctgcccgcttcagcctcccaaagtgctgggattacaggcgtgaaccatcctatcaggctgtgagtgtatgtttgacattataagaagctgaaaaactgtcctgtgattccttattttttatttaatttttatttttttttagacggagtctcgctgtgtcgcccaggcttgagtgcaatggcacaatctcggctcactgcaacctccgtctcccgggttcaagcatgttctcctgcctcagcctcccaagtagctgagattacaggcatgcgccaccactcccggctaatttttgtatttttagtacagatggggtttctccatgttaatcaggctggtcttgaactcctgagctcaggtgatccacccacctcggcctcccaaagtgctgggattacaggcgtgagccaccatgcctggcctggcctgtgattcttaaatgtcaatttggggaagatatctggcaaccatcactttaaccaagtgatccaacttaacattaatgagtgggacaacctgataattttgatgtgatgcgttaggaaatgttcagtatcacctatgacatattcttggcaaaactgtaccaatcaagcctctaggcctaatttccagactacaaaaagtataggaagatcaagatacaagttaaaggaggccatgaggaagcactcaggcaaatctagactatgggcattcataagataactgtcctggtctcttcaaaaagtgaacgtcagccgggctcggtggcttacgcctgtccatccagcactttgggaggccgaggcaagcggatcacctgaggtcaggagttcgagaccagcctgaccaacacggcgaaacaccatcactaccaaaaatacaaaaattagcctggcatggagggaggcgcctgtaatcccagccactggggaggctgaggcaggagaatcacctgaacccaggaggcagaggctgcagtgagccaagatcgtgccactgcactccagcctgggccacagaccaagactcagtctcaaaaaaaaaaaaaattaatttaatttaatttaaaaggccaggcacggtggctcacacctgtaatcccagcaccttgggaggccaaggtgggaggatcactggaggtcaggagttggagaccagcctggccaagagagggaaacaggggaactgttatgaatgaaaagagagtaaagacattacaggaagatgcaaagctttgattgaatcctggtcattaaaagcaatcttcctgcctcggcctcccaaagtgctggaattatgggcatgagccacagctcaactgaatttctcccaagggccaggtgccgtggctcatacttgtaatagcgctttgggaggctgaggtggaaggatcacttaaacccaggagtttgagagcagcaacataacaagactctatctctacaaaattaattaattaattaattaaaaattagctgggcatggtggcacaggcagcttgctcggagggcttagatgggaggactctaaccacccagcaggttcaccttgcccactgcctagatagagctgatttaccaagacaggaaaatttaaacaaagaaacagcgattcacagccggctgcatgggagaccagagtgttgtgttttattgtgttttgttttgttttgtttgagacggagtctcactctgttgcccaggctggagtgcagggacacaatctcggctcactgcaacctctgcctccagagttcaagcgattatcctgcctcggctgccctcgtaactgggataacagtcgagcgccaccacgcccagctaattttttatatttttggtagagacggggtttcaccatattagccaggatggtctcgatctcctgacctcaagatccgcccacctcggcctcccaaagtgctgggattacaggcgtgagccaccacgcccggcctgggacgggagatttattactactcaaatcagtttcccctagcacttagagatttttaggataatttggttgggggttgggggttggggggcagtgagtcaggagtgctgattgattggttcggagatgaagatgtaagaagtgggagctgtcttcttgtgctgagtcagttcctgggtcggggccagaagatcagatgagccagtttatccatctgggtggtgccagctgatccatcaagtgcagagtctgcaaagtatcccaagcgctgatcttaggttttacaatagtgatgttatctccaggagaaattcagagagggtcagaatcttacagcctcctcggaggttgcagtgaaccaagatcaaactactgcactccagcctgggtgacacagcaagactccgtctcaggaaacaaaagaaaaagaaaatgaaaaaaaacccacaatcttacagcttccagcttcatggctcgtaaactgtaatttctatcttttggctaatttgttagtcctacagaagcagtctactccccatgcaagaagagggtttgttttgggaaagggctgctattgttttggtttcaaactataaactaagtttctcccaaagttagtttggcccaggaatgaacaaggacagcttggaaaagttttgacaaaggaaggaaggaaaaaagggagggagagagggagggagggaaggaggaaggaaggaaagaagggagcgagggaaggaaggaaggaaggaaggaaggaaggaaggaaggaaggaaggaaggaagatggagtcggttaggtcagatctcttttactgtctcagttatagtcttgcaatggtagtttcatgatcacttgagcccagaaggtccagcctgcagtgagctgtgattgagccactacactcagcctgggctatacagagtgagaccctgtgtcactagcaatgataatgataataataacttttaaaagtttaaaaagaaataaatttaatttacccttaaacttgaaagcaaggatgataacagtccctccctaaaactaatcccctccttgctcaaggaccaaaaactgcctttgtggaaccaataaaaggccacaagattaggattgtgggaggggcctgaactctgctaaaatgtaagcgtagtttatttttcttttctttcttcttttttgagactgagttttgctcttgttgcccaggctggaatgcagtggtgcaatctcaacttaccgcaacctccgcctcccgggttcaagcaattctcctgcctcggcctccgaagcagatgggattacagacgcctgccaccatgcccagctaatttttgtatttttagtagagacagagtttcaccgtattggccaggctggtctcaaactcctgaactcaggtaatctacctgcctccacctcccaaagtgctaggattacaggcgtgagccaccacgcccagcctgtaagtgtagtttctataatccctttctactcaggaatcatgtggccagaagccacaaaacaggtgtagtttctccatccccagttgcttctatagatattgtcactattgcagaacctacgattacttttttgagatttttctttggactgaccacctgggcttgggactcatgactgtggccccacctagaggtgaactcagcacacatggactgttttccacacccctctctctttttttttttttttttttgagatggagtttcgttcttgtcacccaggctggagtgcaatggcatgatctcggcttattgcaacctccgcctcccgggttcaagcgattctcctgcctcagcctcccaagcagctgggattacaggcatgtgccaccacgctcggctaattttgtatttttagtagcgacgggtttcaccatgttggccaggctggtctcgaactcctgacctcaggtgatccgcccgccttggcctcccgaagtgctgggattacaggcgtgagccaccatgccctgccacacccctataattttatatccaaccaatcagcagcactcattttctagccccttgcccaccaaattgtccgcaaaaaccctaaccttcaagccttgggagagactaatttgagtagtaactccgtctcaaatgtggttggcgtcacattaattaaactctttttttatggcaataccatggtctcagtgaactggttttgtctgtgcagtgggcaggaagaatccatcaggcaatcaaaatttctactttttttttttttttttttttttgagacagagtctcgctccgtcacccagactggagtgcaatggtgagatctcggctcactgcaacctccgcctcccggggtcaagcaagtctcttgcctcagcctcctgagtagctgagattacaggcatgcaccaccacgcctggctaatttttgtatttttagtagagatgggcttcaccatgttggtcaggctggtctcaaactcctgacctcaggtgatctgccctcctcggcctcccaaagtgctgggattacaggctgagccaccgcacccagcccacataattttgtaaaaaaaaataataataataagcagctcagagtaaaaaagaaaatgcctaagtacacacacaaaatccaagtaccatgtattagaagcagtatgaacaacagatagagtgaacagacttgcaaatagttcaatactggaatttcagacattgatttatataataagtatgtggccaggtgaggtggctcatgcctgtaatcccagcactttgggaggctgaggcgggaaaatcacctgacgtcagaaaattgagaccagcctggccaacatggtgaaaccctcgctctactaaaaacacaaaaattagccaggtgtggtggtgcatacctgtaattccagctacttgggaggctgaggcaggagaattgcttgaacccaggaggcagaggttgcagtgagccgagatcatgccactgcactccagcctgggcgacagagtgagactccatttcaaaaaaaataaaataaaataaaataataaaataaaatatgtttatcatgggtgaagaaattgtaatcccagcctgaacaatatagcaaaaccctgtctgtacaaacaaataaaataaaatcagctgggtgtggtagcatacgtctgtagtcccatctacttgacgggcagctgggtgtggtagtgtatgtctgtagtcccaactacttgacaggctgagatgggaggattgcttgaggccaagaacttgaggctgcagtgaactatgaccgcatcaccgcactccagcctgggtggcagtgagaccctaggaaaagaaaaaaaaaaagcaccactgcgttccagtctgggtgacagagcgagatgcgagactcaaaaaaaaaagtgtaagaatttgttgaggtctaagatgggacatttctccagagggaatttacatttgctcctgcctggcattgatgggcactaccacaccagtagcaactaactcaactcatcatttgaagctttctgaaccacacacgcaatatgaatttgggctgcaaatcaacatgtaagaactgcccaggggctacagcttctcaggacagccccctctcctcaccccccatcaccaaggtaaccttgcttgcagcctcacaatgcaaggagtagaagggctgtttacttctggttctcgttaccagagaggtcctagtgttttgtggagcatttcctattagatctcttttggcagataaactgtgtgcccccttcctcccaacagattcctgtgttgaagctctcactccccagtacctcagaatggtactgtatccctttaaggaggggattaagttaaaatgaagccttagggtgggccatgatccaatctgactgtgtccttatatgaagggaaatgggccgggcacggtggttcacgcctgtaatcccagcaccttggaaggccaaggtgggcagatcacctgaggtcaggagattaagaccatcctgaccaacatggtgaaaacctgtctctactaaaaatacaaaaattagctgggcgtggtagtgggtgcctggtaatcccagctacttgggagcctgaggcaggagaatcgcttgaacccaggaggcggaggttgcagtgagctgagatcacaccattgcactccagcctggtcaacaagagggaaactccatctcaaaaaaaaaaaaaaagaagaggaaattaggacacacagagagacaccaggggcaagggagcacgcacagaggagagaccacaggaacatacagcaagaaggcatctctctgcaagccaagcacggggtccttcggatgaagccagacctgccagtcttgatcttggacttccagcctctaggactgtgggaaaatacatttctgttatttgagcccccagtctatggtattttattatggcagccctagcaaactaatgcaattccccacctttggtggccttggcctttgacttttttatttcacagccccttggggtttcactcttgtcgcccaggctggagtgcaatgctgtgcattcttggctcactgcaacctccgcctgtcaagttcaagcaattctcctgcctcagcctccagagtagctgggattacaggcacccaccaccacgcccggctaaattttttgtatttttagtagagacggggtttcaccatgttggccaggttgatctcgaactcctgacctcaggtgatccgcccgcctcggcctcccaaagtgctgggattacaggcatgagccactgtgcccagccaccacttccttttcttttctttctttctttcttttttttttttttttttttgagatggagtcttgctcagttgcccaggctggagtgcaatggcatgatctcagcttactgcaacctccacctcccgagttcaagcaattcttccacctcagcctccctagtagctgggattacagacgtgagccaccatgcccggctaatttttgtagagacagggtttcaccatgttggccaggctggtctcaaactcctgacctcaggtgatccgcccgccttggcctcccaaagtgctgggattccaggtgtgagccaccgcgcccggacttccttttcttttctgagatttgatttgtcccactcattccttactatcttgccacctctgtgatgacgttaagaggtatatttgtttgttttaaaacaatatccagcttttcagttattctcattgtctatccaaataccttcccccacagatcagctaaaaggtagagaagtcaagaaatgacagcagagggaccgaggagctgatgaggaaaaagtgaagggcaacttcaaggttttcagcctgggaggaggtttaaaaaatggtttcaaaaaaataaaaataaaaataaataaaagaaacaaaacaaaacaaaaaaatgaaaaaaagttggtttctagcaagaaaagaaagaaaagcaaaggtcagaaagaaaagcaaattttcagagaacaaccgactttggtttgtatctgtactggacacgtataagtttttgttttgttttgtttttggtcattgttcactaaacaatacaatataacaactattgcatagcatttatgtgttttttgttttgttttgttttgtttttttgagacggagtctcattctgtcgcccaggctgaagtgcagtggtgtgatcatggctccctgcaacctccacctgggttcaagcaactctcctgcctcagcctcctgagtagctgggactaaaggcatgcgccaccacactcagttaatttttgtatttttagtagagatggggtttcaccatgttggccaggctggtctcgaactcctgacctcagatgatctgcccatctcggcctcccaaagtgctgggattacaggcgtgagccactgcgcctggtctaatttttgtattttttgtagagacaaagttttgccaggttgcccaggctggtcttgaatttctaacctcaagtgatccacctatctcagcctccgaaagtgctgggattatgggtgtgagccaccacacctggccatttatgttgttattaggtatcctaagtaacctagacatgatttaaagtatacaggaagatgtatgtaggttatatgcaaatactacacattttatatcaggagtttgagcatcctcagattttggtgtgtgtgtgtgtgtgtgtcttgtaagatggattctcactgtctcccaggattgaatatcctcagattttgtgtgtgtgtgtgtgtgtgtgtgtgtgtgtgtgtgtgtgtgtgtgtgtgtgttttgtaagacagtctcactctgtctcccaggctggaatgccgtggcgcaatctctgctcactgcaacctctgcctcccgggttcaagcgattctcttgcctcagcctcctaagtagctgggatcataggtgactgccaccaagcctggctactttttttttttttcagatggagtcttgccctgtttcccaggctggagtgcggtgccacgatctcagctcactgcgacctccacctcccaggttcaagcgattcttctgcctcagcctcccgagtagctgggattataggcacgtgccaccacgcccagctaatttttgtatttttagtagagatggagtttcaccatgttggccaggctggtctcaaactcctgaccttaggtaatctgcctacctcggcctcccaaagtgctgggattacagacgtgagccaccgcatccagccccagctaattttttttttggatttttagtagagatgggttttcaccatgttggtcaggctggtctcgaactcctgacgtcaagtgatccgctcacctcagtttcccaaagtgctgggattacaagcgtgagccaccatgcctggctaatcctcaaattttgatatccaagggacttcctggaaccaattccccatggacacgcagggaaaattgtaatagtaagacatcaaaaggtaagaaaggaataacattttcagtcaaatgagaattgctatattgtaagtgtgtatcttcatacacaaactcatgtaacaggaaatataattttatttttctataactcagtttaacaatttaacaatttaacttttattattcccatcagcaccataggaaaagtaacaatgaaaaaaaactgttactattcccagaccagggaatccttatgtagtctaaggatgtggtagcctgtttacttgtcatcaattctaccaaatctatcggccatagcctttttttttttttttttgagacaagggtctctgtcacctggactggagtgcggtagcatgatcatagctcactgcagcctcaagctcctggcctcaagagattctcccacctcagcctcccaaagcaccgggatacacatgagacatgacacctggctatagtcaagttttgtttgacccatctgcaggttttaaaattcaaaagctggccaggcatggtggctcaaaccagtaatccctgcacctgggaggctgaggtgagtggattacctgaactcaggagtctgagaccagcctggccaacatggcaaaaccccgtttctactaaaaacacaaaaattagcccagtatggtggtgtgcacctgttgtcccagctactccgggggctgaggcaggaggatcacttgagccttgggaggctgaggttgcagtgagccatgatctccagcctcagtaacagagggagaccctgtctccaaaaaaaaaaaaaaaaaaaaaaaaaaaaaaaaaaagcaaaggctgtggctgcaggtcacacctctaatctcatcactccgggaggccaaggcaggaggatgccttgaggccaagagttcaagactagcctggacaacataagagaccttctctctccaaaaagtttaaaaaatgaccaggtggggtggtacactcacgtagtcctagctactcaggaggctgaggtggaaggatcacttgagcccaggagttggaggttacagcaaactatgatcacgccaccatactccagcctagacaagagagcaagactttgtctctctttttttaataaaaaacattttcatttatttatttcagaagagaactagagtgaagaccttgtctcttaaaaaaaaatcaaaagctgacaattgattcctttcttcctccttcccctaacctgctaccatgtcaatggcattagttaggagtggttttggctgcaaataacagaacatttgaataccagaggctttagtgattgaagattgtttctctgtttttgttttgttttgttttgttttttgtttttgagatggagcctcactctgtcgccaggctggagtgcagtggcgcagtcttggctcactgtaacctctgcctcctcccaggttcaagcgattctcctgtctcagcctcccaagtagctgggactacaggcgcccgccaccacaccccgctaatttttttgtatttttagtagagatggggtttcaccgtgttagccaggatggtctcgatctcctgacctcgtgatctgcctgccttggcctctcaaagtgctgggattacaggcgtgagccaccacgcccggtcccaggaactccctcttacaaagcagttcagggctatggtggtttaaaaatactatcgaccaggcacggtggctcacgcctgggaggctgaggtgagaggattacttggggccaagagttcaagaccagcctgggcacatatagtgagacctcatctctactgaaaaaaaaacagctgggcatggtggcaagccctgtagtcccagctcctggggaggcggaggagggagtgttgcagggtccctgcagtgttggttttctggccagaaaactctgtggctggtggcacctttgcccgagttttactcaggccctctggggtcattttgcccactcagcctggcaggctgtgctcagctcatgctaccagcctggatctcatgcttgccaagggcgaggcaggtgtggagcagcgaggggtgtgtaagcaagagaactggggtctggcatatcttctatttctgtgtcttgccctgtcgggcttttcctatcactactgtcaacgtcctgtagaaaacagaaaaagactgagtgaaccaggggaaaatatcaaatcgtaagatgtaagtctaattacactgatactacagccgaactgtcactatacattattattactaataaggtatatttctttctttcttttctttttttttccagagtcttgctctgtcgcccaggctggagtgcagtggcgcggtctcagctcactgcaaccttcacctcccaggttcaagtgattctcctgcctcagcctcccaagtagatgtatatttattcttaacagtatttttatttcatgggcaaatttagattaagctattacttcattttcattcccttttaatgattgtgttacaatataaattgttccttttgtaaagctactatatatcttaattttttagttaaaaacattatcctcaggaaatgttggggcgaggagaactcggagtttgtctaaggctgtcaccttgctatgttgttttggagcttgcaggggtctggggctcaaggtctcattctctaggagctcacactgcagctgaacttgtaatgctgcttttttttttttttttttttttgagacagagtcttgttctgtcgcctaggctggactgcagtggtgcgatctcggctcactgcaacctccacctcccggattcaagagattctcttgcctcagcctcccaagtagctgggattacagccgcgcaccaccatgcccagctaatttttgtattttttagtagagatggggtttcaccatgttggccaggctggtcttgacctcctgacctggtgatccgcctgcttcggcctcccagagtgctgggattacaggcgtgagccactgcgcctggccaatgcttcttttttttgagatggagtctcactctgtcacccaggctggagtgcagtggtgcaatcttggctcactgcaacctctgcctcccgggtttcagtgatccttttgcctcagcttgctgagtagctgggattacaggtgcctgctaccacgcccggctagtttttgtatttttagtcgagacagagtttcaccatattggtcagactggtcttgaactcctgaccttagctgatccacccaccttggcctcccacagtgctgggattacaggtgtgagccaccgcgcccagccaacatcaggtatacttacaaatctattttcttgtgttgagttcgttctgtttctctctgaaaggtagatttttgaaatgcaaaagcatgaaactaacttctttttctcccaggtgaaccctttcctgaaggaagaaatggagaacggcccagatgactaaatcagagaaggaccacataatccaaggatagggtaaaatattggttaatattttaaaaacttatcctatcacatatatgcgatgtcactgaatcttttcaacaattttatgagaaataaattctattttacaatttaggagagaggttagggctacacagctagaagcagaatttggccaggcacagtggctcacgcctgtaatcccagatactcgggaggctgaggcaggagaattgctcgaacctgggaggtggaggttgcagtgagctgagattgtgccattgcactccagcctgggtgacacagcgagactgcatctcaaaaaacaaagaaaacaaaacaaaaaatagaagcagaatttgaatccatgtctatctgattctaggatcctgtccttgccatctcattgtacaatacctacaggcattttaaaagtgtaacttgaatgttccagttcttatcagcctaggggtgcaaataaggtcacatcagcacttacccacaattttgctggcaggtcacccctcatttgctcacacagaacctcagcttccttcaaaatgcctccccaaaagattcttgtagctatccaagaacgagtttcctttattaagtactgccgcgctctcatctccttggcaaggagaactgacacgaacatgatattcttgctgcttgctgtgccatgagtaataaagtcctttttctcataccaggaatttgatgtcttctgccaacactcatgaagcagtaataggctaacttattagcttgtgagtagggtaaaatcatcccagccctgacacatggcacaggcttgaggtcaggtgctatgtggtggcaaccacaagaagctgttgagagtccagtgacaactgggtactataggccgggcccagtggctcccgcctgtaatcccagcactttgggaggctgaggcaggaggactgcttgagcccaggagtttgagatcaccctgagcaatatagggagatttttttttttttttttgagacagagtctcactctgttgcccaggctggagtgcagtagcgtgatctcggctcactacaacctctgcctcccaggcttaagtgattctcccacttccacctcctgagtagctgggattacaggctcttgctgccacacccggctaatttttttgtattttagtaaagatggggtttcatcatgttgcccagggtggttttgaactgagctcagccaatccacctgccttggcctcccaaagtgctgggattacaggcaagagccaccgcgcccgaccaatatagggagatcttgtctctaccattttttttttttttaattagctgggcatggtagtgcatggctgtggtctcagccacttaggaggctgaggtgggaggatcatttgacccaggagtttgaggttgcagtcagacgagatcacgtcacggcactccagcctgggcaacagagggataccttttctctaaaaaaactagaagaaagaactggttgctgtagcagtggctgccataagaaaaaggtaaaccagaggaatcgaaagaagtgtctctactgtctctctctgcaaatctcattagccactgtcctgcttactctcaatgaagactaggaaagctagtgctgtcaagcaagaactcctttgacggctgggcgcggtggctcacgcctgtaatcccagcactttgggaggccgaggcaggcagatcacctgaggtcaggagttttgagaccagactggccaacatggagaaaccccatctctactaaaaatacaaaaattagctgggcatggtggcacatacctgtagtcccagctacttgggaggctgaggcaggagaatcacttgaacccgggaggaagaggttgcagtgagccgagatcgtgccgctgcactccagcttgggtgacagagtgagactccatctcaaaaaaaaaaaaaaaaaaaaaaaaaaagaactgcattttctggtatgaaatcactgatatgagctgacttactttctttttttttttttttttgagacagagtttcactcttgttgcccaggctggggtggagtgcaatggtgtgatcttggctcactgcaacctccacctcccgggttcaagtgattctcctgcctcagcctcccaagtagctgggatcacaggcaggtgcctccacacttggctaattttgtatttttagtagagatggggtttctccctgttggtcaggctggtcttgaactcccaacctcaggtgatccgcccacctgggcctcccaaagtgctgggattacaggcgagagccactgcacccggccatgagctgactttcaaaatatgaggctgtcaatgactgttggttttcaggggtgtattcaatgaaccaagttgtccctgactgatgtgatagatttataaactgttctagtggttacttgttggcacagctatagaacaatctatcttttcctaggagtgtgggaactctgatttgcatttggaaatgtttctgtaactcattatatagaaagggtcaatcttcctaatatacaaagaccacctaaggttgggggcagtggcccaccctcacaatcccagcactttgggaggccaacgtggtaggactgcttgaggcaaggagttggagaagagtctgggcaacatagtgagaccctgtctctaccacccaccctgccaaaaaaaaaattcagccagttattgttgctcactcatgtagtcccagctaatagggaggctgatgtagaaggatcgcttgagcccaggggatcaaggctgtagcgagctatgatcacgccactgcactccagcctgggaaacagcaacatcctgttaaaaaaaaaaaaaaaaaaaaaaagcccctagaaattgagaagaaaacgaccaacaaaccaatagaaaaataggaaaataactcaaataattacaaatggctcagaacactgggggacaaaaacctaacctcaaccccattcataataaatgttttctcttttttttttttttttttttttgaaacagaggttttggtctgttgcccaggctggaatgcagtggtacaatctcagctcactgcaacctctgcctcccgggttcaagcgattctcctgcctcagcctcccgaatagctaggattacaggtgtgcaccaccatacccagctaatgtatttttagtagagacagggtttctccatgttggccaggctggcctcgaactcctgacctcaggtgatctgcctgcctcagcctcccaaagtgctgcaattacagccgtgagccaccgggcctggccacgaatgattttttaaagccaaagaaaagagcagtggttagttcagaacctttttggttgccttagaaacttagggtttttgctattacataacattaaaattgccacttcctcctctaaagacctaagtctgagataattagccctcatctttttttcagactgtgacctattcttctcagccccaaaggaaaatttgtttttaagatcatgctttaaaaagtactactggtttgcgcccaatgcttggcaagtaaaaaacaaataaaaagtactattagtttaaaaagttaaagtcttctaaaatcaaactagctaaattcatgtatttttagctttatccaaataaaagatttaaaatgttttctaagcatttgccagtagaaggaatcaattcattttttttttgtttataagatgcttttccagaagttattcttgagattctgagatttttaagcaccgttttcaagtcaataaactgataatagtgttgtacaaattacagcacctcgagctctttgtgggtggaaaggttctctcacatgttaaaaccaagttgatttaatatcatgtcagtgcctcttgctaggattgttacacaactcccctctcttgatttgttgtaatgtaggtttactctggagagttacttcattatgatctatttttaattaattccaatgccctcctttttttttttttttttttttttgagatggagtcttgctgtgtcgcccagactggagtgcaatggtgtgatctcggttcactgcaacctccacctcccaggttcaggcgattctcctgcctcagcctcccaagtagctgggactacaggcacctgccatcatgcctggctaatttttgtatttttagtagagacggggtttcaccatgttggccaggatggtctcgatctcttgacctcatgatctgcccacctcggcctcccaaagtgctgggattacaggcgtgagacactgtgcctggcaaatgccctccttttaatagacagatcaggctgggcacagtggctcacgcctgtaatcccagcagtttgggaagctgaggtgggtggatcacctgaggtaaggagttcaagaccagcctggccaatatgatgaaatcccatgtttactaaaaatacaaaaattagccaggcgtggtggcacgcgcctgtaatcccagctactctggaggctgaggcaggagaatcgcttgaacctaggaggcagaggttacagtgagccgagattgtaccgctgcactccagcctgggaaaaaaaaaaagatcaaatcttatcctggtgttctattatttctggattgtatccttctaggagctctgggaatttagtgatgatgtctgatggcttaatttcctatggaggaaatttcaaagagggttcacctggtaggtgaggaattgtgggatttgtagggcttgtaggggcataggaaaatgggacaatggtagctttaggtgaccacccgtttgtgtatggggatggcagacacaatcttattctctgaatcatcagctctggacataatcagaacaacaacaacaacaaaaactaaagaattggaagtgctttctgcaggtacttaaaggttctctaggtggccgggcacggtggctcatgctggtaatcccagcactttgggaggccgaggcgggtggatcacttgaggtcaggagttcgagaccagcctggccaacatggtggaaccccgtctctactaaaaatacaaaaattagctgggcatggtggtgagcgcctgtagttccagctactcaggaggctgaggcaggagagtcacttgaacctgggaggcagaggttgcagtgagccgagatcatgccactgcactccagcctgggtgacaaagcaagactccatctcaaaaacataaaataaatgaaaataaaggttctccagttttctcctatagatccttcatgaggcttaacttctcctgggaatttgtggataagcatcatttttccacacatactaacacccatcttgtctagataggagcgttataggtttttgccttagacgtttcaagacaccttagtccagaatctattaaaggaaaacatctctggtgtgttttctttccccctcttgtcttgcagcgtcaagcctgccattctaaactctgctgatataaaaaccatttgcccagactcctttgccagttggcttcttgtaaagttctatcaataagcggttctaggaaggaggaaaggaaaagggggctactttttttttttttttttttttgagacggagtcctgttgcatcacccaggctggagtgcagtggcatggtctcggctcactgtgacctccgtctcccaggttcaagcgattctcctgcctcagtctcctgaatagctgggactacaggcgtgtgccaccacactggctaatttattgtatttttagtagagacggggtttcaccatgttggccaggctggtcttgaactcctgacctagtgatctgcccccctcggcctcccaaagtgctgggattacaggcgtgagccactgcgcctggccaaggaggcttctttcttctttgttcctcttgtccatgttgcccagcagtgccagttgactccagcctccaaattattccagctcttctagaagtagactcactgggacatttcagaggtagcagcagcagctgggaggtatttcctcctcagagatctgcacacttctgcagggtctgcggggtccacctaccccagccctcaactcctacattctagtgattgaaacccttcccttcagtttctcagcagccgcttcctccgcttatcatccttaggtgatctcagtgttcccttttgctccaaaacctgtgtaaccaattccctctactgaataccctctgctgaaatccttattgtgatttgttttctcaactagaccctgatcaatgccccagtcataaccagcatgagctctcctcctcatcctgcaactcaggaagtccacagtgagtcagtctaacctgaggtgaaaagagacaactgaacgtttcatgagccttaagacttggagggcaatgatggaaagtatggacaggggccgggtgcagtggctcacacctgtaatcccagcactttgggaggctgaggcaggtggatcacctgaggtcaggtgttcaagaccagcctggccaagatggtgaaacccgatctctattaaaaatacaaacattagccgggcatggtcacgcatgcccgtagtcccagctactctggaggctgaggcaggaaaatcacttgaacccgggaggtggaggttgcagtgagccgagatggcgccactgcactcgagtctgggagacagagcaagagtctgtctgaaaaaaaaaagaaaaaagaaaaagaaatgaaaaaaaagaaagtatggacagacagactcaatttatgatccctccccgagagagacttctgaattcaagctttagggatgaagcctaactgtagcagcctgacaccacaaaagtcaaggtcgcccccaactcacattgaactcagggtccatgttacaaatcctgccaaaaccaggcaaaatattccagaaaaaaatcagactcaaaatttaaagttatgattatttattataacttttacacaggaagaagaaatgggtaaaaataaaatacaactctcctcaatacacgctcaactctcccacaatacagactcaactcccctacaatacagactcaactcccctacaatacagactcaacttccctataatacagactcaactctcccacaatagactcaactcccctacaatacagactcaactctcccacaatagactcaactgccctacaatacagactcaactcccctacaatacagactcaactcgcctacaatacacactcaactctcccacaatacagactcaactcccctacaatacagactcaacttccctataatacagactcaactctcccacaatagactcaattgccctacaatacagactcaactcccctacaatacagactcaactctcccacaatagactcaactcccctacaatacagactcaactctcccacaatagactcaactgccctacaatacagactcaactcccctacaatacagactcaactcccctacaatacacactcaactctcccacaatacagactcaactctcccacaatacagactcaactcccctacaatacagactcaactcccctacaatacagactcaactcccctacaatacagactcaactcccctacaatacagactcaactctcccacaatacagactcaactctcccacaatacagactcaactctcccaatacagactcaactatcccactgtacagactcaactatcccacagtagactcaactctcgcacaatacactcaactctcccacaatacagactcaactcccctacaatacagactcaactcccctacaatacagactcaactcccctacaatacagactcaactcccccacaatacagactcaactcccctacaatacagactcaactcccctacaatacagactcaactcccctacaatacagactcaactcccctacaatacagactcaactcccctacaatacagactcaactctcccacaatacagactcaactctcccacaatacagactcaattctcccacaatacagactcaactcccctgcaatacagactcacctatcccacaatacagactcaattatcccaaaatacagactcaactatcccacaatacagactgaactctcccacaatgcagactcaactcgcacaatacagactcaactctcccacaatacagactcaactcccccacaatacagactcaactcccctacaatacagactcaactcccctacaatatagactcaactcccccacaatacagactcaactcccccacaatacagactcaactcccctacaatacagactcaactcccctacaatatagactcaactctcccacaatagactcaactcccccacaatacagactcaactcccccaaaatacagactcaactctcctacaatacactcaactctcccacaatggagactcaactcccctacagtagactcaactctcccacaataggctcaactctcacaatacagactcaagtctcccacaatacagactcaactctcctacaatacagactcaactctcgcacaatacagactcaactctcccacaatagactcaactctcccacaatacagactcaactctcccacaatacagactcaactctcccacagtacagactcaactctcccacaatacagactcaactctcccacaatacagactcaactctcccacaatacagacttaactctcccacagtacagactcaactctcccacagtacagacccaactctcccacaatacagactcaactctctcacagtacagactcaactctcccacagtacagactcaactctcccacagtacagactcaactctcccacagtacagactcaactctcacaatacagactcaactctcccacagtacagactcaactctcccacagtacagactcaactctcccacagtacagactcaactctcacaatacagactcaactctcccacagtacagactcaactctcccacagtacagactcaactctcccacagtacagactcaactctcccacagtacagactcaactctcccacagtacagactcaactctcccacagtacagactcaactctcctacattacagactcaactctcctacaatacaggctgaactctgcagtcttatttttcttgtatgtccttccaaatggattgtgtctttaaaaaataactaaattttttaatataatagagatggggttttgacatgttgcccaagctggtctcgaattcctgggcttaggcaatcctcccagctcggcctcccatagtgttgtgattacaggtaggattactttgcacctgcatgatcctgcctttttaatacctccaagtttttagtgtctgttttccaaatttttatccacaccacatacgcagagctagtatgagaacttgagtaagtcacaaggtatttctgagaatcagtttcttctggagccaaggtcttttgtgacccaggatacatctggcagagaagaggtaagaggaggcttcatcagaagacagatcagtgcaatctactggatgccgtatctggggacttacggcagcacaaagtcactggatgactccaataagtgagactcttccaagaaaaaagtggggctggcagagcagtgggggtggagaagagccagaaggaaggaactgtcacttattaaggattatttttctcaggggccatgccagctgctctacacatattacttaccatagccactctggtggttacattatgatattcattacaatctttttcttttttcttttaaagacagactctcgctctgccgcccgggctggagcagtggtgccatctctgcttttgcaacttctgcctcccaggttcaagtgattctcctgcctcagcctcctgagtagctgggattacaggcgtgcaccaccacacccagctagtatttgtatttttagtaaagacagggtttcagcatgttggtcaggctggtctcgaactcgacctcaggtgatccacccgcctcggcctcccagtgttctgggattacaggtgtgagccaccaccccagcctcattacaaatttaaaagtgaggtaatgaaagctaactagttcccgcaaggtcacacaagtagagaccgagttaaaaagaaaattattttattttttccctcctgcacgacatgactctgttttgattctcaaactcatgtcagttactgggcctgccaggtgtggtgactcatacctgtcatcccaaagctttgggaggccgaggcgggaggattgcttgcagccaggagttcaagaccagcctgggcaacacagtgagacccccatctctaccaaaacaaattgtttgaattagcagggtgttgtggcatgttcctgtagtcctagcaacctttccacttgggaggctgaggcagaaggactgctggagtccaggagttggaggtcacagtgagctatgatcgcaccactgcgctccagcctggggaacagagtaagactctgtctctcaaaaaaaaaaaaaaaagttatggatcctatagttcaatttcctttttggttttttttttttttttttagatactctcacactctgttgcccaagctgaagtgcagccttgacctcccaggctcaagtgatcctcctgcttcagcctcccaagtggctgggactacaggctgaagccaccatgcccagctaattttttttttcttttctttctgtagagacaaggtctcactatgttgcccaaggtggtttcaaacccctgggcttgagcaatcctcccacctcagccttccaagtagctggaactccaggcacgcaccaccacacctggctaattttgaaattttatgtagagttggattctcattgtattgcccaggttggtctttaactaactcctggactcaagtgatcatcctgcctcagcctcccaaagtgctggtattaaaggcatgagccacgtcgcccagccttatcttacaaactagctcagactagcagggaaaaaagtggttgcaaacatcagtttgccttttaggtctcccctctccagaatcttagcccctttggccctcattgtttcagtagctcactaatgcttttaagtaattttatatttttatctggcttctcccattgttcacaggattgtaaatgtcctgcaatccaatctgaaaagcgtaagttttgtttttcaaatattttaaaaatagttcactaaagctaagtaagtcaaaaattcctcacaatgctattttcctttctttttccttccttttttttttctttctctttccccttccttttttttttttttttgagacagggtctcactgtcacccaggctggagtgcagtggtacaatcttagaatctcagctcactgtaacctccgcctctcaggctcaagcgatcctccacctcagcctcccatgtagctgggactacaagcgtgcaccacacttggtagagaagggggtttcaccatgttgctcaggctggtcttgaactcctgagctctagcaatttgtccacctcagtctctcaaagtgctgggattacaggcataagccaccacaccaggcctcttttacttttttttttttgagacagagtctcgctctgttgccaggctggagtgcagtggcgcgatctcggctcactgcaacctccgcctcctgggttcaagcgattctcctgcctcagcctcctgagtagctgggactacaggcacccgccaccatgcccagctaatttttgtatttttagtagagatggggtttcaccatgttggccaggatggtctcgatctcttgacctcgtgatccgcccgcctcggcctcccaaagtgttgggattacaggcatgagccaccgcgcccggctacttttttttttttttttttgagacagagtcttgctctgtcgcccagtctggagtgcagtggcgcgatctgggcacactgcaacctccacctcctgggttcaagcaattgtcctgcctcagcctcctgagtagctgggattacaggcgcccgccaccatgcccagctaatttttttgtatttttagtagagatggagtttcaccatgttggccaggctggtctcaagctcctgacctcaggtgatccacctgcctcggcctcccaaagtactgagattacaggcgtgagccaccgcgcccggccctacattttgctttcaaaattttgggggcggccagagagacagagcgacacactgtctcaaaaaacaaaacaaacaaacaaaaactaaaacaaataaaatctttttcgagacagggtctcactctatcacctaggctggagcgcagtggtgcaatcttggttcactgaagccctgacctctgggactcaggcgaccctcccacctcagcctcttgagcagctgggaccacaggcgtgcacccccacaactggttaattttcctactttctgtagagatggggtttcaccatgttgcccaggctggtctcgaactcttgggctcaagcgatctgcctgcctcagcctcccaaagtgctgggattacagtcctgagccaccatgcccagccccttttttctcttaatgctgaaaaagctttcctgaattataatttttaaaacttaaaaggcagaaaagggccatctacagtggtgcagactgagatttataagcttcctttatcttgcaatattttaagaacattttaagttttttttttttttttgagacgcagtcttgccctgtcgcccaggctggagtgcagtggagcgatctcggctcactgcaacctccgcctcctgggttcaagcgattctccggcctgagcctccccagcagctgggactacaggcctggcaccacgcttggctgattttttttttgtatttttagtagagacggggtttcaccacgttggccaggctggtctcaaattcctcacctcaagtgatctgcccacctcagcctcgcagtgcagtgttaggattacaggtgtgagccactgagtccagccacatactcccttctcaaggtgttttctgggtattcaccctgattttgggggcgggttggagttatgaaaaacaacatcacagacttcctataaagaccttttttttgagatggagtcttgctctgttgtccagtctggggtgcaatggcgtgatctctcggctcactgcaacctccacctcctgggttcaagtgatttttgtgcctcagcctcccgagtagctgggactacaggcacccgcctaatttttgtatttttaatagagatgggatttctccacgttggccaggctggtttcaaactcctgacctcaggtgatccacctgcctcggcctcccaaagttgttgggattacaaggcatgagccaccgtgcctgaccccccgaccttttttgtttttgtttttttgaggcacatgtcaccatgcccggcttatttttattttgagacaggcgtgagcaagcacacccagccaaaaatttctcctacatgtcattctgcatacatgtgaagacagccttaagaaattcctagaatagtcaaacgtacctccagagattttcaattatctattcataccaagcaatgtataagaatgcctagttcctcgcagtcttgccaagattaaaacaaaacaaaaaattcccttatctttgctaatctgaaggatgaacaaacttatgagtattagcataagattatgcatctcttcacctaatagttcagaaccggttatagttactttcttgtgaatgatgtttcttgggaacatacgcatttctagttctcctattgaggacttttcttttttttcttttttttttttttttgagacggagtctccagtctgtcacccaggctggagtgcagtggcacaatcttggctcactgcaacttccgcctcctgggttcaagcaattctctgtctcagcctcccgaatagttgggattacaggcacacgccaccacacccggctaatttttgtatttttagtagagacggcgtttccccatgttggccaggctggtttcaaactcctgacttcaggtgatctgcctgcctcggcctcccaaagtgctgggattacaggtgtgagccaccatgcacggccgagttattggtcttttcttaatgaactggaggatactttacataaaggaaattagctctttgtgatgaactgcaactatttcttcccaagtttgccacagcttccaatttcccttgatggtagtttttgttatgcagaacttttaattttcatgtagctgatttttacatatttttaagttgtggtaaaatacacataataatccatttttatttttagtattttatttttcagattctcagcctctgcacagccttagtactccctgagaaattcagtgtttgcatatcctttccacaaaaatgagaggaaaaaggaccagtacctgctagtgactgatacatttattagtttctaacaaaaaggcatacatggtaggcagagtagaaatactaacagaaattagtttatcttgaaaccaattttagtcaggaagacttcttcacagagaatgagctgaatatataaatcccaaatatatcacaccatatatgtgatatatttacacctaaatatatcacaccctcctttttggtcacagactattccaggaagattaaatagataacgtttaatttgaggcattcaagaatgtccaccctaaaactgaaagtgaaattgctcttagagaaaaattggtttgatgagaagattgatcttagcctgtctcagacaaatttggtttatttatttttacttaacgacccatgtgatagtatagttgcaagctatacttcatttaactacaatcattactcagaggacaatcaccttaagaggcaaattaagttttaaattagcacagaatttataattacccaatcagcattgacatagatgccatcaggtatgcaaagattaacaaaattctattaccaaccttagaggaaaaaaacttaatgacatacagaaatactggcaaatttaagctagaattagctccaggacattttatcttattttcacattaaaagaatagattactagatatcagcagaaatgctgttaaagctattttttactaatagttgttcatattaatgaaacaaaagatcaatagtctctgagctaaatttcacaaaatgaaatcagtgtcttctgatttaactttcaggagtaagaaagggcaaaacccaagcaccatactttctatttctgttcataaactcaaataaaagcagtatcaacacaaatgatcatataagaaaacacgtggttatgtttcaggttccacaacataagacactgtgaggtaactctcctgtaatacattcccatttttttctggaatagcagatgcatagaaatgcaggtttccaaaaattcacccaatttagtaactaattttgattctgatgcctgatagtagggtgtgaaaagctgtaaaacccaaatgtttcctgtgttctttcacaaggacaagggaagaggatgctctgccaaactgcccctgctgcgtcatagtggaccagtttcaatgatccagactgtcagtcaccccatccagcctcatcctcatctggacccatttctcaccacccaatcagtttcaatgatccagactgtcagtcaccccatccagcctcatcctcatctggacccatttctcaccacccaatcagtttcaatgatccagactgtcagtcaccccatccagccacatcctcatctggaccagtttctgaccacccaatcagtttcaatgatccagactgtcagtcaccccatccagccacatcctcatctggaccagtttctgaccacccaatcagtttcaatgatccaaactgtcagtcaccccacccagcctcatctggaccagtttctgacgacccaatcagtttcaatgatccagactgtcagtcaccccatccagcctcatcctcatctggacccgtttctgaccaaccacccaatcagtttcaatgatccagactgtcagtcaccccatccagcctcagcctcatcctcatctggacccgtttctgaccaaccacccaatcagtttcaatgatccagactgtcagtcaccccatccagcctcagcctcatcctcgtctggacccgtttctgacgacctaatcagtttcaatgatccagactgtcagtcaccccatccagcctcatctggaccagtttccgacgacccaatctgtttcaatgatctggactgtcagtcaccccatccagcctcatcccagctcttaactccttctgcatagttcagtttcctttctggcaactaattcccaatttcctagaaaaccctgattttctgatttaacactgattcgaatccactttaaaccaaaggaaacaggccgggcgtggtggctcacgcctataatcccagcactctgggaggccgaagcaggtggatcacctgaggacaggagttcaagaccagcctggccaacatggtgaaatcccatctctactaaaagtacaaaaaaaaaaaaaaattagctgggtagctgggtgtagtggcacatgcctatgatcccagctactcgggaggctgaggcagaagaatcgcttgaactcgggaggcggaggttgcagtgagctgagatcgcgccattgcacaccagcctgcgtgacagagcaagactctgtctccaaaaaaaaaaaaaaaaaaaaaaaaaaaaaaaaatctgggatttcccacatatgaatatgaatccaaattttgaaactccgtctaaaaaaaaaaaacaaacaccaaaggaaatgctacaatgctgaaaattgaattaaattggagatggaaattagattactttaggaaaaccttttgagtactctgtaaacattggacaatagcaagaaaatggattttaaaccctgcatgggttccttaatcactcagaatagtataatcttgctttgattaccagtcacgacaaaaaggtgagcaaaggccataaaacatgcagtttttggaaagacaatggcacttgaagatttcctggagttggccaaagcttaagatatctctaagaattgtaaagcttaatacacatctgttattaagaagggaaacgacaggggacccctgcttaccgctgagctgtgcagaagctcatgtgtctatgcagtccttacaatcacacagaccttcattaaggacaatgagtgtgcctagagagcagcatgaatgacacatggatgaagattccatgataggaaagagcttcacattccagctttactagatcacaaagcactccctttaccaggccttactttgtgcatctctgaaacatctgaaaaacacttttctgtgaaatgctaggctgtagggagtgagcacttttggataccttacagtgatctctagtagaatttggcatctttcttctattaactgactgcttcaactgcatctttaaagacacttgcctatttttgtcccttgagcctctctctggtgttggatgctttgtgtgagtttgccttttgaagttcccatctttgggattcttcctctgtccatttagcactttgtctggaggggaggatgtagcgcgtaagtgatactcatctggggatcctttttgccggtttggcaccatttgctctttatccacctccttctgaagttgtaatgccaataacctgtcctgttcttcttgtttatgtctctcaaacagtagatgctccaaatctatcagtttttgggtaaagtttatttctgtttcctcttgatctggggaagattcgggggacacttttcttctttttgcagaaaagcatggatccttgactgcttcaaaggaagattcttggttttttcttttggaaatctccttactgatcagtaggcacgactcttcattttctgtctcacctgtgttgtttccatttgtctgtgtcacccctgatgtgggggcgcacccactttctgttctgccacaaggcataactgcagtttctttcgagtagggaactctggttttaggtcgctcgtgacttaagacacataactctttcccatgattgcttggtcttgttttgacgtttccttcatggtaccattcggcaccacaggcacataaccatggcataggggactctattgaagaatctgcaccttgttctccaactccaagggatatctgtggagaaagtgtcggcatatcttctatttctgtgtcttgccctgttgggcttttcctatcactactgtcaatgtcctgtagaaaacagaaaaagactgagtgaaccaggggaaaatatcaaatcataagatgtaagtctaattacactgatactacagctggactgtcactatacattattattactaataaggtatatatttctttctttcttttctttttttttcagagtcttgctctgtcgcccaggctggagtgcagtggcgcggtctcagctcactgcaaccttcacctcccaggttcaagtgattctcctgcctcagcctcccaaataggtgtatatttattcttaatagtatttttatttcatgggcaaatttagattaagctattacttcattttcactcccatgaaaacctacagattaaaacccacagactagattccaaatatggccaatagctggtatcaggacctgaccttctttcaccttacaaaggtctgccagcataggggtttttaactcttttctctaccgtggaccctccttttggcatttaggtgaagcttacagaccacttctgagaataatgtttttaactaaaaaattaagatatacagtagctttacaaaaggaacaatttatgttgtaaacacaatcattaaaaggttcaaaaaaatgtgaggtaataatgtgcatctataatacagtaaataataggatctaccagccagtctaataactcataatacccaattatctgtgtcacccctgatgtagtacacccactctctgttttgccacaaggcacaactgcagtctaataccaatgtagagataagtataaatgatatttaaagatatctgtaacatggctgggcacggtggctcatgcctgtaatcacagcacttccggaggctgaggcggacagctcacctgaggtcaggagtttgagaccagcctggccaacatgatgaaaccccatctctactaaaaatacaaaaattagccgggcgtgggggtataagcctgtagtcccagctaccagggaagctgaggatgcaccgagcatccactgtactccagcctggacgatggattctctctcaaaaaataaacaaaacaaaacaaacaagcaaaaaaaaaatacctagtgtttggaagataaagcttgggacttctataagttacttctataagtaacttgactgggtgtatttctcaccaagacccctggaagctagacccattgtttgttataagaaataattgacccttacagggcatgtggtctcaaagtagttaatacactcacttgtgtggcctttttccaggctatcaccttggagctctgctgctgaggactcctgctgaacacacatgcctgatgctgccttactagcatactttttctcatcttgcaatttttttttttttttttttttgaggtggagtctcactctgtcatccaggctggagtgcaatggcgacatctcagctcactgcaacctccgccttccgggttcaagcaatactcctgcctcagcctcctgagtagcagggactacaggtatgtgccacacctggctaattttttttttttttttggtatttttagtagagatggggtttcaccacattggccaggctggtctcgaactcccaactttctgcctgcctcagcctctcaaagtgctaggattacaggcctgagccaccgtgcttggcctcccatcttgtaatattctttttttttttttttttgaaacagagtttcactcttgttgtccaggctggagggcaacggcacgatctcagctcaccgcaacctctacctcccgggttcaagcaattctcctgcctcagcctcccaagtagctgggattacaggcatgcgccaccacacccggctaattttgtatttttttgtagagatggggtttctccatgttggtcaggctgatctcgaacccctgacctcagataatccacctgcctcagtctcccaaagtgctgggattacaggcgtgagccaccgcattcagctccatcttgtaacattctaagtgaagctggtgccaggtataacctattcagttttgtgagtttggattacataggtcaaggatcagtaatctatggctcatggaccaaatccagcctcctgcctgtttttgtaaacaaagttttactggaatgcattcaagctgatgtgtttacatattatctatagatgctttcacactacaccagcgtagctgagaagctgtgacacagatcacactaactgcaaaggcgaaaatattcactctcttagagaaaaactttgctttttgtagtatgtttatttaaaaaattgtagtttcctttggagaaaaagtgctttttctctaggtgagcctaagaggactcagacagggtgtttgattaactataggggcttttgttaaaaggtagaaaactatggatagcactaatctacagcattaatgaaccagcaaaactcagaacatcttcagtatcaacataccttagatacggagtctttcctgacttcttgtacagcttcagagtgtgaggctgacccaaactgagatttcggtgtcaaatacctaaaagaaaagtttaccaaagtttcaatgctttcaaagacagatggtatgtacccaacataataaagctatttataccgaaggttgtctggtttgctgcttggctgttttatcagagtgtatctcatttccgtgcttcagatattttggtcaattccaggacaaaacttaaatgattgagtattgatattttagtgaaaaacagaaaaggaagtaaaagtcaaatctaaatattttttcttttttttttttttttgagatagagtctcgctctgtcacccaggctggagtgcagtggtgtgatctccgctcactgcaagctccgcctcccgagttcacgccattctcctgcctcagcctcccaagtagctgggactacaggcgcccaccaccacgcccggctaatattttgtatttttagtagagacgaggtttcaccgtgttagccaggatggtctcgatctcctgacctcgtgatccgcctgccttggcctcccaaagtgctgggattacaggcgtgagccactgagcccggctaaatatttttttttcttttcttttttttgagacggagtctccctctgtcgcccaggctggagtgcagtggcgcgatctcagctcactgcaacctccgcctcccgggtttaagcgatttttctgccttagcctcctgagtagctgggattacaggcgcccgccaccacgcccggctaatttttgtatttttagtagagacgggtttcaccatgttggtcaggctggtctcgaactcctgacgctcaggtgatccgcctgtctcagcctcccaaagtgctgggattacagccgtgagccactgcgcccagcgtaaatatttcttaattcttgaaaaaagcttaaaaaagcagatagcatcaaaacaatgcaagactctatagtcttcccaaaagtaatgaaaatgatgctttaaactaggagaaaggatatgttagtttcttctttatgctggaaatgttggctgttcacgacattttaaatctctactattgggaaaaagtccatgattaaattccttactattctggtatagagatgttatcatacatacttttatatcaactctcttcttttttttttttttctgagacggagtcttgctctgtcacccaggctggagtgcattggtgcaatctcggctcactgcaaccccgcctcccaggttcaagtgattctcctgcctcagcctcctgagtagttgggattacaggcatgtgccaccacgtccagctaatttttgtatttttagtagagacggggtttcaccatgttggccaggctggtctcgaagtcctgacctcaggtgatccgcctgcttcggcctcccaaagtgctgggataacatgcgtgagccaccgtgcctggccctcaactctcttcttagaaacacatatctttacatttctttctttttttttgagacagagtctcactctgtcgccaggctggagtgccgtgacatgatcttggctcactgcaacctccgcctcccgggttcaagtgattctcctgcctcagcctcctgagtagctgggactacaggcacacgccaccatgccctgctaatttttgtatttttaatagagacagggtttcaccacgttggcctggatggtctcaatctcttgacctcaggtgatccgcctgcctcggcctccctaagtgttgggattacaggcgtgagccactgcacctggtcatatctttacatttctaagaatcttcaatataacaggctgtttgccactgaaaacactacggttttaatagaatggaaaatgttataaaagaacggggaatagaaaaggcaggctacaagatggtaggtatagtttaaaaattgtaaaatatccaaacatgcatataactatgtttacaaatggcagaaatttcccaaaatgttggttgtctccaaatggtggaaactttgggtgattttcaaagagcagctagccatggcttttagaattagagaaaaaaagtgactataaataacagacaaatccataagttacactgtgtcaaaagcaccaacaagtagcatatggaacaatcaaacctaaacaaagatctcatataaagaactaatgaatattccttatgggcaaacaagagtacctaacccatatatttagttatatcaatctatatatttactctgttaactttgaagaacaagaaccaaattttcagttgaaaagaagcttagtctcatttagtttctttaggctgaagaattctttctgtcaatgctgatgcgggaccactacttacgaagcataccagtaccaaagtatcactgttataacagttgttttgacgttcataagcagagaacagaatgttattacttatccaacacaatcactgaagattcattaactctcttggatattccttatttataataaccaagtaatatatgaatacatgctcattctgaaaataagcagaactggccgtggtggttcatgcctgtaattctaacactttgggaggctgaggtgggaggatcgtttgaggccaggagtccgaaaactggacaacacagcaagacccatctctacaaaaaattaaaaagaaaaattagctggacataatggtgtgtgcctatagtcccagctactctgaaggctgaggtgggaggatcgcttgagcccaagagtttgaggctgcagtgagctattttcttgccactgtggcctgggtaacagtgagaccctgtctcttaaacaaaacagaaatacaggaaatatatgtcatcaaccctttcccttcccatgttttaagaacttttttttttcttttttccttgagtctgaatttttgggatccattcccatttgcttccttttatgttttaaattaagtttagcctaaagctgcctccttacgtattttaagttcagcccaaagatttctctgtatatagtgaactacagcctaaagggaggtgtgaacagcctgtaaactactcttgtgccagtcaccaagctttggccaaagggggccaactgttcaaatcatgttcaaataaggcaaatgccaaactgtaaccactctggctgtctctgcccctcatttctgctttccatacatcacgttcccttttctgtctgttaatcttcttccgacatgtggctccacgggagtcgctctcggcctactctggctcgagaggctgcccaatttgtgaattgtcctttgctcaattaaactctgttaatttgtctaaggttctccttttaacatatgtaaccaattttttaaaaatatgatttctatgaaatacacactctttttgattttgtttattttagttattttattttttgggggacagagtctcactctatcgcccagactgaagtacaatggcacaatctctgctcactgcaacctctgcctcccgggtttaagcaactctcctgcctcagcctcccaagtagctgggattacaggcatgcaccaccatgcccagcgaatttttgtatttttggtagagacaggctgatctcgaatgcctgacctcagaagtattgtatttttggtagagacaggacagccaggctggtcttgaactcctgacctcaggtgatccacccacctcggcttcccaaagtgttaggattacaggtgtgagccaccgcacctggccattattttatttatttttttttgagacggcgtctcactctattgcccaggttggagtgcagtggtgcagtctcagctcactgcaacctccacctcctgagttttaagcaattctctctgcctcagcctcccgagtagctgggattacaggtgctcgccaccacacccggctaatttttgtatttttagtagagatggggtttcgccatgttggccaggctggtcttgaactcctgacctcaggtgatccacccgcctcggcctcccaaagtgctgggattacaggtgtgagccaccgtgcctggcttcattattttttaaggcagggtcttgctgtcaccaaggctgaagtgcagtagcaccatcatagctcacggcagccttgacctcccaggttcacgtgatcctgccacctcagcctcccaaacatctgagaccacaggcacaccacgcccggctaatttttgttattttttgtagagacagggtttccgcatgttgcccaggctggtctcaaactcctaggctcaagtgatccacctgccttggcctcccaaagtgctgggattgcaggtatgagccaacacacccagcctcacgcttttttttttgagacggactatcgcccaggctggagtgcagtggtgtgacctcggctcactgcaacctccgcctcccaggttcaagcaattctcctggctcagcctccccagtagcgggattacaggcgtccgccaccacgcctggctaatttttttgtatttttagtagaaacggggtttcaccatgttggccaggctggttttgaactcctgacctcaagtgatctgcctgcctcaccctcccaaagtgctaggattacacgcataagctactgcgcccggcttgtgatttgcttttttcactaatgtcttaagatctttccaagtctgcctcatgaaaacaaagtttatgagagaacagtcatacaatacatgtaagaatcacagtacagcacggtcacggggagggggacactgactggaaagggaaagggcacaagcaaacctttgtaaatattccgtcttcatctggtgggtggtttatacacacacaaaaattcaccagaaagtatacttaggattggtgcaccgtctttttaaattttttactttttcttttttaccctgtcttatggtgccgaagactggtgcactttaaaatatatgtttgctgctctgtggtccattaaaaacaaaacaaaaaaatgtgttattcttctaaaaagtttaaaaatctgtattaccatgaaagcccatatgcttattacttggttgaagggaaaagaaatcattggtttgaaagtctcctatggggcctcgtcatctcccacctcatactatcctgagtttcttatatcttactttttaaaacagatttgccacacttttgcatctctaaacactttattgattagtattgtgtgattctgagcgagactccgtctcaaaagaaaaatttgaaaagttggaattctgattcgaattgcactgactctatagatcagtctgaggagatctgaccattttgtagtattaggcatcttctaacccatgaatattgtatatttaatataatacaattttctccacgggtcgtacagatttttatttttctgagacatggtcttgtctgttgcccaggctggagtgcagtggtaaaatcacagctcactgcagccgtaacctcccaggctcaagtgatcctcctgcctcagccacctgagcagctgggactacaggtgtgcatcatcatgcctggttaattttttaatttttttttaagagatagggtctccctgtgcagctcgggctcgtcttgaactcctgggctcaagcaatcctctcgcctcagtctcccgaagtgctgggattataggcatgagccaccatgcttgcctcagattttaacacatttatttttaagtacttttattttctgatactactatcgacagagtatttttaaagttacattttacaattgactttttgtacagattttatatctggcaaccttgctaaactcttcattctaaaaatgtacctctgactttttgggttttctacatagataattataccgcctctgaagaatgatagctgctttttccttcctttccaggctgatatgttttatctccttttattgtgttactgtgcagactaaactctccagcatgagtctgaatgcaggtggagagtagcaggccacccttgcgtattcctgaccttacaaggggaatggcggggcgtggcggctcactcctgtaatccaggcaccttgggaggcccaggcgggaggatcacttgtacccaggagtttgaggttgcagtgggccatgatcgcaccactgcgctctagcctgggtgacagggcaagaaagactgtctggaaaaaaaaaaaaaggaaataatttcgatgttccactatgaagtatgatatgtgatgtaagattttggtagatatccttcaacaggttaagaaagtttctttctgttaccacttcattaagaattatcatctcgtgtatttcatatttatacagctaattgaataacttacagtgattcattttctaccattaaaccagcaatgtattcctggaattgtctttttaaatacgttttcagctgcgtttttttttttttttttttttttttttgagatatgatcatagctcactgcagcttcgacctcttgggctcaagcaattctcccacctcagcctcccaagtggctggggttacaggcatgtgccactgcatttggctaatttttttattttgtgtagagacagggtcttactatgttgcccaggctggtcttgaactcctcctggcctcaagcaatcctaccacctcagacctcagcctcccaaagtgctgggattataggcatgagccactgtccctggcttttttttttttttttttttagagacaggatcttgctatgctgtccaagctggtcccaaactcaaactccctgggcttaagcaatcctcctgcctcagcctcccatgtagctgggattacaggtacgtgccacaacacctggctgccctttcttcttttctgatacggcacgtaaagccttctaaataccactttagccacataccagttttcatgcatattttcagttctgtatttccaacaaaatttactctttaatcaacaagttgtttagaaatttttcttaattttaaaactatataatcctgttattcatttttaaacttttgaattgaggtgtaattcacataaaatggaatgccacattttgtttacccattcatttgttaatggacatttgggttgtttctacctttcggttatttgaataatgttgacacaaatattcatgtacaagtatttgtttgaatacctgctttcaattcttttgggtacatacctaggagtggaattgctgggtcatatgctaattccgtttaacttttcaaggaatcaccaactgttttctgcagccacgataccactttacattcctaccaagcaatgcgcaaggattccaatttctccacatctttgtcaacacttattattttccctttttgtggattatagccatcctaatgggtatgaaatgctatatcactgtggttttgatatgcatttccctaataactaatgatgttaaacatattttcgtgtacttattggccacttgtacatcatgggaaaaatgtctactcaagtccctttgtccagtttttaattatttgtcttctgttgttgagttataagagttttcatatattctagaaaacagactttatctgtttttaatattgttacaactttaatccatcagtttctcaatttttgcttttaaatccttagtttttcttgtatctctggtaattttttatttttatgtatttcaaagtatatatttagatatataaagattcatgagttatagccttaaacagcatattgtatcaatatgaaatacttctgcattttagcggttttctcatttttactttgcacattatgagtactggcgacactgatattgtcacatctttttttttttttaatagtacctccctcatttaacattctcttctcctaagcttcctcccacctcaaatacaaaatttcaacaaatcttggaaggagatgagttacctgcacatatttcctcagttgaaccagaagtccttatgtatttttcaagtctagactgtggtttttaaacttttccaactgtgagttaccatgggaaagctgatgtttgcgtaaagccaccaactccacctggcacctgaccctggaggggtgttgtggtgaaactcaatcacgccacctttgtctacctgactcatgcattttgtgtaatagagaagaaatgacaaattgtaaactctttcagtgaagataagcctatctgggacccatttttttcatctgaatttaaaccaagagaaagaggaatccaatggttcactttgagaaaactggaaatcctgaggcagtaagataaaagtatgaatctgccacagtaagtggctgagtgagaagccaagaggaagctgtgtgagtagctctctccttttcaatttacctcaacctcagactattttcatacaaagttcacggaccaaactttgagaatcagtagtagtctatatgaacagaaaacactggcatacagtaggaggtcaacaaataattcatagtcatgttcacttacttctgaatatctccagtgtttctttgtttgttcttacttttcttttcagacttgggtgtaactggatcagattttctggaattcaagggagaagccgagatacttccctcacagaaattgttcttcaacaatagaaaaagcataacagacattatgagagagaactttatgataaaataagctattaatttgactaattcagaaatccatagcatttttcagaaattatagttatatttaaattctgtacatctcttgaagaatattgaccatgcaaaaatcagaataaactatgttcatccaagttggtctaaattaattacatttttactgtacatcaagcacaaaataaggcataatactaacctcattagctgataattcctgttgatctttctttcctttttttttttttttttgagacgcagtctcgctctgttgcccaggctggagtgcagtggcgcgatctcggctcactgcaagctccacccccgcaggttcatgccattctcctgcctcagcctcctgagtagctgggactaccggcgccctccaccatgcccggctaattttttgtattttttttagtagagatggggtttcactgtgttagccaggatggtctcgatttcctgacctcatgatctgcctgcctcggcctcccaaagtgctgggattacaggcatgaggcaccgcgcccggccttttttttttttttttttttttttttaagacagggtctcactctgtcgccgaggctggagtgcagtgtagcaatcatggctccttgcaaccttgacctcccaggttcaagtgatcctcccaccttcacctcccaagtagctaggactacaggcatgagccaccaggcttggttaggtgggttgtttttgttttattttgagacagagtcttgctctgtcatccaggctggactgcagtggagtgatcatagctcactgtagcctcaacctcctgggctcaggcaatcctcccatcttagcttctcgagtagctaggacacaggcatgtgccaccatgcccagctacttttttttaaatgctttgtaaagatgaggtctcactatgttgcccaggctggtctccaactattggaatcaagtgattcccccaccacagccttccaaagtgttcggattataggtctgtgccactgtgcccagcctgttgatttttctaataaatacttttatataattacttttatctatatggacatattcagagagctgtggatatacccaaaagaatagttttatgtaataatattttagttctggactttaagggcgtattaataaaaatcacaaatatttacttgctgtaccagtctcgtaagtttcttactaccctaatggaaaagttcatatatggtgatggtgaatatttggccttaaaccaccaaactttcataaataaatagaaaattattctaggttgggcatggtggttcatgcctgtaatcccagcactttgggaggctgaggtgggtggatcacatgaggccaggagttcaagaccagcctggccaacatggtgaaaccccatcggcactaaaaatacaaaaattaacaggatgtggtggcggcacctgtaatcccagatactctggaggctgaggcaggagcatcgcttgaaccgggagttgaggttgcactactgcactccagcctgggtgacagagtgagactcttgtctcaaaaaaaaaaaaagttaaaaaaattattctacagtatcaataaatctactcttataataccatgggaaaactagatatacttcttccctattccatttattattccattggtcaatgacttttatttagtttcctgattgtgtatttctaaagcgattctacttaaaaaagacacataaaaaggggcatataacccaaaatttgggtacattattattaatggtaggcctctcaaaaaagaaaaaaattcccaattctgcgtatactcattttgctaagtgtatatacatatatatttttttattctattgaacttcccatgattcaatggtaagtgtatgttaagatattcgttgtttgaaagctgaagaattgttttcacaggctctcaaacctgaatgtttcacacttccctacatgcctctgaagattgtattccctaggtcccatccctagagactctgacttaatagatttggagtaaatatgagagtttgtatttcaacagcattcccaggttactctgccaggctcgttcaaaccactgggccccacagtaccctctgatcttaaagtatgtgttttatcacacaccatttaattcattttcttacaggcagcaatttaactacaggaagcagaacatccaagtttaatacattatctaaaaatttaatgtgccttactttcaaaatgtgatttacatccataaaatggaatattattccactctttaaaagaattagattgactacatgtagtaatatgaaaaatctctacgatgttatcaagtggaaaaaatgtaagcagcaaaacagtgtgattgctttatataatcctttttaggtcaataaagaaaaaaagcttttttttttgagatggtcttccaggttgaagtgcagtggcgagatcagctcactgtaacctcaaactcctgggctcaagggatcctcctgcctcagcccctcccagcaggtggagctccaggcacgcaccatcacactcggctcattattaatttttctgaagaaacagggtctcactttgttgcccaggctggtctcaaactcctgggctcaagcgatcctctcgcctcagcttcccaatgtactgggattacaggcccgagccatcgcaccctggcaagaaaaaagttgtaagaaactgttaatagtggttacctttggggatagagactgatataaatggaaaaggaacgggagtggagaggtggaagaaggaaaaaggaagctttcattcttcactgaatagctttcctacatataaaaaagttgttaaacaacttgcggtggctcacgccacaaacccagcactttgagacgccgaggcagatggacggcttgagcccaggagctcgacaccagttcaggaaacatggcaaagccctgtctccacaaaaaagtagccaggcatggtagtgccagcctgtagtcccagctactcgggaggttggaaggatcaccggagcccggccgtcgaggctgcagtgagtcgtgattgtgccactgcactccaacctgcatgacagagtaagacctgtctcaaaaaacaaaaaaccccaaaaacctggattagagcaaatatgtaacaatatgcaaaacaattttactttaagtaaagcaaaaatgttatcaatagcttctaattatggcaacgccatctcttctgttctttgaaaaccacagtcaaagcaatcggaatgttaatagttagctttccgtatcagcaggttccaaacactcaaatccaaccagcctggggtggaaaagacaatatttgtgggatgcagaacctggaaatacaaggagctgactcttcccatgagcgggttctgcagcagcgcataccaagggatgaccataccttagcgttccctcctaaaacttacaatatcaatgcttagctttcttgccagttcctcatcacttttcagttgttcttccatcgctcttcgccttttttctgcctgtcttttttcctcttcttcctcctctgccaacaacctctgtatgtattcttcactggctttgttttcttcttcctcgctggcccgtcgctctgccgccaccttaaaagtgattaataaagagcaatccttctctgaacgttttggtatacttgcaatatttcataacaagaatagaaaagtagaaaaagaacaaattggcagaaatttaaatgatctcaaatgaagtacaaatctggagaagtagattcctgcaagatagctgtcccatctcagcctcccaaagcactgaaattataggtgtgagcctccacacctagcctgagatgtattacaagtgaaaattatacacaaaattttgaagactaacaaaaaaagagaaaaatctctatttatgtataacttcatatgtaattaaaacataatgcttcactataaacactgctttttaggtacttttcctatttaggaacttcacagctagccctttaacctttcctcatctaaactcacactctaccacccttttactttaagctcaaaactttggggaaataaaaatatatcctggtatggattaaattaggaaaaagaagaattaaaaaattttcttcatatgtaaatgcttagggaacactatcacataagagcattaattatgtagaagtaaattacagcaaaaaacaaagcccttataaagtacattaaaattatccatattttggccaggcacagtggctcacacctataatcccagcactttgggaggccgaggcgggcggatcacaaggtcaggagatcgagaccatcctggtgaacactgtgaaaccccatctctactaaaaatacaaaaaaattagccaggcgtagtggcgggcgcctgtagtcccagctactcgggaggctgaggcaggagaatggcatgaacccgggaggtggaggttgcagtgagccgagattgcgccactgcactccagcctgggtgacagagtgagactccatctcaaaaaaaaaaaattatccatatttcaagatatactagttatataagcacaaaaaactaaattaaaatctgaaactaaaaacacagcagagaaatattccaaaaaaaaaaactatttagcacctaccttgcttatttcctcttcatattctcttctcagttccccaggtttactgagcagacgaactggctgatagtcatcagctatttcatatcaaaaaagaaaataacattataggcaacacaattttatggtaactttggtcttccattaaaacgaaaaattaaaatatacaactattaataactgcagcaatatctccttttggaattccatttttaacatttattttatttatttattttagatttattttatttattttttttgagacagagccttgctctgctgcccaggctggagtgcagtggcacagtctcggctcactgcaacctccacctcccaggttcaagcgattctcctgcctcagccttctcctgagcagctgggattacaggcatgcgccaccacacccagctaattttttatatttttggtagagtcagggtttcaccacattggccaggctggtctcgagctcctgacctcaagtgatccacccgccttggcctcccaaagtgctgcgattacaggtgtgagccaccacgcccggcctggaattccattttgtgaggccagaggtttagggttttgggtttgaaatggcatatgaatgcatatacttaacccttcctctaaactccattaaaataacagtaaaggaatttttaaaaactgtaatcctacaacagcagaaattagcagaggaggttaactgattaaaaaaaaatgttttttttttttgagacagagtcttgctctgtcacccaggctggagtgcagtggtgcaatctcagctcactgcaacctccgcctcccgggttcaaacaattattgtgcctcagtgtcctgagtagctgggatcacaggcatgcccaaccatgcccagctaatttttgtatttttaatacagaccggtttttgccatgttggccaggctggtttcgaactcctaatgtcgggcaatctgctcacctcagcctcccaaagtgctgggactacaggcgtgagccaccgtgcccggctccagttaaaaaatttttaacaaatttctagaaaatgggaaggcaatgaaatagagataattgatacagcagaaatgaaggaaaagaaatccttgaaagggaagactacagctgaggtagaattagaagggaatctgcctcctatttgcctagagagaggctcatagagtccagagtgagtaaccgtgggactgaaaacagaactcgagatttataagctgttaaatcagaatcctcgacttaccggcatttctccctggatatgggtgcaggtgcacacacgcatatttctttaaagaaacagatctagagagagccagagcagctaatgtaataggtggtgacccagagcaaagtcctctgcgatcgggcagttagggatggcaaagcacaaaggccaggtttccatcggcttgaactcaacgtctgcccatcaccaatacccttccacatacacagagcttttctcctgggcctcattctcaaacctaaaagctaatccaaggatcgtcagacatttgaaatacatctgcaggactagggaaacagtaagctatacaaagagaaaaaatcatcaccctggagttgaaagataattctgggtcagaaaataacctaaatgtgggtatgtatcctcaacaaatctgatgagaattttattctataaaacaagacactgttttataaagtgtaaaaagggaacatccaaaaaagagaacgcatctgtctgtttcaaggggcagctgctactcaactccagctgactacgactaccaggaaactcaggcctgtccgtgccatattttttgctttctcaagaaaatccagaggcggcaggggtggatggtgagagatgacttcatgggtacaatgtacattatttgggtagcagataccctaaagagccctgacttcgccactgtgcaatctatacatgtaacaaaattacccttgcaccccataaatttatccaagtaaaaagaaaaaaaaaaagaaaatccagcaatcaagatgttaatatgaaatcttccaacttaaatagtggcattggatgggtcacaaaaaacatgcacacaggattcctatggcctgcaggccagcagtttgaaaaatctgcaacagagagactaaaaaacagtgatgtaactccaaaacaattagggatgcagtatgctgaattctcatttattttagtcactaaggaggatctattcaagacaatacaatggtatacacaggagagacatatataaggctccttaaaaagtagaaggataatcagctggcttaaactgagacctagatcagcaagtcttaaagtagaatctacgaaaccctggaggtatctgagactttttttcagggaaactgcagagtcaaactattttcatttaaaaaattaaagtaagctgggagcggtggctcacgcctgtaatcccagcactttgggaggctgaggcaggcggatcatgaggtcaggagttcgagaccagcctggccaatatggtgaaaccccgtctatactaagaatacaaaaattagccaggcgtggtggcacgcacctgtagtctcagctactcgggaggctgaggcagtagaatagcttgaacccgggaggcggaggctgcagtgagccgacattgcaccactacactccagcctggacgacagagggagattccgtctcaaaacaaacaaacaaagaaacaaacaaaaaacccaaataaaacaactgacagtaggccgggcacagtggctcatgcctgtaatcacagcattttgggaggccgaggcaggtggatcacttgaggtcaagagtttgagaccagcctgaccaacacggtgaaacccgtctctaccaaaaaatacaaaaagccgggagtggtggcaggcacctgtaattccaactactcgagaggctgacacagaagaattgcttgaacccgggaggcggagcttgcagtgagccgagatcacgccactgcactccagcctgggcgacagagggaggctccgtctcacaaacaaacaaaaacacatgttcaacattactagtcattagggaagtgcaaatcctgagtacggagataccgcttcagaggacagccaacacttggttttttttttataatagtcatccattaagatatatacacacacataatggagtatgcggccaaaaaaggaaatggaatggacacgtgctagaacacgatggaccttcaagacactacgctgcgtgaaacagccagtcaccaaaggacagacactgtgtggggttccactcgtacgagacacctagagcaattaaacccgtagaggcagaaagaatggaggtcgccagcagccaggggaggggtgaatggggaattaattattgtttaatgggcagtttcaagcgtggaagatgagaaagttcagagatgaatggtggtgacggctgcacaaaaacatgaatgtacttcatgtcacgcaactgtccatttaaaaatggttaacatggcggattttatgttatgtatcttttacaataaaactggaaaaaaagtaaatcactttacacattagatacaataaaatagtagctaagaggctgggcacagtggctcatgcctgtaatcccagcactttggaaggctgaggcaggaggaccacttgagctcaggctatcaagaccagcctgggcaacatagcaagaccccatctttgttcaaaaaaattttttttaagtagctaatttaggaaaacaataataagacagatgtattatactagaaagcaaaacatatcattaagcagaattaaactaagcatgtgtggtactgacacagctactgataaagagatagttaaaaaataaaaagcccaggcaaggtgccatggctcatgcctgtaatcccggcactttgggaggtggaggcaggcggatcacttgaggtcaggagttcaaaaccagcctggccaacaaggcaaataaccctatgtctactaaaaatacaaaaattagccacgtgtggtggtgcacgcctgtaatcccagctactcaagaggctgagacaggagaatcgcttgaacccgagaggcagaggttgcagtgagccaagatcgcaccattgcactccagcctgggtgacagagagagactccatctcaaataaataaataaataaataaataaaataaataaatagccccaaattgctctggaaaataagcatatgattagtgaaatagtacgtatatcaatgtggctgtattactaccaagtagtgtggctattaagtggcaatcaagggcagggggagttaagatgcctacctcatacaatactcgaattcaaggtggattaaaaaatggaaaaaaacaaaactataaacgactaagaagaacatatgagataaattccaaaacaattaaaacttccatgtgatgaaagacatcacaaagttaaaaacaaactagaagttatttgcaaatacataaatcaccagagaattagtgtccagaatataactagaacttccacagatcaattaaaaaccacaacaggcaaaggaaaggcacgtgcgatttacagaagatgcccaactacagcaagcagagagctgaacttttgttaaaccgtggaatgacagatttttaaagtttacttatttctacataaactgaatctaaattaagatcagtgagttattcaactgcagacacaagttaaaattgtcttcatttgcctttttcttttgtttttggaaacaagatctcactcttgcccaggctggagttcagtggcgggatcatagctcactgcagcctccaaccccttggctgaagcgattctcctgccctagcctcctgaagcactgggataacaggtgtgagccactgcatccagtccatttgctatttctttttcttctttgacggagtttcgctcttgttgcccaggctggagtacaatggcgcaatctcaggtaactgcagcctccacctcccgggttcaagcaattctcctgcctcagcctcctgagtagctgggattacaggcatgtcccaccacgcccagctaattttttgtaattttagtagagacgggggttttaccatgttggccaggctggtcttgaactcctgacctcaggtgatccacctgccttccaaagtgccaggattacaggtgtgagccaccgtgcccagccttccatttgctatttctttctttttttaaatttatttttttttttttttgagacagagtctcactttgtcactcaggctgcagtgcagtggtgcaatctcagctcactgcagtgtccacctcccaggctcaagcaatgctactgcctgagcctcccatgtagctgagactacaggcgcccaccaccacacccggctaatttttgtattttttgtagacggttttgccctattggccaggctggtctcacactctcaggctcaagcgatttgcctgccttgaactctcaagtactgagattacaggtgtgagcccccgcacctggcctgtttgctatttcttaaacaactctaattttataagaaatttgaatatctcagttttatagtcttaaagtgactatacaatttttgccatctgttggaaacaactctcgacactcttcagttctggttaactctaaaatttctgctgaaacccacttcggttaaacattcctactctactcgatattttgcttcttcgcagcaagtggtcttcctaggcggccaggactcatttaaggaaatatgtccccatgctttttattttattttgaaggaaaaattcaagttagttaaagacctgaatgtataatactggatgaaaaataaaaataaataataagccttaacttgaacagttgagctgttcataaaactgccctcccatcactgaactagactgcagctccatgtaaatggcagtttccttctcccaattaaatgtgcattcctgggctgggcacagggtacaaaataaagagatagttaaaaaataaaaagcccaaagttgctctggaaaataagcatatgatttgtgaagcagtatgtacatcagtgtggctggatcatcaccaagtagtgtggctataaatggcaatcaggggcaaagtgctcacacctgtgatcccagcactttgcgaggatgaggcaggagtatcacttgagctcaggagttcaagaccagcctcggtaacatagtgagaccctatctctacaaaaaataaaaaaattagcctggcgtagtggtgtgtgcctgtggtcccagctactcaggaggttgaggtgggaggattgcttgagcccgggcggtggagggtacagtgagccaagatcgctccctggcattccagcctgggcgactaagtgagaccctgtctcgaaaataaaataacataaactaaatttgcactttctgcctcaatatttattttgaaaattttcaaatctacagaaattgcaaaaatagtatgataaacccccgtttaacctgcatttagattcatgaagtttttaaactgccacattgcctttcgtgtgtgtgtgtgtgtattttctgaaccatttgaaagttgcatgatcataacccttcaccaaatccttacgtgtccacctcataagagatgctgtccttatctcttgatttgatatacaatgatcaagttcaagaaaattaacattgatatattacccatcatatcaatgataaaaatttcaccaactatccccatgtctttaataacaacctttgtcctaatccatgttctaatccagggtcatgcactgcatttagctgtcattctcttttaatctccctttcaactagaatgattcctaaggctttgccttcatgacactgacatttttgaggtactaacaactacgttttgtagaatttcaatttgggtttttgttttctcacagttagattcaggttatgccttatactcgtcctatcaggaggaccgcaatgtttgtttgttccatggataacgttaactgtgatcacttcattactgtggtaacaggcttctcgactgtatccttcaccctttgtaattaataagcaatctgtaagatgatattttcagactatatgagtcctccgttctccggcaaattttcaagcagggattttggcatccgtttgtaattcttgcctgcatcaatttttacagtgacagtcgcaaacagaaaggaaatttagacattctaaggctgattcttccctactataggattcttttttgagaaatccaaatgtaaaacacacctgtctccgtcacactaattcactttcaaatacttcattttttaaagctatctcatatgtgctttcttacaaccttccttccataaattaaaaatacataaagtaaatgagtagattcactttatgtattatgtgttaacaaagttaacacagaaacaccaattatatttttataaattatcaatgaacaatactgaaaattttttaaaatttacttaaaacagtctcaaaagccataatataattagggataaatattagtttcttagggccaccatagaaaagtaccacaaattgcgtgacttgaaaatacagcaatttattttctcacagttctggctaaaagtccaaaataaatgtgtcagcagggccatgacacttttcaaacttgtaggggatccttccttgcctcttccttgcttctgacagtatgctgataaccttagacgttccttgggttgtaaatacatcactccagtcctccagcctcacgtggtactctgtgtctttacatcatcttccttctgtgcgtgtctgtctctgtgtccaaatttctcctttttataaggaaaccagtcataatggattagggcccattctaatgaccttattttaacttcattactgaaaaaaattgaaggtgacctacacaaacagagaaatatactattttcatggatacaaggactctgttgctgtttggatgtcaattctccccaaattgttctattaagttcaatgcaaccccaatcaaactcctaacaggctgttagtagaaactggtaagttgattgaaaaatttaaataggctgggtgtggcggttcaggcctgtaattccagcacttcaggaggctgagacgggaggactgcttgaggtgagctgttcaagaccagcctgggcagcatagcaaaaccccgtctctacatacaaagaataaatatacggaggacgggcacgatggctcacgcctgtaatcccagcactttggaaggtcgaggcaggagtatcatctgaggtcaagagttcgagaccagcctggccaatgtggtgaaactcccgtctctattaaaaatacaaaaattagccaggcatggtggtacatgcctgtaatcgcagctactcaggaggctgaggaaggagaactgcttgaacctgggaggcagaggatgtagtgagctgagatcacgccactgcactccagcctaggcaacagagcaagactctgtctcaaaaagaaaaaaaaagatttactctaaagtcacagtaatcaagacagtgtgacactaatattagaatcaacggatcaatgaaatagaatagacccacattattttttttaaaaagtcttttcaacaaaaggtacagaaataactgatacccatatgggaaaaagttaacctcaaccccctaacttatacaatattcaaaattaatttgaaatggatcaaagacctaaacataaaagttaaaactggccagacacagtggctcacacctgtaatcctcgcactttgggaggccaaggcaggcggatcacgaggtcaggacttcaagaccagcctggccaacatggtgaagccccatctctacaaaaaatacaaaaattagccaggcatggtggtgcgtgcctgtagtcccagctactcaggaggctgagggaggagaatcgcttgaacctgggaggtggaggttgcagtgagccatcacgccactgcactccagcctgggcgacacaacgaaattcagtctccaaaaaaaaaaggtaaaactataaatcttttagaaaaaaaaatagcaatatcttagcctgaaggtagctaaaggtttcttagaccataaaaagcaataaactataaaaggaaaaatttatgagacttcatgaaaattaagaatttcagctcgtcaaaacaattaagaatatctggcaaagtaccagtattcaaaatacataaataatgtctacaactgaatataaacaatttaggggaaaaagaattaaacagacactttacaatggaagagggcaaaactgtcaataagcacatgaaaaagaacactatcattagttacctggaaattgaaattaaaacaagatactactatcaatacaaatcaactggaatggttaaatctaaaaagacagataacatcaaaagttggtaagatgtacggcaaccagaacctgtatgctgttggtgggattacaaaatgacacaaccactttcgaaaaagatctggtagtttcttctttctttttttgagatggagtctcactctgtcaccgaggctagagtgcagtggcgcgatctaggctcactgcaacctctgcctcctgggttcaagcaattctctgcctcagcctcccgagtggctggtattacaggtgcccgccaccacacccggctaatttttgtatttttagtagatggggtttcagcatcttggccaggctggtcttgaactcctgaccttgtgatccacccgcctcggcctcccaaagtgcgtgagccaccatgcctggcaggtagtttcttataaaaatatgtacctattctacgttgcgtaattccagctcctaagtatttaaccaaaaaaaccctgaaaacataaggccacacatacacacacagagacacaaaaacttgcacaagaaccttctcagcaactttattcataatatccaaaactgcaagcaactgaagcactgtatcagtggagaatggccaatcatatacagcatagtcaatggtggaataatacttaaaaaacgaatatctacacaagaataaatcttgaggccaggcgcggtggctcatgcctgtaatcccagcactttgggaggccgaggcgggtggatcacctgaggtcaggagttcgacaccaggctgggcaacatggtgaaaccccatctctactaaaaatacaaaaattagccaggcatggtggtgcgtgcctgtaatcccagctacttaggaggctgaggcaggagaatcacttgaacccaggagacggaggttgcagtgagccgagatcctgtcactgcattccagactgggtgacagaacaagactgtctcaaaaaaaaaaaaagaataaatcttgaaccttatgctgaataaccccccaaaagatatgcttaagtcctaactcccagtaactaagaatgtggtcttaactggaaacaggttgttacagatataatggagttcatacaaagagtacagagcctttaatccaatataactagtgtcctggtaaaaaaaaaagagagagacacagaggagacggccatgtaaagacagacacaccgggaaactctacgtgccaatggaggcagagactggagtgactcagctgcaaaccaggaacaccatggattccagccacaccagaagctaaggagaagggcacggaacagattctctcccagagccttcaatgtacatgtccctgctccctgctagcatcttgggtttggagttctactcttcagaactgagggagaataaatttctgctaagttcgtggtactttgttacagtagccctaggaaataaaaagaattccatttatatgaagttccagaacagaaaaaactcatctatggtggataaaaactaaaacagcccggacgcggtggctcacgcttgtaatcccagcacttttggaggccaagacaggtggatcacgaggtcaagagattgagaccatcctgaccaacacagcaaaaccccatctctactaacaatacaaaaattagttgggtgtggtgtcgcatgcctgtaatcccagctactcaggaggctgaggcaggagaatgcccacaactcaaaaaaacaacctgattaaatgacaggcaaagttgtggctttttctgggttttgggagaaaaacagaaacaaaaagaatgaatgagcacaggatttgaatagatatttcatatttttccgaagatgatatacaaatggccaataaatgcatgcaaagatgctcgccatccttagtcattggggacatgcaaataaaaaccacaatgggataccacctcatactcaccaggatggctactatcaaaacccagaaaatagcaagtgttggcgagggtgcagagaaactggacacccacgcactgttggtgggaatgtaaaacggtacagtcactgtggaaaacagtatggcggtttccaaaaccaatcacacatagaattaccataggatctagaaattccacttccaggtatacacccaaaagaatagaaaacaggcccctgaacagacatttgtacacccaagttcacaccagcattatttctaatagccgagaagtggaagcaagccaagtgtccactgacagaggaacagatttcttttaatgtagcatatacatacactggaacattattcagcctggaaaagaagggaatgctgtcacatgcagtatggatgaacctggaaaacattacgctaggtaaaacaggccagacacaaaaggacaaaacctatgaaaattccacttacaggaggtacctagaagcagtcgggttcacagaaatggaaaggagaacggtggttgccaggggatagtaggagggaggaacggtgagcctcaagggtgtggaaattcagtttgggaggattaaaaagttctggagatggacggtggtgacggatgcacagcagtgtgaacggaggcgatgccactgaaccatacaattacaaacggttaaaattttcctcccttctttctagtcaaaaacatttttaagtggttaaaatggtaatcttgctatattttaccacaattttttttttttgaaacggagtctcgctctgtctcccaggctggagtgcggtggcgtgatctcggctcactgcaagctccgcctcccgggttcacgccattctccggcctcagcctcccgagtagctgggactacaggcgcgtgccaacatgcccggctaattttttgtatttttagtagagagggggtttcaccgtgttagccaggatggtctcgatctcctgacctcgtgatccgcccgcctcggcctcccaaagtgctgggattacaggcgtgagccgccgcgcccggccccgcaattttttgacacacagagttaagataccagttcacatgtactagcatggcacggaaaataacaagtgttggtgaggaagtgaagaaactggaaacttcgtactctgctaatggaaatgtaaaatggtacagccactgtagaaatcaatgtggcagttcctcaaaaagctaaacacagaattaccataggatccagcaattccactcgtagatatatagacaaaagaactgaacacaggtattcaaacacatactggtacataaatgttcgtatcgccagtattcaaataacgaaaaggtgaaaaaaaccaatgtccagccaatggataaacaaaatgtaacaagtatatccgtaaaacaaattattattcagcccgaaaaatgaagtactgatccatgccacactgtacatgaacctcagaaacacgctaagtgaaataagctagacacacaagatcctatattgcatgagtcccttctatgaaatacctagaatggccagattcatagagacagaaagtggaatagaaggtgccgaggctggggggaaaggtgaaatggggagtcagtgcctcacggttagagtttatctggggtgatgaaaagttctggaaacagtggtgatggttacattgtgaatgtaattaatgctattgaattgtacttaaaaatggttaaaatgtcagtttgttatatacattttggacaatattttaaaaataacgcaatataccaaaaaccattaaattgcacacttttaaacattttactgaatttatgttacccagaccggcctcaactcctgggttcaagagatcctcccacctccgcctcccaaagcgctgggattacagctgtgagccatcgctcccggccaaccgcacacttttagtaggtgaattgtatggtctgcgagcatttgaataaagctttttcttttaactattgtttaaaaatgtttaaaatggcatttttttacaataaaataaacgtatgtttaaaaggcaggtacacatataactgtgaccaaaaaaaattagaaaaaaaaaaaaaaaaaaaaaaaaaaagacctgtccacgagagaacggagacaccatatcctaagcccagacaggaaccaccgcccggcttattgctcacattagtggaggaaagagtcaagggttcagtttggggctcctgagtctaccgggtgcagggttgagtgataaaaaagcgactttagcctcgtcgcatgattaggagaatcaagaattaaatgaatggagatgtatagataagtaaatcagaggccgggcgcggtggctcaagcctgtaatcccagcattttggcaggccgaggcgggcggatcccttgaggtcaggagtttgagatcagcctggccaacatggtgaaatcccgtctctactaaaaaacagaaaaattccccgggcgtgatggtgcacgcgtgtaaccccagctactcgggaggctgaggcaggagaatcgcttgaaaccgggaggcggaggttgcagggagccgagatcgcgccactgcactccagcctggaggacggagcgagatcctgtctcaaaaaaaaaaaaaagaaggctccagacgggcaattctttaatttttaacacaacaaacacccatcgaacacagcgcgggcattttgacaatggacaaaatcttgcccttgactttataatccatcgacatttggggacccataaaccccctaacctctgagaactatttagacaaatactagtcgggttttttggtttgtttttactttttaaatggaaaagtgatgattcaccttttcaaagacttgcggcttttggccaacaaacacgccatggtttactcacccacttcctctgattcttggccagacgctctaagcttgcactccctgggatagtgtttttgaattatcgtccacagttccacgttgacgagagaatttcttcgggtatggtaccgagtccacgacgatacccggcggcgacagaagggacagcataaactcgccttttcgacggtcgactggaagcacggtttacacagcgtgtggttacacgggagggtgacgggctccacgaggatttccatgcagatcccgcactggcactcggacagcgaggggatggcgtctttgggtagagccatttcaatatgttagtaaagccgactaaacaacgacacctgcacgaaaaagaatcctattttcggccaaccacagagagagcaaaagcagttttgtgtttcagtattatgcccagaagcgtatcagaattcggagaacaggagcatccaacacgtcttgaagcaaaaaggcgctctcagggtcaggcaaacaggaataccccggagggcggcgtctttgtccattttcaaggcaaacgtcccgccagcaaataaatgcaggttttcgtcggaggagcctggctgctccgcggcatgaacaccgcggctgcggctcccggggcagcgaggggaacgcgccaagtcctctcctcccctcacccggaaaggatgctccgctcagctcggggcagccgggccccgggacgcggctccgggaggaagcccgggctccggctgcagcataacttccgctttaccgctgctgcgggggagacgcgcgactcccgtgttcacctttcgggcgcctggcgcagtttcccagagctccgcgcccccgtccctcctacgcagccagaaaccctattcgttgcggcagcgcagcagccaccggacaagcgctagcaacgtcacaaccgcccgccaaaatcgcacttcccacccagaaaactgcccaagggcgaacgttcccggggcgggacttccggggtctgcgcgccgcccgccctccctcccagccggagacggtcccgccctggcgtcgcagccccgcctagtgcagcctgggtggagcctgacctttccctgagatttctgcgaggcctcagacacccctggtttcttggtttctgggtagaaaaagggaaacctcaaaacaaaatcaacagccaaacaaggccgggtgcggtggctcacgcctgtaatcccagcacttcgggaggccgaggcgggcggatcacctgaggtcaggagttcaagaccagcctggccaacatggtgaaacccccgtccttactaaaaatacaaaaattagctgggcattgtgacaagctcctgcaattccagctactcaggaggctgagacaggagaatcgctaaacctgggaggcagaggctgcagtgagccgagattgtgccactgcactccagcctgggggacagagcaaaattccacctcaaaaaatacaaataaataaatagataaaagaattggggtctcactgttttatccaggctggactacaactccagggttccagggattctttcgcctcagcctctggagtagctgggtctagagcttgcaactccatagccagctccggacctgcattttttgagggaatcaatcagtgtgaaggaagagaaaagaaaatcactgtgcgtgaaagcagcctttaagttgttttgaggctgctgagagcattcaggctgggtaggggatggtttccaggttgagaacaacgaggagacatcggtcgttggtagaagtctttgggaactttcatttcaatgtgggttcagaaacctgttattgtctgtgatagctcacacctgtagtcccagcactttggaaggccaaggcgggaagatcagtggagcccaggagttcaggtccagcctgggcaacatagtgagaccctgtctctacaaaaaataaaaaaattaactcggtgtgctggctcacacttatactctcagctactctggtggctgaggtgggaggatcacttgagcccaggaggtcaaggctgcagtgaacagtgatcgtaccactgcaccccagcctgggtgacagggcaagaccctgtctcaaaaaaaagaaaaaaaaaagaaacctgggactgtcatctggttgtctacagtaacagtaccttagcttggaatttcaggcttgttttttgttcgtttgtttgtttttttgagatggctcctcattctgttgcccaggttggagtgcagtggtttgatctcagcttactgcaacctccacctcctgggttcaagcgattctcatgcctcagcctcccgagtagctgcaattacaggcgcgtgccttgtaataccacgtgcattgtaataccacgcctggcaaatttttgtattcttagtagagatggggtttcaccatgttggccatgctggtctcgaactcctgacctcaggtgatccaccggccttggccttccaaagtgctgggattacaggcgtgagccactgcacctggccttcaggcttcctaatatgtccacaacctgcttttcccatcgaatctcccattattcttttaaacatgcaactatgatttattctctgtcatccaaacgttttgctttcatgacattgctttctcggttcatcctaaatgggttgctttgtggctgtgcctacttcaaacaccaatttaatgcagttgggccaggcacggtggctcatgcctgtaatcccagcactttgggaggccaaggagggcggatcacaaggtcaggagttcgagaccagcctgaccaacatgttgaaactcagtctctactaaaaatacaaaaattagctgggcatggtggcaggtgcctgtaatcccagctagtcgggaggctgaggcagaagaattgcttgaacccgggaggcagaggttgcagtgaggccagattgcaccactgcactccagcctgggttgacagagcaagactccgtctcgaaaaaaaaaaaaattaattcacttcttccagagtgcacttttatgtgcaatttaatgcactccccaccaccagtaatgccccttttctaaactcacccagtcatatattgcccagtgatactgatttttattgcagttttactattgaactcctgtattttgatttctatcttcaggtgcttatgtcttgtgtaatggatatatttcatgtacttcctcagatttccttcactttgtttgctttctgtacccataatcacttgctctttttggggctcaccagttgcatttccggaatctctggcttctcctgccacttctgaacaatgcaggagctgacttctcagaggctgctagggcctcggtaatgcatgctgggagggtgggggggtcactccccatggagtaactttcaccaattgaaaccagtggactgaccgagcacaatacttaaattcccttttcttcttccttccaaggatggtttctccagtgtgtctggagacaggcaagactgagggagtgtgcctgctgaaaaagctgctgtgtctcttgtggctcattttcaaggaggggacagcaaggtaacacatcaccatgtattacttcacatccttctctacctaacttccttccagctttcttcactctggctgtcctgaatttgtacctcccaaataaagcatcggcacttaatctttacctcgagggcaggatccacatttttaatgtttctgttatccacagtacctagtacatggcatttggtattcgataaatattataaataaatggtcaagatgtaagaatctcctttctggtataaataactatggtacttcattagagaacaaatacacattaagatacaatttataggatctcatgatgtatattttaggtgtttttgttttaatttatgaaaatagagatgaggtctcactattgttacagctcttactcccgaatttgatgagttctgagttgttgtcccatgactgagaagaatgaggtacacggacactggagagtgagtaaggcaaagtagaatttattgagtgacagaacggctcttggcagtgagaggggacccgaaggtgggttgctggccacgagcctgagtctatgggtttttgtgggctagaaatgggcaagtgcatgctgattggtctgtggctatgcttgacaaagcaccattcagaaataggcacgatagtgtagaggaccaatcgcggaagggtaggtatgtataaaataggtgaagggtaaggaccaatcaggagagagggtgccagacgagaatgggagctctcagtctggctcatggatttatccagaactcatagcttggttttcaggctttagactgtccttggcttgaaggttgagtttcaccagggacccctccctgtctgcctaggaatttacctgcctcctattgctatcactgtgttgcccaggctggtctgaaacccctgagctcaagtgatcctcctaccttggcctcctaaggtgcttggattataggcatgagccaccatgtccggccttgtttattttttaaataggtaatacattcacatggttcaaaattgaaaatgtaaaaaatggattaacagtgaaaagacttcctcttgtctttgacccctagcctcttagctttctttcctgacaactaatgttatcactgtcttgtgtatctctgcagaagaagtttatggatatgtaaactaatatgtgttatatatatatttatatatatatatttgtcaccttttttccacttagcaatgtatattggaaataaacatttgaaaacaacaatacatttggtgatcacttcatatcattacacaaagagcttcttcattcttttatatggctgcaaagaaagtatctattgtatcaatttgtcataatttatttaacatcctctcactctttgctataaaaataagactataataaattgtgcatactttttgctgtttccaagataaattactgtaggtggaatcactgggtcatagggtaacaggttagtttttgacagatggtatcaactcttcgagggatgacttttgcttttcaggggtcctaactgctttccccttctcaattacctgcacagccctcagcaaactgtcctgcagagcctggttctttaccatgttagtaattaggaacgtgacatccctgatgtacatctgcctcactttagcagtatagtgttctgccttgttaccacgtgcaataaagaaggtacaaagtgctgtgatgtctccttcttgcagcccacactcctccagtatggactcccatacaactctaacgcgcttgttcttaacttttcttctgagtacagaggctaaggttggaagacctctcaccaggtctggcagcttctcaagcacacgagtatgcaagcagataagtacttcaatgacgtagctgtataaaatattcaattccattgaagtgagcctacaaaaaatatggagagcttcttaagcggtcaaaaatattttatatagaaacagaaaatgaattcttttaggataactcaatatgaacccactaggagaaccagctgttgtaatttagaaaatatttactttagaatttaaattcaaattcaaatacttacattttatttttttttaagagacagggtctcactttgttgcccaggctgttctcaaactcctgagctcaagtgatcctgtcgcctcggcttcccagagtgctgggattaaaggcgtgagccatcatgcccagccagtactcactttagaattaatgcagataggctgggcgtggtgctcacgcctgtaatcccagcactgtgggaggacgaggtggttggatcacctgaggtcaggagtttgagaccagcctggccaacatggtgaaaccccgtctctactaaaaatacaaaaattagctgggcatggtggcgggcgcctgtaatcccagctactcgggaggctgaggcaggagaatggcgtgaacccaggaagtggagcttgcagggagccaagattgccccactgcactccagcctgggtgacagagtgagactccatctcaaaaaaaaaaaaaaaaagaaaaaaaaattaatgcaaataaggctttggcaagcaagagactttgtgatgagatgtgtactatagtgcctggcatataaagagatgctcaaattaatcttttttttttctttgagacggagtctcgctttgtcacccaggctggagtgcagtggtgagatctcggctcactgcaagctccgcctcccgggttcacgccattctcctgcctcagcctcccgagtagttgggactacaggtgcctgccaccacacccggctaatttttttttttttttttttttgtatttttagtagaggcagggtttcactgtgtcagccagggtggtctcgatctcctgacctcgtgatccgcccgcctcggcctcccaaagtgctgggattacaggtgtgagccactgtgcccggccaaattaatctttttttaaaaaaataaatgaacctaagaaaatgtaattgctttacaatccattgtgggaaacatactaagaaattcaattttgcaatgaccagtggaagctctcacaaagccacagaatcccactgatttctcaattgatactcactggagtgcccgaactgctgtccacatctcatcttgggctgcttggcttgccaaagccttactatgatgttcgaatttctgcatcaggttatccttggtgaagtctagttctttgaactgtgtttctaacgcttggagtttgtggtctactctgtaggataacagaatcaagggttagtttaggttacaggacaaaactaaggttttgatttaagctgaggctctaatacattatttacaaccattaccaaatttggataacttttttttttttacttttactttaaactatgaagggaaaatgggtagctatttgaatttgaaagtttcaacaaatggctccatttgccattccctctagccatcatccttgtcctttcattccatatattgcaaacttttgaattgtctaattatttgaattgcctgtcgtgtcttgtttttgtattataccttatactttatgtatttatttattttctaatacagagtctcactctgtcacccaaaccggagtgcagtggcacaatcactacctcccaggctcaagtgatcttcccacctcagcctcccgagtagctaggactacagttgtgtgccaccatacctggctaatttttaaaaaatattttttgtagagaccaggtattgctatgtttggctggtcttcaacacctgggctccagtgatccacctgtcttagcctcccaaagtactgggattacagccatgagccaccatgcccgggctataccttacgatttagagaatattttatgtaagcattactttggtgttcacagcaaccataaaaagtaaagcagtcatttttactattttactattaaagaaattgagtctcaagaggattgagacctaatgtcataaagttagctagtgctgagaccagtatataatctggatctcctcggcaggaaagtcaagggccttcaccctttgctcctatcttccgccagtcccctcacccatcctagtcaccaattacatgagacatctagttgctgcttgaatacattatgtggttccaagcttacatatggcttataccctattttctacccgattctaattgtccaactcttatcctttcttccagaatcagctcaaatccactgcctttttgaatccccatctacctggtgatctccttgcccccctgcgtctcgcttacaagcactgcctctgtggacccatctcccgcctcctgctttactattagggttagcctttcatgaactaaactacgttcttggagggaaggaatcagagactatttcttagatacctttatgtctgtcccccaatacccagcaaaggtcttgcacagtaataaaagtttccctgtatgattgacatctttgatgagaatgaaatgctgagttctgtaacccaaaatggggatttgagtagctccgaacagccatgatcatcagaggctgctgtggcaccagcattatgtctaattaaccacaaagactggagcaacacaattcacttgcctgagccacctagattgtccttatgagggaaacttgcctgggccacctagattgtcattatgagggaaatttgcctgggccacctagattgtctttatgagggaaacttgcctgagccacctagattgtccttatgagggaaacctgcctgggccacctagattgtctttatgagggaaacttgcctgagccacctagattgtccttatgagggaaacctgcctgggccacctagattgtccttatgagggaaacttgcctgggccacctagattgtctttatgagggaaacttgcctgcgccaagtagattgttgttatgagggaaacctgcctgggccacctagattgtccttatgagggaaacctgcctgggccacctagattgtccttatgagggaaacctgcctgagccacctagattctcattatgagggaaacctgcctgggccacctagattgtccttatgagggaaacctgcctgggccacctagattgtccttatgagggaaacctgcctgggccacctagattgtccttatgagggaaacctgcctgggccacctagattgtccttatgagggaaacctgcctgggccgcctagattgtccttatgagggaaacctgcctgggccgcctagattgtccttatgagggaaacctgcctgggccgcctagattgtccttatgagggaaacctgcctgggccgcctagattgtccttatgagggaaacctgcctgggccgcctagattgtcgttatgagggaaacctgcctgggccgcctagattgttgttatgagggaaacctgcctgggctgcctagattgtctttatgagggaaacttgcctgcgccaagtagattgttgttatgagggaaacctgcctgggccacctagattgtccttatgagggaaacttgcctgagccacctagattgttgttatgagggaaacctgcctcggccacctacattgtccttatgagggaaacttgcctgggctgcctagattgtccttatgagggaaacctgcctgggccacctagattgtcgttatgagggaaacctgcctgagccacctagattgtggttatgagggaaacttgcctgagccatgtagattgtggttatgagggaaacttgcctgggccgcctagattgtggttatgagagaaacttgcctgggccgcctagattgtcgttatgagggaaacttgcctgggccaagtagattgttgttatgagggaaacatgcctgggccacctagattgtcgttatgagggaagtgatgcgtcaacacacatgctacttctctgagcttccgtatctccagtgacctgaatacctttgtgactgcccagcattctatgcttgatcatcttttattcttggtcctaaatttctccctaggctaattcaccttcaggtactacatctctcctaagctttaaacctgtatttcctttctttttttttttttttttttttgagatggagtcttgctctgtcgccaggctggagtacagtggcacgatcctggctcactgcaacctctgtctcccaggttcaagtgattctcctgcctcagtctcccgagtagctgggattacaggcgccaccacatccggctaatttttgtatttttagtagagatggggtttcaccatgttggccaggctggtctcgaactcctgacctcaggcgatccgcccacctcggcctcccaaagttctgggattacaggcgtgagccaccgcacccggcctagagatgtattttcaatatgttttgtgcatctccacaaagatggagatgtcaaactcaactctcctaagcttaacctactaatacctcccccatcttcagaaattactatgaagaaatgttgtcactgctttacacatagataagactcagtataaaatgttcattttgtaggaatagaagcctgtgtgacctgatatgcctgtaatttctgtctacaagtcaaaaccatgtgatttgagctaggtgcagtggctcacaactgtaatcacagcagtttgggaggccaaggtgggtggatcacttgagtccaggagtttgagaccagcttgggcaacatagtgagacctcatctctacaaaaaataaaaaattagcctagtgtggtggtgtgcacacttgtggtcccagctactggggaagctgaggtatgagaattgcttcagcccaggagttcaaagctgcagtgagctgtgatcatgccactgcactcagcttgagcaacacagcaagaccctgtgtcaaaaaaaaaaaaagaaagttggccgggtgcagtggctcacgcctgtaatcccagccatttgggaggccaaggcaggtggatcatgaggtcaagagatcgagaccatcctggccaacatggtaaaaccccttctttactaaaaatacaaaaattagccgggtgtggtgatgcacacctgtagtcccagttactcaggaggctgaggcaggagaatcacttgaacctgggaggcggaggttgcagtgagctgaaatcgcgccactgcactccagcctggtgacagagtgagactctgtctcaaaaaaaaaaaaaaaaaaaaagccatttggcatactattttgtgttaacttttagacctttaagactatattgcttataggtcatctgtagtttgaaacttagggaagaagtctagcttgtcaatcagtataaaaatttacagttgcagcagttctttggaatcctctcaccaaaggacagtccgaggccgttccagataaatctcaaccaacatgcaaatctcagcgcaggctgttttgttttgttttagtacagttccctagtttcgttaatgacctcaccatccaatcaattgcttgaactagaaatctcagaataattctcaacttttttcttcccctgatttatgtctctctaacccattcctgcctctccatctccatcaaatgagtttctcatcatctttcactaggacccaagattaccgtagcctaactggacccccgttttccatttcccatccatcctccagacacattcttctaaaacacaattccgattctgtgactcaactgattacaaatggtttatgtcatcctggcttgcccagtgatatactcagaggcaaactggatctcctcagcaggaaagtcaagggccttcaccctttgctcctgtcttccaccagtcccctcacccatcctagttaccaattacacgagacatctagttgctgcttgaatacattatgtggttccaagcttacatatggcttatatgcactgtttcctcagcctagaatgccttcccatatttttctccctcataagctcctacttgcactttaagatccagcttaaatgaccctatatgaagagttcctttttctagtgtcaaaggcaaaattggttgatcctcccttcatgttcgcatagacctttaggaacatcaccattgtaaggtcagtcacattaaattgtaaatgtttttcaaacttttctctttcctacaggctgtgagctccttgagggcagaaaccacattttacttatttttgtaaatctaggatttagcatatgcatacattcaatggagttacagcacctgggagcagacttttctttattgttaatttacataggtttgggcctggaagacttaaaccactgtaatagagacggaattctttttttggacggagtcttgctctgttgccaggctggagtgcagtggcacgatctcggctcactgcaacctccacctcccgggttcaagtgattctcctgcctcagcctcccaagtagctgggactacaggcgcccgccaccatgcctgggtaatttttgtatttttagtagaggcagggtttcaccatgttcgccaggctggtctcaatctcttgaccctgtgatccgcccacctcggcctcccagtgtgctgggattacaggtgtgagccaccgcaccggccacagagacagaattctaatgagcatgtctgcagttctttatttctattcttcattcttctcttacccatcttcccagaatagcagacccatgcttgctccctccctatagccctcagcaaccttttcattgcctccttcaaggatatcagggttgtggtttcattgttcatcttctgaaggcaaaaggaaagaaaacaaaaacaaagcaaaacaaaaaaagcaataaatgtttgaatccagaattttctgcggtcttcctctcagcaacaggcagcagtagcaggagcgctcagtctacattctgcctgaaaggtcactcagtacaagaagcttttaatagcctgcagatccaaatatagtttcaaagaacttatctcgtggacacaggtgtcctggaatgcactataacatttgcctttgaaaactgaaccatagtacattaacatacagcaacaaccatgtataattaatgactgtgtacattatggtaaatgtatatacagatacattaacgtaacgtataggattaagtttgatggaaatattactgtcatattttaactgcttcattattcaattacaacctaaattaggtttgaagagtgccccagatcttttatgatgatgatatcaaagcaaaaaatctaactatcattagaaactactaaatacttgttatggctgggtatggtggctcactcctgtaatcccagcacttggggaagccaaggtgggaggattgcttgagcccaggaattcaagaccagcctgggccacagagcgagactgtctccacaaaaaatacaaaaattagccaggagtggtggtgcatgcctgtagtcccagctactcaagaggctgaagtgggaggactgcttgagcccaggagttcgaagctgcagtgagctatgatcatgccactgcactccagcccgggcaagaggataggatatatatatatatatatatatatatatatatatatatatataattatatataaaattatacatataattatatataatatataatttatatcgtatataaaatatatatataattttatataattatatatatattagattaggaattgaatataaatgtggaaataaaataggactgctgttttcatgagatttaaaatctagttgggaagaaagaatatatccttaaatagaaaatgtatatgggatgtgtgctaagtagatagagaccataaaaataatagaaggtgagagactaagtcactgaaatcttgggtccttggggagatattcaccctgaaggtggtacttggcttggccttaaaggtcaaggtctttgattatcagagaagagtgttaagggtgttacgaactggagaaattgtgtgagcaaaatcacagaggtggcaaagtaaatgatgtgttcaggaaacaatgagtaggtatgttttgagcaaaagattcatataagaaaaagaaaataaccacaccatttaaactggtaagagccatgtcacgtatttgttctttcactgaatactttattcacttattcaatatttactgagcatcatagatattaattgaatgtataaaacctacgaatggatgagcagcactattccaggcactggtaatatagtgataagtaaggcgaaatccttgtcctcaaggaacatactagcagggagacagcacataaggcttataagagaggggatgcttctagctagcttggtaaggagtttggacagatgtgagctgttggttctagaagattaatctaggctcaggtgcagtggctctcacctgtaatcccaacattttgggaggctgaggtgggtagatcacttgaggtcaggaattcgagaccagcttggccaacatggcaaaaacccatctctactaaaaatacaaaaattagctgggcatggtggcacacacctgtagtcccagctacttgggagtctgagataggagaatcgctcaaacccgggaggtggaggttgcagtgagcagaaatagcaattgcgccactgcactccagcctgggtgacacagcgagactccatcgcaaaaaaaaaaaaaaaaaaaaaaaaaaaaagattaatctagcagtgatattgtagtataatatgaaatatatttggtcttcgtccccatttcagccacaaagctcctaaaacccttggaatttcctgagtgataggagtgtctttttttattcataatgagccccttttgatcacatgtgagtttatgctaatgaggtgatttagggtggtgcaactagaatagcctccagatggggctggtcactagaaagaccaggtgattctaagttggaactttcagcccccacccaccaacctctaggaaatgaaatgagtgagctggagattaagttccataaaaattcttggacaatgaggtttgatgagcttctgggttgccaaatataaggaagcgctggtgggatggtgctggggagagggtgtggaagctctacagcaccctccaccatatcttcctctatgcatctctaacagcacccccccatacctttccctatacatatctaacagcacccccctgtgccttcccctatgcatcactaaaactgcctgttcatctgaattctatttattttattttcttgagatggactctcactctgttgcccaggctggagtgcagtggcatgatctgggctcactgcaacctctgcctcccaggttcaagcaggtctcctgcctcagctcccctagtagctgggattccaggtgtgtgccaccactattacaggagttattaaaaaattattttagtcagctagaaagggtaaaagagtcctcagtaatgctttttattttaataaaaaagcagcccccgcaaacatttcttttctaacagaaagtggctggaaaaaccagacctgcaagcattgatttgcaagtcacaggcttacatatgtaaatgctggtggctaagagccaggttcacccaatatggcagttcctgctgctttttctttgttgccacatgtgcagatatcatggcagccagccaggtagaagtaacatgtacaggcatcatggcaaccagccaggtagctgcatttgcataataaaaggctagggtgggagggccagtttttttgtgggctacgtgaatgccacacctggtcaaaccaatcccttgggctctatgcaaatcagatgccacctcctcaagcctcctgacataaccaactgctttctgctaaagggggttattccatttggagccctcctcccattgtacaggggagctgttctcttccttcttgcctactaaactttccactccttaatccactctacgtgtgtctatgttgctaattttctcggcatgtgacaaaggaccctggatgtttccccagacaatggagccatatcacgatgctcagctagtttttgtatttttagtagagacggggtttcgccatgttggccaggctggtctctaactcctgacctcaagtgatccacctgcctcagcctcccaaagtgctggagacaaaggaccctggcacaagacaaaggaccctgggtgtttccctagacaacgtagccatgtcatttttgggggctcatccggaatcccaaggtacaacattcaatggagcagtgagtagaggagcggactcaaaatctgtcctttcattccaaggctcttggtctccattttaaaatctaatcaaatcaataacaagcatccatcagccagttaaagacacggttagtgtggctgccattcttagagacttggatgtcaggcttactggggagaacatggagacccccccaatacccatgggtcactgggcacgttggccatgcttcaaatcagcttcctttcaacaaggaaacctaaccatcccgtgaggccaggaaaagttcttaagcaattgagaatttctggccagtgcacacccttgtgttattcaaatgcttctggactggactcagcctccaatagcctgcccaggtgttggtaaagggtccccagctagcctgttgcaaaatttcccttctttttctatctgcgatcactatgtctcttattttctctgtgtgtcaaatgtgagggaatttttgcagcccagggaagtaatcctgttggggaagatcaggaaatgctgtagtaaccatggatgtagttcaggatcttgtgatcttttaggaacagagggcctcccctttcccacacagtgaggtcactcgctactagtcctcgtgcgagcacgtggtatatttaagccaacagcgccacctcgtggaaatagaaatcccctctgtaagacacgttggtccactgtagcttcccaatttttccattttgcagctttctttatgctgcttctgtgaataggaaaattctgccccaacaattaggagtaaaatgtcctctgcagccaaattttagtcctgatactgtcccatcggcaggaaaatcgccattaggtccttaagtccctttaaggcacctattctgtctccaattaaaacagtacttaattagtaaggggattttaagtctggaagttaacctgaaccattttctaagggtaaatgccctagtgcgggccataatagtagccaatccagcacattccctccgttaaagaagccttgccttttacatagtttttcccaagatccattttccagggaggcacacagatcacacaagtctaggaaataaaaggggaaccacatgcagagaactaggatagcatgggtaggcatgactaatcccatcttctagtttctctggttccatggcttggagagtcacacctacaaccacgggcggcacatttaacaaggtgccaggacccaggaaccaaggagggaaaacagtcgggggggacgctcccactgtcttcttctccaccctgggtcacacaccaaaaggaaggagactaaatggatggctttttctcacttctctttctagatgggaaacagaccatctacgacctgcactcctctcaagtgcattctaaaacgctgggacttcttcaaccttgagactttgaagaaaaagcacctcatgttatattgcacaagggcatggccttcttaccatcctggggacagacaaacccgctggagggagccttgcttttaatattatccaaaaattcgatcttttctgcagacagaagggcaaatggtctgaggtcccctatgtacaggctttctctgccctgtgagacaacccagatctttacaagttttgtacaatggactcagttcttttagcagccatggcaggcaagcccataggtaataattccccagagctaaagcagattccagaggagcaatctgagacagctattgaatgtcccaacccttctagtccccctcatccagaaccccctccaatcatgccatcagctcctccagctccaccatcttcaatatcacccactttgcccacttcgctcttacctctgcaggaaatgcctgatggaaatggtgctatgaagcttcatgttcccttctcattacaggatcttaagcaaataaagggagacaagccgattttctgacgaccccgatagatatatagaaactttccaaaatttaactcaggtgtttgatctcacgtgttgctcctaagtcagactctcaccgctgctgaaaagcaggcagttcttcaggcagcagaaaaatatggagatgtgtgggtgaaggattacctaggtgctgagacaagagactgaaggcacaaactgtttcagtataataaagaaaatagttagaataagaatagttataatacaaattagatatagagatgatcatggatattatcaataattagtataaacattgttaatcattagctcttaatattgctctttgttgtattactaatatagccaaggaataactggcaggtatagggtcaggtgctgaagggacattgtgagaagtgacctagaaagcacgaggtgagccctcttgtcaacgcctgcataagggccacttgaggggtcctgggtcaagcggtaatgccagtgcctgggaaggcacccattacttagcagactgcaaaaaggagtctctctttccttggaggagtcagggaacactctgctccaccagcttcttgtgggaggctggatattatccaggcctgcctgcagtcatacagaggcctaaacccctcactgtggtgctgtgcttcaatagtcatgctccttgtccactttcatgttcctcccgtactccgggttcctctttgaagtttgtagcagatagtggtagaagaaagagtgaaagtcttaaaatctttgatctgtcttataagtgcacagatgaaaacactgacgtttgctgccttctctctctgcttcggctacctaaaagggaagggccccctgtcccatgatcacgtgacttgcttgaccttatcaatcacttggacgactcaccctccttaccctgctcccttgtcttgtatgcaataaatatcagcatgcccaatcatttgaggccactacgggtctttgcgtcttggcggtagtggtcccccgggcccagctgttttctctttatctctttgtcttgtgtctttatttcttactatctttcgtctccgtacatggggagaatacctgctaagccctgtggggttggaccctacagagataagcaacatgtctcctatagcagaccaaagagagaaaaaggaaatagggaaggtgaactaaaaatggaaactccattcccactaggaagagaagcagttctggcagacaaccctcatgggaaccacaatagctccgtcgatgaatggaaaacgaagcacttttaatgtgcatattagaggcctaaaaaaaccagagccaaacctcttaattactgtaaactatctacgatagaccaaaaaccagatgagaatcccacagcctttatggaaaggctgagagagacactaacaaaacacacctctttatcccctgatttagctgagggacagctcatcctgaaggacaagtttatcacacaggcatctccagatattagaaggaaactacagaagcaatctataggaccaaatagcacccaggaaaacctcctgaatatagccactttggtctttgataatagggatcaggaggaggcccaagaaaaagagaggaagcacaagagaaggacagaggctctagtggcagcattgcaagcttgcaaagtccaggatccccatggtgcatccactagctgttactgatgtggcaagtcagggcattttaagaaggaatgcccaaacagcaagaagaagccagctcaaccctgtccagtctgtgatggagaccactggagattgaactgctcccagagatggaggtcactaggttcagaaccagtctcactgatggtccagcaggactgatgagtcccagggctcaaccccctgctccagcagctcaaactgccattacagcacaggagctccaggtgtttctggaaattgaaggaaggtagatctccttctggatactggaggcaggctctctcttctctctaatccaggtctcccctcttcccatagcacaactgtaaggggtgtctcaggaaaaactctaatccgatatttttcttcacccctagctgcagatggaggggacctattatttacacatgcctttttactcatgcttgaaagtcccattcctttatcaggtagagatattctagctcgcaggggggccggcatccttacagccccaggacaaactctttgtctccccctggtggaagctaacattaatccagaagtgtgggctactccagaaagaagaggttgagctataatctctaggccagtccagattcatcttaaggatcccacttattttcctttctttctttctccttttttttctttctttttgagatggagtcttgctttctcacccaggctggactgcagtggggtgatctcagctccccacaacctccgcctccagagttcaagtgattctcctgcctcagcctcctgagtagctgggattataggcatgtgccaccacgcctggctaatttttgtatttttagtagagacggggtttcaccatgttggccaggccagtctggagcttctgacctcaggtgatccacctgtcttggcctcccgaagtactgggattacaggtgtgagccaccacgcctagtcaggatcccatttttttttcctaatcagagactatatcccctaaatccagaggctaggaaagggctagcagccattatcgataacctaaagatgcagggcctcctcaaaccctgtaatagcccctgcaacgccccaatattaggagtgcaaaacctcaataaggaatggagactagttcaggacctctgcctcattaatgaagctgtcgttccaatccatccaatggtacctaatccctttacactgttaactcaaatacctgagggaactaaatggtttacagtcctaggtttaaaggatgcctttttctgcataccgttacatcctgactctcaatacctgtttgccttcaaagatccctccagccagaccacccagttaacatggacgttgctgcctcagggattttgagataggcctcatctgtttggacaggcactgtcaaaagatgtctctgagtgttcccatcctcaaattagggtcttgcagtacgttgatgatactctgctctgtgccccaactaaggaagctcctcaggaaggcactgaagctcttcttaacttcttagctaacagaggatataaggattcaaaacccaaggcccagctttgcaaaacctcggtgaagtacctgggtttagtgctgtccaagggaactggagcattaggggaagaaatgattcagcctatttcttcctcccttctccctaaaacctcaagcaactaagaggatttggggacattacaggattttgtagactatggatacctgggtattgtgaaatagtccacctgttatataacctcataaaagaagctcagggagctaaaactcatctttattttattttatttttttagatggagtctagctctgtcaccaggctgtagtgcagtggtgcaacctccacctcccgggttcaagcaattctcctgcttcagcctccgagtagctgggattacaggcatgcgccaccacgcccagctaatttttgtatttttagtagagacggggtttcaccatgttggccaggatggtctcgatctcctgaccccgtgatctgcccacctcgacctcccaaaatgctgggattacaggcgtgagccaccacgcccggcctaaaactcatcttttaatctgggaacctgaagcttgaaaggcctttgaccagctaaaacgagccttgcttaaggcactagctctcagccttcctgtagggaagactttccatctgtacgtatcagaaaggaagggaatggccctgggagttttaacgtaagcttgacgagcagctcaacagccagtgggttacctaagtagggaacttgatttggtggctaaaggatggccagcatgcctttgagccattgcctcagtagccctactggtcccagaagcccccaaattaaccctgggaaatgatttaactgtttacaccccacataacatggcaggactactgtactctagggggagcctttggctaacaaacagtcgactccttaactatcaggccctgctgttagagggttccaacatccaattaaaaacttgtgcagtggctcacgcctgtaatcccagcactttagggggccgaggtgggtggatcatgaggtcaggagttcaagatcagcctggccaacatagtgaaaccccatctctactaaatacataaaaattagccaggcatggtggtggtgcatgcctgtagtcccagctactcgggaggctgaggcaggaaaatcacttgaacccaggaggtggaggttgcattgagctgagattgtgccactgcactccagcctggcgacagagtgagactccgtctcaaaaaaaacaaaaacaaaaccaaaaacaaaaaaattgttctcgcctaaatccagccactttcctccccaaggaaactagggaacctgaacatgactgtgaacaagtcctgatacagacctatgcagccagggaagatctcagggaaaccgctagagaacccacactggaccctcttcacagatgggagctcttttgtagaacaaggaatccataaggcaggatatgcagtagtcactctaaatgacgtcattgaaagtgtgtctctccgtccaagcactcaattagctgagctgatagctcttactcgagcactagaattaagcaaaggaaaggtagctaacatttgcactgactccaagtatgctttcttggttcttcatgctcatgctgccatctaagctttcttttaaatattttcagtatgtccaagagaaaacacctgcttccgtttatttagcggtaataacctatatggacttaaaaattttttttgtacagatgaggtttcaccatgttgcccaggctggtcttcagactcccaaagtgctgcgattacaggcgtgagccactgcacccggccaacattttcttttttagaaacagggtctcactctgttgcccaggctggagtgcagtggcatgatcacggcatactgcagcctcgacctcgtgggctcaagtgattctccttccttagcctcccaagtagctgggactacaggtatgcaccaccacgcccagctaatttttttttgttttaatttttatgtacagacaggcatcttactatgttgtcctggctggtctccaattcctgggctcaagtgattcacccgccttggcctcccaaagtgttgggattacagacatgagccaccacacctgggttattgttggatttactgaagaaaaggggcaggagaaaaaagttaaattacgacaaatctctaggtcaattagaagccatatctctgggatattttaaaaaatcagtcttaccgcttccgactctaaaagttaatgccattagtaacaacagcaggaaaaataaacctgataaaaaccagcccattcattttagcaaaaaagcagtttaactcaaaatacttagaccaaagtataacactacgtacccaaggtgccccacccaccagcaagaagagaagaaataattgctttaaaaatcaaaatatgcggccaggcgccgtggctcacccctgtagtctcagcactttgggaggccaaggcaggcagattacctgaggtcgggagttcaagactagcctggccaacatggtgaaaccctctttctactaaaaacacaaaaattagccgggcgtggtggcgcgtgcctgtagtcccagctacctcgggaggctaaggcaggagaatcgcctaaactcaggagacggagcttgcaatgagccgagatccgccactgcactccagcctgggcgacagagcaagactctgtctccaaaataataataataataataaatatgctcagcatttcttccagagatagcaacggtgctactcctgagagtgctcggaaggactaaagctggagtgaagataatgtctagggattggtatcccacaaaggctttcaaagcccaaggtaccacaagcacactaaactcgtctatgaattagaaaacaagatatcactgctgcttctttctgtcttttgaaatgtacaatattttgtaggctctgcccttcgatgtgaaagcaggactaagaaaaaacaactaagagggccaggctcggtggctcacgcctgtaatcccagcactttgggaggccgaggcaggcggatcatgaagtcaagaaatcaagaccatctggccaacatggtgaaaccctgtctctactaagaaaataccaaaattagccggacgtggtggcaggcgcctgtagtcccagctactcaggaggctgaagcaggagaatcatttgaacccagaaggcggaggttgcagtgagctgagatctcgccattgcattccagcctgggcaacagtgtgagactccgtctccaaaaaaaaaaaatagagacagagtcttgctatgttgcccaggctggtctccaactccaagctaagaaatgtgaaattatttgacacctaaatttttagaaccatttatcttaactgtgaaattaaacagatctaccttctcctgccttcagtcaaaccacctcacaaaaataagagaactgaaacaatccaaacatgatcttttttttttttttttttttttttttttttttgagatggagtcttgctctgtggcccaggctggagtgcagtggcacgatctcggctcactgcaacctctgcctcccaggttcaagcgattcccctgtctcaggctcctgagtagcttgggactacaggcacacgccaccacgcctggctaatttttgtatttttagtacagatggggtttcaccatgttggccaggctcgtctggaactcctgacctcaagtgatccacccaccttggcctcccaaagtgctgggattacaggagtgagtcactgcgcctggcccaaacatgatcatttttaaagtccttgaaagtattaaaactttgaaaagaaaagaaagaaggaaaaacaaaaacatggcagtgcaggaaagctttacaagaaagagggggtgaaaatcaatgggcttgtctttttttgtcaacaagcaagtgcaagaaggttcattttgtgacttgttcagttgtgttttgcatatctccattctgatcggaagggactttgaggtttttctgcaactcctgagcatctgcaggctccatcctcttatcctttatctgtctttgtctcagtcatctcaaagccaaacttctgtagaagtcaattgctgactcattgctgatctggacaaacagatgttgtcaaaagtgccatcttggctgggcagtggcttatgcctgtaatcccagcactttgggaggctgaagtaggcagatccctagagtacaggagttcgaaactagcctggccaatatggtgaaaccccgtctctactaaaaacacaaaaattagccaggcgcggtggctcccatctgtaaccccagcactttgggaggccaaggcgggcggatgtcctgaggtcgggagttcaagacctgccaggccagcatggtgaaaccccgtctctactaaaaatacaaaaattagccgggcgtggtagcacatgcctctaatctcagctactcgggaggctgaggcaggagaatcacttgaacccgggaggtggacgttgcagtgagccgagatcgcgccactgtactccagcctgggtgacagagcgagactccatctcaaaaaaaaaaaaaaaaaaaaaaaaaaaaaaaaaaaaaaaaagaaagagagagagagagagaaagaaggagaagaaaaaggtgccatcttctccacagatgtttgacacgatttaacatctgagttgctattcctggccttgggtaaggtgccggacaccctggtgtgatgatgtgtctgcgaatgatccaccgtcccgccctcgccccagctttgctagctcagcctccagcacgcccttgtaggacgtgtccctgcagccgactgaaaaggtggcctggatgggtgtcttcaagtacggagaactgcggtgtcgcgcctccgggccccatccggctcccagcatcttctcccgctgcggaggccgcatttccactcagggcagcgccgccgcggtggttccgccctgtcgggctcagaccggcctgggcgcctccgcggggagctgggcggtggcgggggccgcgggagtggagccggcccgagcctccagggggcgctggcggccgcttcctccatccgcaggcggctcccggccacgcccgtcgctgagcgtgaggcgatggcggccgagctcagaacactggtccccggaatggagagctgaggggacagatctaagggacatttataactccgcagggactccggggtgggagtcagtccgtctcaggtgcgtctccggaagaacttcggcgtcctcagggaatcagtccctgccccagtgagaaaaaccttgctgggtcctccctgatccccgccactacttttttctccttagcaaaatccagatattgtttgagtattgggcagccacgtgcttcaggggaagctgagccccttcccagtgtgagagttgggggtgagtcttagaataaatcaatcacagcaattttattattattgccgttatcattggtttaggaacggacaggtggcagaattctggcccatgaaatataagaagaggcccactgtggagcttctgaggccgggcacggtggctcacgcctgtaatcccagcactttgggaggctgaggctggcggatcacgaggtcaggagttcgaaaccagcctggccaacatggtgaaacccccatctctactaaagatacaacaaattagccgggcgtggtggcgcgcacctgtaatcccagctactcgggaggctgaggcaggagaatcgcttgaacccagaaggcagaggttgtagtgagccaagatcgtgccattgcactccagcctgggtgacagggcgagactctgtctccataaattaattaattaattaattaattaagacatagtcttgctacgttgcccaggctggtctccaactcctgggctcaagtggtcctcccgccttggcctcccaaagtgctgggattacaggtgtgagccagaaaagtttgtttaaattgtgcaaaaatatacataacaaaatttaccatttttatattttacttactttttatttatttcaataggtttttggggaacaggtggtgtttggtttcataagttcttcagtggtgatttctgagatttggtgcagccatcactcgagcagtgtacacggtacccaacgtgtggtcttttatccctcgcccccttcccaccctttcccctgaatacccaaagtgcattgtatctttttttttttttttttttttgtgagatgtagtctctctgtgtcgcccaggctggagtgcaatggcacgatctcggctcactgcaacctctgcctcccgggttcaagtgattctcctgccttagcctcctgaatagctgggactacaggcacatgccaccaagcccagctaatttttgtatttctagtagagacggggtttcaccatgttgggcaggatggtctcgatctcttgacctcatgattcgcctgcctcggcctcccaaagtgctgggattacaggcttgagccaccgcacccggtccactccgtggctttcttttcatcatcttgatggtgtgttttcatgaactaatgttcttaattttcaagtagtccaatttatcatgttttcattttgatgtcttatatatgaaatttttcctaccccaaggtcatgaaaatatttttttccttttagaagcttcaccactttacctattacatttatatctgtaatatgcctaaaatttagacctttggattaatgtgaagaaggtcaagattcttttcttctccatatggatatacaactgactcaatcccatttattataaagagtttcctcactgctctgcagtggacttttgtcattaatcaagtttgcatacatgcaagcatctatttctatcctctattctgttccattggtctgcttatttattcttgtgcccaaatcacactcaaccttaattattttggcttcattaaaaagtcttaataacatacagtgtgagtcctccagctatgctcttcaagattatctggggtattctgggccatttgcattttcatataaaattttcaataagcttgctaatttttagaacgctatgagctgggatattgagtagaattacattgacatcttcataatatttagccttctaattcatgaatatgatacgtatctttatttagattctctttaattttcctcggtcgtgttttgtagtttcctttgtagagtttttgcatgttttccattagatttattactaggtatttgatgtttcttgatgctgttgtaagtagtgtttaatgtttttcttattgctgttataaatacgaccaatttttctatatttacctttttattcagcaaccttactaaacccatttttcacttagtcgttcatctgtagatgcccgcccgcccgcctgcctgcctgcccgcccacccgcccgcctgcccgcccgcctgcccgcctgcccgcctgcccgcctttcttttctttcgtcttgctctgtcacccaggctggagtgcagtggcgtgatctcagctcactgcaacctccacctcctgggttcaagtggctctcctgcctcagcctcctgagtagctggtactaccggcacatgccaccacacctgactaatttttgtatttttagtagagacagggttgcaccatgttggccaggcttgtctcaaactcctgacctcaggtgatccacccaccttttcctcccaaagtgctggaattacaggcgtgagtcaccgcatccgtccttgttctgcaaacacaatcatgttgtctgtgaatgacagttttagttcttcctttccaattcttatgtctttcatttctttttcttgtcttgttgtaatgtctacaccttcaacagaatgttgaatagaattaatcaagggaatttcattctattctcaaactcctgacctcaggccatctgcctgcctcagcctcccaaagtgctgggattataggcttcattctattctcttgttaccaacatcatgaagaaagtttcagtgttttaccatgtttctaaattattcatgtctcaaagaagaaaatacaatgaaaattttaaatgtttcattgaaaaacaatgaaaatgtgacataagacaataaggaggtagctaaaactgtactttgaagaaattttgtctcaaatgcaaaataaaagctggacatatccgtgagataagtgttcatctcaaggtgttagaaaaagagcaaattaaacctaaagttattagaatgaaggaaataataaagattagagcaggaattcatgaaatagaaagaaataaataatagaaaggattatcaaaggcaaatattagttctttgacccttgtgcactattgatgggaatgtaaattattacggccattatgaaaaacagtatggaggtttctgaaaaaattaaaaataggactaccatatgatccagcaatgatatatactaggtgcatatctggaggaaatgaactcagtgtgttgaagggacacctacactcccacattaattgcagcgttattcataatagccaagatatggaatcaacttaaggagccatcaacaatgtggtatgctaggcatggtggctcatgcctataatcccagcattttggaaggctgaggcaagaggatcacttgtgcccaggagtttgaaaccaggctaggcaacatagtgagacctcatctctacaaaacaaaaaaaaaattaatttgaaaaacaatatgctgaaaaaatgtgctacatgctcatcatggatgacattaaaaataagtaaataagcaatatggtgtatatacacaatggaatactattcagcctttaaaaagaaggaaattctgtcatttgcaacaagatgtaagatcctggacgacattatgctatgagaaataagtcaggcataggaagacaagtactgcatgatctcacttatatgaggaattgaaaaaagtgaaacttctagaagcagggacagagagtagaatgttggttgccagggttggttaggaggctggggagatgggagatgttggccaaagggtacaaactttcaatataacgtgaataagttctggagatctaatacacagcacagtgattatagttaataatactgtattgtatacttgaaatttgctaagagaatagttcttaagtgtgttcattattgggggaaccagcccccaatatttcaacgtaggttcttttctattttccctaagtgtcagctggtctgagaaaaaaagagaaagagtacaagagagagaaattttacagctgggcctccgggggtgacatcacgtgtcggcaggttctgtgatacccacctgagccgcaaaaccagcaggtttttattaggaatttcaaaaggggagggggtatgaatagggagtgggtcacagagatcacacgcttcattcaaatggcaataaaagatcacaagggcataagggcagagcaagctcacaaggccagggcgaaattagaattactgatgaggtttcacgtcccactgtgcacgcgttgtcattgataaatatcttaacaggaaacagggttcaagagcagagaactggtctgactacaattcgccaggctggaatttcctaatcctagcaagcctgggggcgccgcaggagagcagggcgttatttcatcccttatcttcaaccgcatgaggcagacagccccagagcggccgtccatgccccccaccgggaatgcgttcccttcccagggtgattccttgctgggaaaagaatgcagccatatttctcctactcgttttctgcaataagaaagatatgacgctgttctgcccggccccgcaggcagtcagaccttatggttatctcccttgttccctgaacatcgctgttatcctgttctttttcagggtgcccagatttcatattgttcaaacacacgttttacaaacaatttgtgcagttaacgcaatcatcacagggtcctgaggtgacatacatcctcagtttacgaagatgacgggattaagagattaaagtacaaacaggcacaggaaattatgagtcttgactggggaagtgatacatgtccatgaaatcttcacaatttatgttcagagactgcagtaaagacaggcgtaagaaattataaaagtattaatttggggaactaataaatgtccatgaaatcctcacaatttatgttcttctgccgtggcttcagctggtccctccgttcagggtccctgagttcccgcaacaattcatcgcaaaaaaaaaaatggtaagaagctgggcatggtggcgtgtgcctgtggtatcaactacttgggaggctgaggcaggaggatcacttgagcttggcatgggcaacctaccaagaccacatatctaaagaaataaaatgtcttttctggttccacttgagggttgcatttttttaaaagcagactttttttgtgagataatgtatatggtagcaagcttgatttggccactccacatgtaaacatatttcaaaacatcatgttatgtaccataaatatatatattttttgtcattaaaaaataaatttaggcgaggcatggtgggttgagcctgtaatcccagcagtttgggaggctgaggttggaggatcacttgaggccaagagtttgagaccagtctgggcaacgtagggagatcccatctctgcaaaaaattaaaaattagccaggtgaggcagtgtgcacctgtagtcccagctacctgagaggctgaagtaggaggatcacttgagcccgggagtctgaggctgcagtgagctatgattgtgccactgcacttcagccttggcaattgggtgagatcatctctccaaataaataaataaacaatttttaaatggttctttgaaaaggttattgatactgaaaaactcctgacaagattaataaataagagaagtcacagataaccaataacaggattgaagaaggggacatcattatacatgtaaacagatgacaaaaagctaagaggatattataggctgagtgcagtggctcacgcctgtaatcccagcactttgggaggacgaggcgggaggatcacgaggtcaaggagatctataccatcctggctaacacggtgaaaccccgtctctactaaaaatacaaagaattagcccggcatggtggcacgcgcctgtaatcccagctactcaggaggctaaggcaggagaatcgcttgaacccaggaggcagaggttgcagtgagccaagatcatgccactgcactccagtctgggcaacagagtgagactctgtctcaaacaaacaaaaagctaagctaagtttgattcttttaattctgagtagtattctatagtatgggtgtactgtaatttgtttaaccatttacctgtggaaggaatctggcttattccagttttgagctatcacaaataaagctgctataaatatgtgtccaatatttttctggaataaatgcccaggagtgcaattgccagataatatgggtaatacggtagtagcatggttagttttgtaagaaactgccaaactgttttccagagtagctgtaccactgtgcgttcccaccaccaatgtaggagtgactcagtttctccacatactcaccagcatttagtattgtcactattttttatattaaccattctgataagtgcacatattcattttaaaaaatatttcatacagattttgttagtattctggaaggataagttgatttgcaacatgctaaatgatactgtaacctattaaactcattctgtaattggtattgaatcagttttttgacagataggatccagacatctagatagttttaattttatttttattttttaatttttttttttttttttttttgagacagggtcttgctctgttacccaggctggagcacagtggcatgatcttggctcactgcaacctctgcttcctggttcaagtgtttcacctccctcagcctcttgagtagctgggattacaggcgccagccaccaggcctggctaatttttttacttttagtacagacaacggggtttcaccatgctggccaggctggtctcgaactcctgacctcaagtgatccaccagcctcagcctcccaaagtgttgggattacaggcagtaagccactgtgcccggcctagatagttttcagatcaacaaaggtgaatctgatttgcaaccagggttatgaaccactggtctcagaagacgtagctttgagggaagtggccacagtcaatgatgggaagagacaatgggaatacacagtgggatagtagagatgaatgatgtttcataaacataaacaaggatgccatgaccctgggaaataacattttttggaaaataatttttaaacttttgaaattatttttttctttttttgagacagagtctcgctttgtagcctaggctggtgtgcagtggcgcgatcttggctcgctgcaacctctgcctcctggattcaagcgattgtcctgcctcagccgcctgagtagctgggattacaggcgtgagccaccacgcccggggaatttttgtatgtttagaagagacggggttccccttttacctcgttgcactcctgagagcaagatgggtcaccagcagctgtactggagccacgcgcgaaaattcggccagggttctcgctcttgtcgcgtctgctcaaaccggcacggtctgatccggaaatatggcctcaatatgcgccgccagtgtttccgtcagtacgcgaaggatgtcggtttcattaagttggactaaatgatcttccttcaaagggttatccaaggcatctactcaatgaaaaaccatgatcattctttgtacataaaataaacatttgaaaaacccaaaaaaaaaaaaaaaaaaaagagatggggtttcaccatgttggccaggctggttttgaactcctggtctcaagttatctgcccgcctcgtcctcccaaagtgctgggattacaggcatgagccaatgtgctcagccctggaaatttaaaatagattgattgtaaagaaatctacttgggcaaaaaaattttaaatttgaatactgaaataataatggttccttagagccataaagtgtttattaacaagaaatacagttgataaaagatatgtatgattgcccaacttacatagaaaagaaaaaaatggaaaaagttcaggtggtgactagtcaagttaattgattattaaggatatcaaaatctctgggcggggcgcggtggctgacgcctgtaatcccagcattttgggaggccgaggtgggtggatcacctgaggtcaggagttcgagaccagcctggtcaacatggtaaaacccccgtctctattaaaaatgcaacaatcagctgggtgtggtggcgggcgtctgtaatcccagctactggggaggctgaggcgggagaatttcttgaacccgggaggcagaggttgcggtgaaccgagatcgcaccactgcactccaacctgggcgacagagcgagactccctctaaaaaaaagaaaatcaatcaatcaatcaatcaatcatcaatcggcccacctaggaaaattgtggattgtgtcgctagggggcgctgaacctttacagagcaattcaggaagggaaaatttaaaattctcagaaccctacatataacacctctctataaaagacaaggaacaccaagcagaaaattagagtatgttattttaaaaagagcaaatctaagagtaagacatttaggagaaggagaaagagttctgcccagtgcctcctctgccttactctggtaagaggaaggcaaacagccttttccaaacagcccggcctctccggtgggttctgtcacatgccagcaagaatcctgactaataccagaagcgacgtgctatttggagaactggtggtcatgtcacccaaacggctagtcagagccagtcaaggcggataaggtctgagtagtcaaacttgctcaccgtcttgtgctccccacctggattatgaaatcgggatccacccagtcactgaggccagaaacctgggctccattttccactccaatatctcttactgataatttcactagcttttctacctggctaccttagaatttagactgaaaaatccttgtgctccatcagaataactgcttctgcagcaaactgagttctaacctttctaccttctccacatttcccagtatcaccattgaccaagtcctggtctcgaaatcctacaggcccctcaagagaatttttaggacactatctacaagtctatgaactcaagctggagtattgtgtctcctcctcctcctccttcttcctcctcctcctcctcctccttctcctcctccttctccgacagggtctccttgtcttgtccaggttggaatacagtggcacagtcatagctcactgcagccttgaactcctgggctcaagcgatcctccagtctcagcctctcagagtgctgagattacaggtgtgagacaccatactgggctgagtattgtatatttctttctttctttatttcttttttttttttttttttgagacatggtctcattctgtcacccaggctggagcgcagtggtgtgatctcggctcactgcaacctcaacctcctggactctagtgatcctcccacctctcagcctcttgagtagctgaaattaaatgcctggctaatttttgtatttttgtagagatagggtttttgccatgttgtctaggtcggtctcaaactcctgaagtcaagcgatctgcctgccttggtctcccaaagtgctaggattacaggagtgagccaccgtatcaaggctatgagcactgtacaccttctaaaagaaaaaattattacactttcaagatcgattacaattattatactaaaattgtttttagcataatgctgcttaaatatgtctaaacccaatatcaggtgtaaatttcttttctttttttttttttttgagatggagtcttgccctgtcgcccaggctggagtgcagtggcgcaatcttggctcactgcaacctctgcctctagggttcaaacgattctcctgcctcagcctcctgagtagctgggattacaggcgcccgccaccacgcccagctaatttttgtatttttagtagagacggggtttcaccatgttggccaggctggtttcaaactcctcaccccgtgatccgcccacctcagcctctcaaagtgctgggattacaggcgtgagccaccgcgcccggccaggtgtaaatttcttatgcttatagctcttatgcaactataagagcaaaacaaacctacgtattaaatacaaaacaaattacaagtaataaagttaaattgacagcattaacatactatgatggctgatgctgctttgttgaagctaagtcatctctcacatcatagatttcacaaagctgctttacagcaggttcttttgcatttggcaagttgatactaccttgggcagagaaatgactcaatcataaaatttttctctaattgaattacacccatcacttggtttatgcattctcagtttataaattttagatgaaaaaaatctgaatatatatacctgtcatttattttaaaaattttagatgttgtttgttttcaaaccgaagatactctatgatatgttatggaagatacattcttccgtcacttctcctaccaccgtgatgaatagagaactgatggtggaacactggggaaagaggttattggcccttgttttgagtgactgttaactctggggggactgtgtctgctgagaaaccagtcaaggtgtttctgttgaacacatgcccagttcaaactctggctagtctcaaactcctgggcttaagtcatcctccagcctcagcctcctgagtagctgggactacaggcatgtgccaccatgcccagcttgtattattatttctttttttttgagacggagtttcactcttgtcacccaggctggagtacaatggcgtggtctcagctcattgcaaccttcgcctcccaggttcaagcaattctcctgcctcagcctcctgagtagctgggattacaggtgtgcaccaccacgcctggctaatttttgtatttttagtagagacagggtttcatcatgttggccaggctggtctcaaactcctgacctcaggtgatccacccacctaggcctccaaaagtgctgggattacaggcgtgagcaaccacacccggcctgtattactatttctaacatcataacttcaaacgagacaaagaaaagatggaaaaagtattaatttaagttgtgaagcctaattttaaaaatccttattttaggccgggcatggcggctcacatctataatcccagcacttttggagaccgaggcgggtggatcatttgaggtcaggagttcgagatcagcatggtcaacatgatgagaccgtctctaataaaaatatgaaaatttggtggctcacacctgtaatcccagccctttgggagaccgaggtgggtggatcacttgaggtcaggagttcgagaccagcctggccaacgtgctgaaaccccatctctactaaaaatacaaaaaattagccaggcatggtggtgcgcgcctgtaatcccagctacttggaaggctgaggcaggagaatcgcttgaacctgggaggtggaggttacagtgagctgagatcgcaccattgcactccagcctgggcaacaaaagtgaaactccatctcgaaaaaaaagaaaaaagaaaaaggccgggtgcggtggctgatgcctgtaatcccagcactttgggaggccaaggcgggcggatcatgaggtcaggagatcaagaccatcctggctaacacggtgaaaccccgtctctactaaagattcaaaaattagctgggcatgctggcgggcgcctgtagtcccagctactcgggaggctgaggcagaagaatggcgtgaacccgggaggcagagcttgcagtaaactgagatcgcaccactgcactccagcctgggtgacagagtgagactctgtctcaaaaaaaaaaaaaaaaaaaaaccacacacacaacaaaaattagccaggctggtggtgcgcacctgtaatcccagctacttgggaagctgaggcaggagaatggcttgaacctgggagatggaggttgcagtgagccgagatagcaccactgcactgggtgacagagcgagattctgtttccaaaaaaaaaaaaaaatccttattttaagtgaaaaattagtagaattaaagtaaatcaagacaatataaacattaatggtggtgaaagcttgaagctctagtacaagagatttggggtagtaataggtccagaaaaagcagtaagacacttgtcttgaaactgcactttgtagcaagcaacctttaaaaaacttaagttttcagccccgattcagtggctcacacttataatcctagcactttgggaggctgagcccagaggattgtttgaggccaggagttcaagaccagcctgggcaacatagcaagaccccatctctaattttaaaaaataaaaataaattagttttgagatataacttacatacaataaaattcaataatttaaaaagtatggcttactgagctctgacaaatgtttacagtcatataatgactgccacaatcatgataaagaccacagaatatcccccatcaccctgaaaacttcccttgtacttctttgcagccaatcctataccctgcctctgacccctggaaacctctgagctgctttctgttttgccttttccagaatgtcatataaatagaatcatatagtatttggatataaatggaatcattagtatttagtctgctaggcatatacttgcttctttcacataccacaatgcttttgagatttgtccatgttcttgcctgtgtccacaatctgttccttttattgctcaatagtattccattgcacggacacactgtgagtggttgaacagttgagggacatttgtgttatttccaatttggctattatgaacaaagtagctataaacatttgggtcaagaattttgtgtgaacgtattttttcatttccctttaaaatttttttattatttctttttcttttcttaaaaatcccaaatgtgatagtattttatttttcttgagtaaatacctaaaaatagaattgctaggtcatattataagcatatgtttagctttaaaagtggcccaactgctttccaaagcggctgtaccattttgcattcctactaacgatgtgtgagagttcccgttgctccgcattcctgtcaacattgtcagtctttataagtgtagccattctagtgggtgtatacaggtgttacattgtagttttaatttgcatttacctaatgactattcatgtcatgcaccttttcatgtacttattggccatttatatatccatattggtgaggtgtccaaatcttttttttttttaattatacttaaagttttagggtacatgtgcacattgtgcaggttagttacatatgtatacatgtgccatgctggtgcactgcacccactaactcgtcatctagcattaggtatatctcccaatgctagaggtatccaaatcttttgcccatttttttttttttaatttttatttttattgatcattcttgggtgtttctcacagagggggatttggcagggtcatgggacaatagtggagggaaggtcagcagataaacaagtgaacaaaggtctctgattttcctaggcagaggaccctgcggccttccgcagtgtttgtgtccctgggtacttgagattagggagtggtgatgactctcaacgagcatgctgccttcaagcatctgtttaacaaagcacatcttgcaccgcccttaatctatttaaccctgagtggatacagcacatgtttcagagagcacagggttgggggtaaggtcacagatcaacaggatcccaaggcagaagaatttttcttagtaaagaacaaaatgaaaagtctcccatgtctacttctttccacacagacacggcaaccatccaatttctcaatcttttccccacctttccccgctttctattccacaaaaccgccattgtcatcatggcccgttctcaatgagctgttgggtacacctcccagacggggtggtggccgggcagaggggctcctcacttcccagtaggggcggccgggcagaggcgcccctcacgtcccggacggggcggctggccgggcagggggctgacccccacctccctcccggacggggcagctgccgggcggagacgctcctcacttcccagacggggtggctgccgggcggagggtctcctcccttctcagatggggcggctgggcagagacgctcctcacctcccagacggcgtcgcggccgggaagaggcgctcctcacatcccagacggggcggcggggcggaggcgctccccacatctcagacgatgggcggccgggcagagacgctcctcacttcctagatgggatggcggccgggaagagacgctcctcactttccagactgggcagccaggcagaggggctcctcacatcccagacgatgggcggccaggcagagacgctcctcacttcccagacggggtggcggccgggcagaggctgcactctggacttttgcccatttttaaattaggttttttgtcttctttttaagttgtaagagttccatatgtatagattctggatataagctctatagtaggtatacattctacacatattttctcccagtctgtggtttgccttttttttttccttttcttttctttctttctttctttttctttttctttttttttttttttcagacagggtctcactctgtcacccaggctggagtgcagtggcacgatctcggctcactgcgccctgcgtctcctgggctcaagcaattctcccacctcagcctcttgggcaactgggactacaggcatgagccaccacactcagctaatttttgtatttgttgtagagacggagttttaccatgttgcctaggctggtctcaaactcctgaggtcaagctacccactggcctgggcctcccaaagtgctaggattacaggcgtgagccaccacacttggccagcttttcattttcttaatagtttttttttggaagaacaaaacttttccactttgataaggtccaattttccaattttttcttttacgcttcatgttttttgtgtcttaagaagtctttgctgaatgcaaggtcgcaaagatcttcttttatgtttcctacattttagagcattagctcttatttttagttttatgacccattacttatgatgtaacagttgaggttcattttttggcatatggcttccaattgttccagcaatacttgttagaaagactaaaatttcccccattgaataaccctggtacctttgctaaaaatctgtttgccatgaacgtgtaagcctgtaagcatatgaagggatgcagaacatcatcagtaattagggaaatgcaaattgaaactacagtaagattctacttcatacccactcagaaaactataattaaaaaaagacaggctgctgggaatgtaaaatggtgtagtcactttagaaagccatctggcagttcctcaaaatatgaacacatatttaccatatgacccattagtttcactcctaggtatatacttgttcatagcagcattattcagaatacctcaaaaacagaaacagtccacatactcatcagctaatgagaagataaacaaattgtggtatagtatatgagtacaatggaatattattcagccctaaaaaggaatgaagtactgatgcatgctaaaacattatcgtgaaaacataatgctaagtgaaagaagccggcctgaagaaacttcatattacatgagtcaatgtatatgaaatgtctggagttggcaaactacagagacagaaagtggagtaacagttgcctagggtaggggtgaagtggtggtataaggtgaaatgggaagtaattgctaatgggttccaattgtttccagtgaggtttctttttgggagaagataatttttttcttcttttttttttagacagtctgtctctgtcacccaggctgggagtgcagtggcacgatcttggctcactgcatcttctgcctcctgggctaaagcaatcctcctgccctcagcctcccaagtagctgggaccaccagcacgcaccaccacgctcagctaatttgtgtgtgtgtgtgtgtgtgtgtgtgtgtgtgtgtgtgtgtgtgtttgttttggtaggagagggttctcccaggctaggggagaggaattttctaaaactaggttgtggtgatgctgcacgaccctctcaatttattaaaagccatcgacttgtatactttattttttctgtgaactttgtagagaagtagatttgtgtactttaagtgggtaaattatatggcatgtgaattatgcctcaataaggcagtttttaaaatcaaaaaatgtataattgttgaatttaaaagattgttccggctgggcatggtggctcatgcctgtaacagcacttggggaggctgaggtgagaggatcacttgagcctacaaggtcgaggctgcagtgagccatgatcgtgccacacactccagcttgggcaacagagcaagacctcgtctcaaaataaaatagttttgttccttaaagttatattcttgtttccactactactatgaaacaattatttccagtgtttgaaacggcagctgtgtgtcttctctctgacattgttaaaattttttctaaagtcacagcacacacacacacacaggcatactaagaaagaaagaaaagtttagtaagtaagtttagtaagtttcattgatgggtcaattacataaagaaacagcaagtgaagtaaaaataaagtacactggagaacctgcagaccactgggaatcccaactgacctgagtttcaatctggttgctcccctgacgcatgggtgtcacctgaccagtgagagtatggaactgctgcctcctccccaagcctctcctgtacaggaagacttcagtcctgtagccttcccagttctcctgcatatcatcctgtgtttttatattagaaacaacatttccccagaggtttaatttctgctttgaaagatctatatgaaagagccaagatacagttaagaaggaaggaatgtgccatcatctgtgtgtttaaaattctgtttcggggctgggcgtggtggctcatgcctgtaatcccagcactttgggaggctgaggtgcgcggatcacctgagatcaggagttcgagaacagcctgaccaacgtggtgaaaccccgtctctactaaaagtacaaaaattggctgggtatggtggtgggcacctgtaatctcagctactcgggaggctgaggcaggagaattacttgagcccagaaggcggaggttgcagtgagccaagatcgcactactgcactccagcctgagtgacagagcaagactctgtctcaaaaaaataaacagagagtctgtgaactcagaaggcatacaattcttataaacacttttcactgtgttaaatttataatgttacatatttgacagtgcattcatagaaattctaagtacttagtagctaaacgtaaaaaaagtgcacttaatttttaggccactacatacctgtgaccagttgtgtcaacatttgtaaatcaataggacttgtatttacttgaccactccacgctctggatgcttctttattcactgactagaattacaggaaaatcgtgcccaagtaaacttcgggttcaagcggtttttttggctatggagaggacttgattagagattcagccccagcccagcccctttcctcaccaagagtaagggaatagcaggggctctccttaagtactggggaggtggtctgtatttttcctgcatgctctcctgggcctagattcaatcttgctcctctggctggatatgacccaggtggtagtggtgatggcagcgtatcttgttcactccagctgagactctacactattccataatgcccctctggcctagcaacttagtctctaagtgaactctagctcagtgaaagggacaatcttccccagctgggaatatcccgcaggaagagggttgactagaaagaaggcctgtctctgctcaaaccccagactgagctacaggtttctcttgtccccagcctctcacctccataagccctgctcatggctgctgaggggcttgtcttctgaccagttctggctgctaccctctcctgccaccagggcttttgtgcagtaaggatggcatgaggcataattgctagtcaagaccaagaatgtgagttattgctaagtttctcatacatgatatcagtattatggttatactggaaaatgtccttttttaggagacgcatgctgaagttttgagatcaagtgtgacatggtttgagtgtccccactcaaatctcatcttgaattccatgttgtgggagggacccggtgggaggtaattgaatcatgggggcaggtctttcccgtgctgttcttgtgatagtgaataagtctcatgagatctgatggttctataaggggattctaaaattagcttgtggtgatgccagtaagacctcctcaatttattaaaaaccattgacttggccagcgtctctactaaaaatacaaaaattagctgggcatggtggcgggcaagtgtaatcccagctacttgggaggctgaggcaggagaatggcttgaacctgggaggcagaggttgcagtgagccgagatcatgccactgcactccagcctggcaacagactgagacacggtctaaaaaaaaaaaaaaaacaccactgacttttatactttatttcttctgtgaactttgtagagaagtagatttgtatactttaagtggataaattgtacggcatgtgaactatacctcaataaggcagtttttaaaatccaaaaatatgtaattgttgaatttaagtttgttccggctgggcatggttgctcatgcctgtaagagcacttggggaggctgttatattcttgtttccactagtaatataagggggagtttccctgtacaagctctctctttgcctgctgccatccatttaagatgtgacttgctcctccttgccttccaccatgattgtgaggcctcccagccatgtggaactgtacatctattaaatcctttttcctgcataaattaccaagtcttgggtatgtctttatcagcagcatgaaaacgaactaatacagtaaattggtaccagtagagtggtattgaaaagatacctgaaaatgtggaagcgactttggaactgggtaacaggcagaggttggaacagtttggggagctcagaagaagacaggaaaatgtggaaaagtttggaattccctagagacttgttgaatggctttgaccaacatgcttataatgatatggacaatgaaatcgaggctgaagtggttgcagatgaagatgaggaactcgttgggaactggagtaaaggtgactcttgctatgttttagcaaagagaatggtggcattttgcccctgccttagagctctgtggaactttgaacttgagagagatgatttagggtatctggcagaagaaatttctaagcagcaaagcattaaagaggtaattttggtgctgttaaaagcattcaggtttttttttttttttttgatatggagtcttgctctgtcgcccaggctggagtgcagtggtgcgatctcagctcactgcaagctccacctccagggttcatgccattctcctgcctcagcctcctgagtagctgggactacaggcgcccaccaccatgcccagctaattttgtttttgtatttttagtagagacagggtttcaccgtgttagccaggatggtctccatctcctgatcttgtgatctgcctgccccggcctcccaaagtgctgggtttacaggtatgagccaccacacccagccagcattcagttttaaaagggaaacagaataaaaatttggaaaatttgcagcctgacaatgcaatagaaaagaaaatcccattttctgaggagaaattcaagccagctgcagaaacttgcataagttaagaagaagccaaatgttaatccacaagacaatggggaaaatgtctccagggcatgtcagaagtcttcatggcaacccttcccatcacaggtcctaaggcctaggaggaaaaaatggtttagtgggtcaggcccagggtccccctgctgtgtgcagcctagggacttggtgccgtgtcacagccaatccagccatggctaaaaggggccaacatagagcttgggctgtggcttcagagagtgcaagcccaaagccttggcagcttccacatagtgttgagcctgtgagtgcacagaagtcaagaactggggtttgggaaactctgcctagatttcagaagatgtatggacacacctggatgtccaggcagaagtttgctgcaggggtggggccctcatggagaacctctgctagggcagtgtggaagggaaatgtggggtaggagtctccacacagagtccctacaggggcaccttcaggtggagctgtgagaagagggccaccatcctccagaccccaaaatggtagcttcactgatagcttgcatcattcacctggaaaagccacagatactcaacaccagcctgtgaaagcagctgggaggctgcaccctgcaaagcacacaggggcagagctgcccaagaccatgggaacccacctcttgcaccagtgtgacctggatgtgagacagagagtcaaaacagatcactctggagttttaagatttgactgccctgctggattttggacttgtatggggactgtagcccctttgttttggccaatttttcccattttgaacagctgtatttacccaatgcctgtacccccattgtatctaggaagtaactaacttgcttttgattttacaggcttatagaggaagggacttgccttgtctcaggtgagactttggactgtggatttttgagttaatgctgaaataagactttgggggactgttgggaaagcatgattgggtttgaaatgtgaggacatgagatttgggaggggctgagggtgaaatgatatggtttggctgtgtctttacccaaatttcatcttgaattcccacatgttgtaggagggacccagtgggaggtaattaaatcatggggacaggtctttcccatgctgttttcatgatagtgaattaagtctcacaagatctgatggttctataagggggagtttccctgcacaagctctctctcgggttgcctgccgccatccatgtaagacatgacttgctcctccttgccttgcaccatgattgtaaggcctccctaaccacgtggatctgtaagtccattaaacttttttcctgtataaattatccagactcaggtatgtctttatcagcagcatgaaaacagactaatacaaagtgtcaaggtacctcactttcaaatagttcagcaaacaagacacacacacatacatacatacaaaacatatgtgctgtgcattactgtttttcactaattctttccttgtaaataggaaaattgtggtcaagggagagctggtcataggctgatggcaccagaactacacgattctgccagaatgtgactgattaatcctgaaaagtatttctgcccttggcaaggagtggttgggtggccctgtatcagcctcaagtttgtgcatccaggaccacaaactgattgtaatttggagagggtacatgaaatgtgaaataatttggtaggccagggtgggcggatcacctgaggtcaagagttcaagaccagcctggccaacatggtgaaaccccatctctattaaaaatacaaaaattggccaggcgcagtggctcatacctgcaatcccaacactttgggagtccgaggtgggtggattacttgaggtcaggagttcaagacaagcctggccaacatggtgaaaccccatctctactaaaaatacaaattagctgggcatggtggcgggcacctgtaatcccagctactcgggaggctgaggcacgagaactgcttgaacctgggagatggaggttgcagtgagccgagatggtgccactgcattccagcctgggtgacagagtacaactccatcttgaaaacaacaacaaaaaaaattagccaggtgtagtggcaaacccatgtaatcccagctattcaagaggctgaggcacgagaattgcttgaacccaggaggcagagtttgcagtgagccaagatcatgccattgccctccagcctgggtgacagtaagactgtctcaaaaaaaaaaaaaaaaaagaaaaaagaaatgtgaaatgagcatgtttaggtgtctgtgagttcagcattggttaggagaatgtgtagccctgatagctggcgttaaaaataatctgaagaggctgggtgtggaggctcatgcctgtaatcccatccctttgagaggccgaggtggggatcacctgaggtcaggagtttgagaccagcctgggcaacatggcaaaactgagtctctaccaaaaatacaaaaattagctgggtgtggtggcaggtgcctgtaatcccagctactcaaaaggctgaggcaggagaactgtttgaacctgggaggtgtaggttgcagtgagctgagatcatactactgcactccagcctgggtgacacagcaagacttcatctcaaaaaataaaaataaataaataaaaataaataaaataaaaataacttgaagaacaagcaaagggttgggtctagttgtcaggcaatcctgccaccagttcccttcaggcttttttttctaaccacattttaactttctggatctcctttgattcatttaatatcttatgagtactgtttgtgttggctgggaagcctaggacaggccacacgatatgctctgaagtgaaagagggtagtctttgccttcaagcatcttacactctaataaaaatagaaaagcacgtagttatgcctcggtactcatgggttccacagtctgtggagtcaatcaaccgtggctcaaatgtcttcggggaagaaaaaacaacagaacacaactatacaactatacaatgataaaaaataatacaaataaaaaatacagaatactatttatatagcatttccattgtattaaggattataagtaatcgagatgatttaacgtttataggaggacgtacataggttatttgcaaaatattattttaacataattctttaagattcataaattaatcggatctgcaaagatccttctgccaaatgtttataaatttacttataattaaatataaatattaataattaatattatcaatattatttaagttacatagcaatctcataatattcacaatattttaaattaaataattaaaatttatatttaatggtaataagtaatacaggttccagtgattggaacctgttatctttggaggatgtttttcagccttctacaggtgggggacattgaaagcttgcttccgaggggtgaccactgaagttcctatttgtcaccttgagtggccatttgactattagaactaagttatattcaaaatgatgtcctggttctctgtaaacttaggctggggtgcttcttttgcttaccctgccagcgtagccgcctcagcagtatgcacctgactgttcttggacttctcagctatgtgagccaatacattcctttttattctgttaagccaatttgaatttggtttctgtcacctgcaacaggagtcctgactaaaactgaatttatgaaaaagagatctccacaaacaagaataatggtaaccaatcagatgatctcttcaaagctttgaatataggccaggtacggtggctcacacctgtactcccagcactttgggaggctaagacaggaggattgcttgaggccaggagtttgagaccagtttggccaacatagcaaggctcctctctataaaaaaattaaattaaaatttaaaaaactctaaatataagagtaggcagtatgagtgaaagctgaaagaacatgcagagaagacagcaatccaggcctcaatgaaaaggaacataactcttgacaccctatctaggcctctattctcttttctatcttctgcttcgtcagaatttctgcttattaataactgcaacttattctcactccaccagcatcatggcctggattgctgcataataccctaaactgatttgaccctggaaccctttttgttttttagaaacacagcaaaaggtaattgtcagcaaagcaatttgggctttacacagaacaagcaagaacaggtttcctcttccaacttggtaatgctcctcatgacatcctgggatcagaaataactaatgttatttatttatttatttagagacagagtcgctctgtcacctaggctagagtgcagtggtgtgatcttggctcactgcaacctctaccttctgggttcaagcgattctcccgtctcagtctcctgagtagcttggattacaggcacgtgccactaggcccagccaatttttgtatttttagtagagatgggtttttgccatgttggccaggctggtttctaactcctgacctcagatgatctgcccgcatcggcctcccaaagtgctgggattacaggcgtgagtcactgcgcctggacagaaataactaatatggtgaccaatttggaccaggatgtgggcttccctacggtaggcagcttaacaaggtcctttccagacaagtcgttgtgcctgcaattttcctggatctttaagttacttaacatttctaagtcttaattcctgtggcactaaaatgggggaaatcacttcaatgattcggaacaagaaatcaaatatacgtaaaatggctggtacatggtacacaatgaatattcattctcttcctccaaactttaacatatcacttactatataaatatccaattgtcttttgttcaaatatcttaaaatttgtacagcagaagagtatgattttacatataacaaacagcttaaataaagaaccaggagcttttttttttaatctgaaaaacagttttgccacaattcttcaaatgtttttattggatttaaaattcatttaaggggtatacagatatacaactagtttgatcagctactaatatattttggtgtccctttatttttgtacccaagagccagttcactttttctccatgttcaatatttagctttggtaaaatgttgccatgttcttcctcatctgttactgaagcgttagtatttccaccctgcttggtgcaagttcctcttttaggtttcttcctgtgggtacgttttgtgggactcttctgttttttctcaacttcactgtttgcatcccacaacgtgatcttcccatcattccctccagtaagcagcaaataggattctgggagaaagcagacctgggatacccctgaagtgtggcccttaaatcccagttcctgttcacacttaactcccatcacccgaaagattcgaaccttaccatcttctgcaccacaactaaaaatattaccacacgaagccacagagatagaatgggctagggcagggtttaagagctgaccaggtgactgtgggccttccatttcttctgtttcatcctcctgtaaatttgtaatccagagtggtcgggctttttgaagactccacagcatcacctttacataagaagaaattacacagtcatacaaaatgctagccaatttgctcaactatcatgcttattcagcttctaataaaatcgttaaagtagtctgagaatgagcagtagtgcacgttctcagcagtattaaaaaataatcaaatgctgccataacatgccagtggaatgctaccccgggactaaaactagagtgcggttaggtagaattaaacaagatcctgaataatttttgattaataaactccattaaagtgtaattgttaagcagctgccagtttctaaaggtttttctgctctcatctcttcaagtaaaaccaaagattatcaaatttgctagttttagtctatgctggttataggtcaaaaggcctatcaactaaataaactcgatctggactatcattgaaatgctttccatctggaatgccttcctttcctttcacattacccaattacccatccaaggggcttaagctcagtcctggtgcctccaagaaggctttcctatttcagcccgcttctccttcctgtatctagtttctattctattaattgacatattctactagcttatcagtttcttgagacttacttagtctttgctaatgcctagcataatggctgagaaagaggagaaattccaaacatgtctgttgattaatatgacatcctggtattaatttcatttggcttttcgttgttcccgacctggtgctttttgttttttttaaataagctttgtgaatgggttttacattatcatctagtgattcattcttttcctgtatcaaccattttgcaaagaaaaatactcttaatactttcaaagcaaacagacagctttatcatgtagtttaccatcatccctgaattataactcacaattttaacagacactggaagaagcatgagcttgtttagacagtgaaaagcatagatctgaattggcaagattactattgctaatgctattaagaatttggtttcctattcaaggtaacttcccttatgattattctcagtggcctattttcaaaagcagtgacatctagtaacacttacattctgcttctcttagatgaaaatctctttgaattggatttataacattatactatgtgactaacaatcactgtttgggtgaagttaaagtacgaacaaattgaaataagctaaagtaaaataaataaatattagaaaatataacacgaaggagtgctgaaacttgatatgaaaatagttttttttttaaaaatagggtctcactttgtcacccaggctagagtgcagtggcatgaccatggctcactgcagccttgacctcttgggttcaagtgatccttccacctcagcctcccaagtagatgggactacaggcgcatgctaccacacccagctaatttttgtatttttttgtagagatggggtttttgctatgttgcccaggctggtctccaactgctgggctcaagcgatccactcatctccacctcccaaagtgatgggattacacgcatcagccacaatgccccaaaacagtttctattaaaaaatctgaacacggctgggcacggtggctcacacctctaatcccagcactttgggaggctgaggtgggcggatcacgatgtcaggagatcgagaccatcctggctaacacagtgaaactgcatctctactaaaaatacaaaaaattagctaggcatggtggtgggcgcctgtagtcccagctactcgggaggctgaggcaggagaatggcgtgaacctgggaggcagagcttgcagtgagccgagatcacaccattgcactccagcctgggcaacagagcaagactccgtctttaaaaaaaaaaaaaagaaaatacacacacacacacacagaaaatggacattctagaatctgctagcttcactgtattggcagatagacccagttctttctcatacagcccttatgaatggactgtattttctgtcctccaaagacattcaaacatgcactgcacccagagtgtttcagcagctgaaacaccttttgtatttgacttaaatcatctaaatgtgttaacagccatcccagattctaccaagtctagaatcatttccacgtattgaggattccagactgttcctgtctggacattccctttatgcttcttgacttttctaaaatgctaaagactccaaggtgtttcacacttaatttctcaaccagctgttcaagcagttctcatcctaatcaagagagctagagatactgaaagaaaagaataaagagtttggggcttatggttctgcaaaacatcgaagggagaaaaagtggggaaccagcaaatgttcagaagtgaatgtaatcataacaaagtgacctttcaaaacaaattccccttttacaaaaacatttctttccacataaaagactcgtcttcaagataaagagcctcttcaggccaggtgcagtggctcatgcctataatcccagcactttgggaggccatggcaggactgcttgagcccaggagttcgagaccagcctggggaacacagggagccagccctcctctgcagcaaaaataaaaaaaattagctgggtgtgtcggcttgtgcctgtagtcccagctatgcaggaggatgaggtgggaggatcacctgagggagtgcgaggctgcggtgagctctaattgtaccactgcactccagcctggatgacaaagaccctgtctcaaaaacaaacaaacaaaagagccttctctaccatcctggtctgtaagtgttgggattttggttttaaaaatccagaaagaacaacaaacctttcaatcatttgttttcagatgcagaaaggggcagggaaagaaaatcaacatgtatgctacagaaatatgacagttttaattttctaagtctttcaagaaaaaaactatagttgaatggtaggtatacaggtatttatttaattttttttcttttctttttttttttttgagacaaggtctcactgtcacccaggctggagtgcagtggcacaatcttggctcactgcaacctcaacctctcgggatcaagcaattctcccgtctcagccccccaagtagctgggactacaggtgctcactacacacctggctactttttgtatcttttgtagagatggggtttcgctatgttgcccaggctggtcacaaactcctgagctcaagcgatccacctgccatggcctcccaaagttctgggattataggcatgagccactgcgcctggcctaatgttatcctttacacctcatatatataaatattactttgtacctattaaataaaaaattaagcagtctcacgtgtcttaaagaaccacactttgcttttagggtccctgcctctttgaatgcgctttgcctattttatttttttgagacagggtctcactttgtcatccaggctggagtgcagtggcgagatcatggctcactacaacctccacctccctgggctcaggtgatcctcccacgtcaacttcctaagtagctgggaccacaggtggatgctagcacacctggctaattttcgtattttcggtagagatagggttttgccatgttgtccaggctggtctcgaactcctgggctcaagtgatctgcctgccttggcctcccaaagtgctgggatcccaggcatgagccctcaggcacataagctaccacacctggccctgcctaattatttaaacctaagtcaaaagacataactttataattactgttacataagaaaaaagataggtatgctgaacatggcaatcattcaattcctgccttgagataaaatttgtttgctcagagagaagtaactcaaaatagtcagaactcccttccactattactgtgcctacattcttgggctcccccatagactggctatccttaaagtttaggataatactggatcaacaggttttaggaagacaactgtggaaataattatagagtttcaacttcagttaaggaagtcatttcttaaaagcatggttgtatggctgttacatcacaacccagtgtagaaacaaatctaccatgaacctttagcaattttaccaggcaaatcaaaataagaaattacctgagcctccctttttcaaaatacttgtttccagggctgttcactagcaagtgcctgccactaaaacgtcttacctggaactgggggcaagacagtaaattctgaatgcccattcctcatctaatctgaaaagtacacatcacttttgcgtacccaattgtctattgccatgcctagtggttaatgaaccactgatggaaaagtggtacagctgaaggatgacagaatgactactcaaagacacactgtacaatctgcctacttaaaacatatccatctggttgtataggtctttctttacaaccacaagggcagattatcaccactagggtggagaatgtaggagatttataaagggcttggtcaaaacctaggagtggaaaaggaagatagaggttgtagggtcactatgccccatacatgtagagtgagtctcaacccaggcactacagatgtttttggggagacaattctttattgtttggagactatcccagcactgcaggacacccactgattctgcctactgaatactggtagcttgcaggagaggggaacagcatggtgacaacaaaaacagtctcatcattcttcagttatgaggggtatgcagggttggggagggaaaggtaaagaccactagccaagagggtggaagtcataactgatgctattaaaaagaacatggaatcttagaagatactgtatgtaactgagaacagagattaaatgcctgaacagtgctggacacatcggtcattcacaatggttctctctctagaagccacctgaccccaaaccaagaaacttttctgtgacattattgatgatactctgcttgaatacctgtcatcttagagaaaaaacatagcctttggagccagagagattgaggtttgaatctcagtcaggtggcaatgtagatacttcatgtgaatttcagtttctttatttattaaaaaaaataactaggagggtgtgattagaattaaaactaatatacacaaagcattggcaagaactaagtgctcaacagacagaaatcatgacgactcactccagtgatgagatttactctctcaagaggaagcacatcctgccatgggaacgttcaagctatttgaaaacgtttacattaagcccaaatctgctttcccatgacttctcttatgaagaccagcacattccattttttcccctcatgaaaactaagaattaaacacctccagttctctacataatgggtttctagatacatctactctcctgatggacttcctctgtatttgggcaatttgtgatgctcctttcttttttctttttttttttttgagacagagtctcactctgttgcctaggcaggagtgcagtggcatgatctcggctcactgcaacctccacctcctgggtcaagcgattctgctgcctcagcctcccaagtagctgggattgcaggagcccaccaccacgcctggctaatttttgtatttctagtagagacagggtttcaccacgttggccaggctggtcttgatgacctcaagtgatctgcccacctcggccttccaaagtgctgggattacaggcgtgagccaccgtgcccagccgtgatgctcctttcaaaactcagcattgaatacagtgctctgatcctgatcaccaatacacactatttcagttaatgtaccccagaactttaaagtaaaaacagacccctctaactttttgtttaaacagagtttacagagagtgggtggaccaactctgcctttagtactcactgtttgtttaaacagatgtttacaatcaaatatttgcattttcaggttttaggagtatcttacagtatagagaaaggaaaagtaaaggattaatgattactttgtgaataaattctattaggttttatcagactagcattaaatgtagaaataaggcttattgttcataaatggatatgttagtagaaaacagaaaaagcaaagatatttcgtgtgatcaataatttgatcctgttagcaaatcccacttagaaattccccaagtactctgtgcaaaagcatcacctgcatatccagtccacatgacaccaggctctgaggcctctgaggccgaaaagccactgaggagcagatattggaatgtctcttcaaggatctgataactttcttgttttccaagtctaggattttgattgccccagagtcgtcagcagaagccagcaggttttccgtttgattcaatgaaagacaattgatttcttcttcattcacatgaaaatggtccaaggaatctttgagggacctgacatccagtacactaatggtttctccatgtgaggcatagagcttggtgggacaggagggagaaaataagacactggtaacatcatcagccccttggaaccgcgtgtgtcctaatggagttccatcttcaccccaagccgtgagatctccgccctctgctccagaagccagcagcccttctttacttgcattcaggcagaggacaggagaagaatgcccacccgtccacttgactgccataatggtcccggagactctgtgaagtgggggaaacaactgtaatctcatgttttatacatcgacttgatgggaggagacagatgtaataaacaatatttcatcttttaaaatgttttaaaaatacatcttaaaaaaactcaattaattaaaaaaaaaaaagacacttaaagatcacatctccaaaagcctagctgaacacagggttgtatcctggctggcaaatacttcagtgggcttcctttgccatcagggatctaggtaaggccagtcctccagtctttcatatggaacccacagaagaataaacactacatattttaaattaagaaaaattattttaaagagagggctgcaaaatcatcaggttatgcctcttatctgaataatgttttagatggtgagctctgcagctaggctctccaggtttgcagtagctaggggactgggcaaattactgaacctgtcacccacttttcttctctataaaatgaggataataatgacactcatttcataggatcataatatatgtaaatcacacataatagtgcctgatacataatgaatcctcaacaagcattgctattgttactttttcgatttttattaggccggtgcaaagcggcattacatacactgcaccagtactctcaaagtgtggtctccacactagcagcatcagcatcccctaggaacttgtcagaaatgcaaattgtcagacccaaccctagatctactgaatctgaaaatgggggtgagaccaagcagtgtgtttttgttgttgttgttttgttttgttttctgagatggagtctcgctgccgttagcccgggctggactgcaatggatgatctcggctcactgcaacctccgcctcccgggttccagcaattttcctgcctcagcctcccgagtagctgagataacaggcacccggcaccatgcctggctaatttttgtatttttagtagagacggggtttcaccatgttggccaggctggtctcaaactcctgacctcaggtgatccacccaccttggcctcccaaagtgctgggattataagcgtgagccaccacgcccggctgcaatgtgttttagtaagtcctccaggtgatcctgatgtacagtggaattgcagaatctgtattaaactaatgaccacctggggaaatggtgaaaatggcaggcccttggtctccccaccagacacttattcagtaggttatctaattttatctcaaaacaacccttttgattggtattattccattttagggataataaaaccgagtctcagaaatgttaaataattttcccaaggtcacttgactcttaggatttgtaacagatcccaaatgttttgtttttgttttgagacagggttttgctctgtcacccaggctgcagtgcagtggcacaatcgtggctcactgcagccttgacctcccaggcctaagcaatcctcccacctcagtctcctgagtagctcagaccacttatgtgcaccaccatgcctggctaatttttattttattaaatttttttttgcaaagtcggggtctccctatgttgcccaggctccaaatatttaaataatgaaggtccttttctaacaactccacctgacaacagttttgttattattctttgaagaaacagaaaatgaccaaaagttactagtaagtcatcagtgcttgaaaatgtactcacatatgtttaatcatattatcatctacctgcacttacacaacagtgtaaaatttagatttctcatcctctaggaatcccagatatacacacactggaaatgccacataataccggcctgccgtgcccgcctgctggtcaaggcaaaaaggaaatcagggcaatttatacaactctaatcttggtcaagacaaaaggaagcaaataaatctacctggacaaatttaatttttcatttcataagcgaaaggagagcttacccgagtgccagcccccagagctgttgtgctattttcagataagatacttgaatttagcccagtggtacagagataaaatcatttaaaataatctggcaatctgcccaaagtttccattcccaacacaaagcttttttttttttttgagacggagtcttgctctgtcgcccaggttggagtgcaatggcacaatctcagctctctgcaacctctgcctcctatgtttaagcgattctcctgcctcagcctcccaagtagctgagattatagacgcctgccaccacgccaggctaacttttccatttttagtagagacagggtttcaccatgttggccaggctggtcttgaacttctgaccttacatgatccacccacttcagcctcccaaagtgctgggattataggcgtgcgtcaccgcacccagcctccccctacttttagtcacacatacgatcactaattagactgcaaaaaaatcactgatctattagtaatcaaggtaacggaaacgtgatcacaaaatcaaatacagaaatgttcataaaaataacaaaataaaaaacaaaattaaacttttgttttcaagcagaagcactcaactaatatacagaggaaactaactggagactgaagcaataatatttaaaggagagaattggagaggaaatgactcagagggaggtaaaaacagggagccctggtggtttgatttttgctgacaagtactgaaacagcagcaggtaaatatgccgtaacgaagactgttgccaaaagttccagataaacctagattttaaacgaaaggcactgatagtatttaggcttaggaactgtaatactgacttacctcatgataaagatgctatcctacaaatttgaattgagtattgaaaagtcaatttaagttacaaataattttgtttaacgatttcaattttttttcttttttcttttttttttttttttgagacagggtcttgctctgtcatgcaggccttgacctccccaggctcaagtgatcctcccgccttagcctcctgagtagctggaactacaggctctcaccaccaaacccacctaattttttgtattttttttgtagagatgaggtttccccacattccccaggctgttcttgaactcctgggctcaagtgatcctcccgtctcagcctctcaaagtgctggcatcacaggcatgagccactgcacccagccaatgctttcaaatctttagaatgtcgatcacttttttgccaagttatagttttaattttgctatgatgaatcaactttgaagtcaggaagtctgtactctagagcattaagatttgctgatatttgtgtgcatacaggttttggatcccagctgggattttaggttttctctgaaacaagaatgaggcaaggtttctagtgctcctgtttctccattacaaatctacccacaggagagccaaataaatgctgactgacagacaaaagttttagcaggttttcttcctaatttaattcttttctagaaaagattaactcaatcttcaaggttcattcagttaagttttgctccgaagtgtgagaagacaggcaataaacgaattttgtccttaaagggattattataaagactacagttcctataaatttttccacagtggaaccagtagtaactcttgttctattagtctcacaagaccccaagaacactttcatcttattaaactctacacactaaactcctactctctaaatcacatagataatatttactgatcatttatctagtcagaaaaataaataactgttactgggaatgttaaaaaaaaaaaaaaggcaggggccaggggaggctgggcgtggtggctcacgcctgcaatcctagcactttgggaggctgaggagggcggatcacttgaggtcaggagttcaagaccaccctggccaagatggagaaaccctgtctctactaaaaatacaaaaattagcagggtgtggtggtacgtgcctgtaatcccagctactcgggaggctgagggcttgaacctgggaggtggaggttgcagtggtgaactgagattgtgccactgcactccagcctgggtgagagtcggggtgagggggcaggggggagtttggaaagccccagaaacagaaatccataaactctgaggctattaattttagtcaatcaagatttattatgcaaactattgatcagcgattcaactagagcctccaaaattgtttacttagtctataaaactaaaatgatttgttattatttgaaacacaccaaagaacactatgaaaaagttaatcagattgctgtgatagaagggtagtgggaaaaaatgtaattaaagttgggttaaatcaaaacaatttttcagaaatgagttggcaagccactgtttcttgcttttctatgactgcaactggaaagcctggcagaaagaggtgaagtgtcaccatccccacattcacgtatcaagtcaacaagcttctcttttcctatggagttgcctaaagcgttaagcacagcagttaatcatatcctactgtaaattactttaattagataatagatcacttccttctaatacctaaagaaatcacacagagtgggtgagggaaaggtgagttttttcttgtgttttttttttgagacagtatctccctctgttacccatactggagtgtagtggcccaatctctgctcactgcaacttccaccttcggggctcaagtaatcctcccacctcagtctcccaagtagctgggattacaggcatgcaccaccacgcccagctaattatcttattttttgtagagacaggatttcaccatgttgcccaagctggtctaactcctgagctcaagcaatccacccacctcggcctcccaaagtgctgggattacaggcatgagccactgtgccctgccaggtgagttattttgagagcatttttttcttttttttttttttgagacagagtttcgctctcgtcgcccaggctggagtgcaatggtgcaatctcggctcactgcaacctccgtctcccaggttcaagcgattcttgtgcctcagcctcctgagtagctggaactacaggcatgcaccaccacgcccggttaatttttgtatgtttggtagagatggggtttcaccatgttggccaggctggtctcaaactcctgactgcaggtgatccgcccgcttcggcctcccaaagtgctgggattccaggcgtgagccacggcacccggccgagagcattttttaaaagggtgaagtgccacagccggcagttctcatcagccagagcgcagaatgagagtactgaacatggggaaggggcttggtggggtgggtgatgagcaggtgaaagatttgtaaaaaagaaaaggaggggttgagaagggtaatcttactttgaaattctacctggggcgctcaggagacggtctgccgttgaaagtcacctcagcggctggactagattagtaagaatgacaacatcgcatccttcaaaggctctgcctcggctgcactgagacacgataaaggccagtctttaaaaactgagtgatctctaaacactctgcactagtcataccaccaccgtcccgttcaagagtctgtgcctctaaggctgttcattctgtctagttcatgatccctttctcagatggatcaactctgcttatccttgaagacttcaaagaaattagtgagagacagtcaccatcaccagagtcagcacaggtcaacttttctctacaggcttcgggtttctgaagttggacttgatgtggagaagctggatagcaaccaaaatgattgaagggctgtggcgctggcactggtaagaatgaaaagaattagggttactggacttggtgaaaaagacatgaggagaagggacaggcaaataataatcaaacaccatgaatcagagggtagggaaggtagccaccgttcctttgcttttactagagactaagaaatggattatacatagcaagaagcttcagaaaagatttcttactacataaaggttccaagacattggagttgaccaagggagtctgtgaaccctattattttaattactcagctcatggagttgttttgaggattacgtatataaaaatctgcgtaaatgacgtagtatacagtgcctggttcacaccgtggctcaaatgatggttattattattctcttactaagcatgctttaaaggctgtcggaaaactttggggccacctaggaaatcgtagtataatcaaataatgctgaaattcttgtgtgtgtgtgtgtgtgtgtgtgtgtgtgtgtgtgaggtaggggctcactctgtcgcccaggctggagcacagcagggcgattacggttcacctcagcctcgacctcccgggctcagcctcccaagtagctgggaccagaggcgcacgccaccaccctcggctaatttttctatttttttgtagcgacactgcctcgcaatgttgcccaagctgggatgctgaaattcttccccttccaagaatccatctataattatagcctccacgtcattctccctattggaatgtttaattgactaaaactacattgccttcatctgcttactaagcggtggatccagtaaagaccacatcttgtccaaaagacggcagcacttaattagcgctcaaatggcactcgaacgtttgggcgagggggtgttcagtcgcagccaccttactttgcgaaggcacacagggacagacgttcgctaagtgccgatacttagggagaacgagagggcctgaccaggtaaagacggcctccgctgcccaagctacacaaaaaggttggggagccaggacccggcaagcaaggagagaaaagtttcatgcgttgagctggagtctgaagcaaggacctaacggacacagggaaacgtcacaggaaagggagcccaggagagcagacgcggagccaccagaccagaaaaaggaaaaagcactggaaaacagcatcgaagtcaccggaaagcagcatcgaagccaccggcgccagcctcatacctgcgcttcccgctcccctcctcggcgcctagtgataacctcacccgccggcgcccaatcccgtcgagcgtcaggcgtgaggcggcgcagccaaacagtcacatccggggccgagaggaaccgcgaacgagctgggcgtgcgcccttgcttcgtgccctcaacccgcatggcggagccgctggcgcgccgcggagaggccgggcgagtcgggcggtttcggcgcccgcgctgagccgcggaggaggggcggaggacgcccctgcagccggtgcgtctgccctcagtgaggcggggcgcgcggcggacgcccccgggcaggggcgggagtggtggaggcgccggcggttggcactgacaggggcggtgagcgagccgctccggtctccgggcgaggcttggccttccgagcagagacggcgggaagcggcggcggcagcggcggccctagggccggctggtgaggcgatggcggcgccggccccgggggctggggcagcctcgggcggcgctggctgtagcggcggcggcgcgggcgcgggcgcgggctcgggctctggggccgcgggggccgggggccggctgcccagccgggtgctggagttggtgttctcttacctggagctgtccgagctgcggagctgcgccctggtgtgcaagcactggtaccgctgcctgcacggcgatgagaacagcgaggtgtggcggagcctgtgcgcccgcagcctggcagaagaggctctgcgcacggacatcctgtgcaacctgcccagctacaaggccaaggtgagagagccccgggccacaccgctgcccccagtcccgctccccggcgtcgttcgcggtgtttctcatccgagcttctgagtcagaagcttcgcctcaccagcccgcctttccacggctccagtcagtatcttcctcacctccccccaagataaagattctcttttctttggatcgaagttctgctccttaacccatcccacttccgtgatccacttttcaaacaactaggtagtttgcctcactcattcaacttttgacagttttccccgttaaagacagaccaccactcttgtaccttttaatgccctcatcctacttttctccccggcctccagatagacttcattatattaaataatcccggccaccttaacatgggcttagtttctaagtttctaagtttctagtttgctttcactccacgtttatctcatcttttccaagctctgatttttaaccatttgttttcattattttcccccaagttctctttagttccctccactatattggaggcttacaagtgagtgtagttctagtcatcctgctcacttacaagatacaggcttttatagaacgtccacgggcaccacctaacatactgctttgtcctgctgttattggctgtttccttgctaactttttaatagttccacattgatggtgtctctctttttctatttgtcatctaacgtgctgattacagtttcgctgcatccttcctgcatattccgcccgccttcatatacaaaataaaaatgtcaaggaacaagttgtggtacggctgaaaggactctcaggccgaataaacaaagggtcttggtcttgagttgagttgaatggttaacagctattcagtatagcagtcaatcaagatcatatataagagaagataaagtctgattgcaatgtgttaaacataatgaatgcattagtaactaaaacgataacatccccccctttttttttttttttgagacggagtgcaatggcgtgatctcggctcaccgcaacctccgccttccaggttcaagcaattgtcttgcctcagcctcccgagtagctgggattacaggcatgcgccaccatgcccggctaattttgtatttttagtagagttgtggtttcttcttgttggttaggctggcctcgaactcccgacctcaggtgatccgccctcctcggcctcccagagtgctgggattagaggcgtgagccaccgcgcgataacaccccctttttaatgctagcttgccaacaggggtcggagtaagaagtaaaaatttttttttcatgtgaagcatgtaaaatttatacttatgtagtaaaaccggttttagttatagaagatagggaacattgccattaaatatgtaaactatcaagttgtttctcttttcttttttctttttttttttttttttgagacggagtctcgctctgtcacccaggctggagtgcagtggcgggatctcagctcactgcaacctccgcctcccgggttcacgccattctcctgcctcagcctcctgagtagctgggattacaggcgcccgccaccacgcccggctaattttttgtactttcagtagagacagggtttcaccgtgttaaccagcatggtctcaatctcctgacctcgtgatccgtcgccttggcctcccaaagtgctgggattacaggcgtgagctcatgcgcccggcctcaagttgtttttctattaagcgaaataacaataatttactaggactgtttgtgcgtggtggctattcagtggatactggttgtaatttatataggtgagtacagacgattggaattttgtcctactttgataaatgtgtcggtttcataaattttatttagtttttatttttctgtaaagtttattgtttttacttattttaaactaggagtttttgttgttgtttttgagacaacaaaacaacaaaactctgtcgcccaggctgcagtgcagtggcacaatcatagctcactgcatcctcgacctcctgagctcaagggatcctccttagcttagcctcccgagtagctggcacttcagtcatgtgccaccacactggctaattttttattttttagagacacggggtctcaccttgttgcctaagctggtctcaaactcctggactcaagcgatcttcttgcctcagcctcccaaagtgctggggttacaggcattagccactgcacccagcctaaattaggagttgttgttttgataattgacttgtaatagaaatgttcacatgattcaagattcatattataatatgtaatagataatgtgttcgtgtgagtcaagcttcaatagaagcaaaatgatatcaagcaaaatgttttcctttcatccttgtcgctcagctacccggttcctctccatgtatgcaacctgtcttactttttcttttgtatccttccagagatattttaggtttctgaggtttttaatactttgcttttctgctatgtgcattatagatgttgtagacttgtaccaatcactgttcattcacacattgtaggacttcccttgaatattttgaggataaaagattaattcaaaaggagtcaaatagtctagtaggaaatctttcagtctagtagaggagagaaaaatgtatagaaagaactgctaatgtgtggtagaaattgctccttactgttacagacataaaaaagtatactagaagttcagtgaaaggaggaatttacaaactgagtggaggattggaggagatttgaggttgagcttatatttgagctgaattttaaagatgaggaggagtttagtattttaggaagaggaagtactctgagcagaagcaggacaagaggaaagtaaagggtttgtacaacatatatttttatttaaaaaaatgagtgccaggcactatgctcatttgcagatgcaatggcaaataaaacaaacacagtctcttaatggatgtcttgccttatggagcttacagtctagtaggggaaatggatattaatcaaataatcacacagatgtaaaaccgcatctggtaagtagtatgaaggaaaaatacctagtgctctgattgtcagtagtggaggatttaacctggtggagaggtgagggaaggctttctcagatccatgtactgagacctgaaggatgataagtaggcaaaggggagagagaacagccttccaggagggaaccttatgagtgtgagggatggaaaatatgtcaatgtggctggagcacagagagcaaaggtgatgctggtttgagataagatggaagaagtggactgggaccaaagcgtagggaagccattttgagttgtaagcaagaaggatttgaggtgtggggattggtgatatgattattttgcattttaagagattatttctgactttagtatggagaactaaattgttggttggaagaggaccttagaaatatggtagatcaattaggaaataggtagtggaggagatagaaatgggcagatttagtaagtaaaatctatagaattggcaatagatttgaaatagggatgaggaagagggaagtggtaaggatgactcctagtatttggctcacataatgtagagatcagttgatctagattttttttttgagatgaggtcttgctctgttgccctggctggagtgcagtggaatgatcatagctcactgcagccttgaactcctgggctcaagcgatcctcccacttcagccttctgtgtggctgggactacaggcatgtgccaccatgcccagctaatttttattattatttttttttgtagagatgtctcattatgttgcccaggctggtgggctaggtttcgaagaaatggcagtgagttcagttttgggagagcagcatttacagtatttttgagacagagatttccaataggcagctgttggaggttggagcttagaggagagatctgcgctaaagatataaaataatatagttagattgaatgaaaggaagtagtgggaaatattataaagctatattatgggactagatatatcatggagggctttgaaatatagccttcagtctatagtttgggttttgtactacagttgtaaaccatagaagtttgaacagcagagtgacaaaggctctacttcaaaaagactaggccatagatgagttggagagggcagcggttagtgcctataccagagatacttaagactggaacaggtacatcgaggagagaaggggatggctggagagctgtcgtagaaaacaatatacataggtagacagctgactgggtgaatgggatgaggaagatggatgtgtcaaatggattttcccaggagcctggataacagagaatgataggaaaaggtttagggatagcatagaacaggaaagtggagtttattaatctgttcagttgttttttttttaagttcatattttacatatcaccccgtagcattaattatttaagtcatacttggcatctgatgagaattctctaaagttcagacttagattttaagctaggtcttcatgctgcttttgccataacaaaattcaggttgtgcatgggaatgtgaggctatgggttgtttttaatttattaatttggtctttattttcctttttttttttttttttgagacagagtcttgctctgttgcccaggctggagcgcagtggcacaatttcagctcactgcaacctctgcttcctgggttcaagtgattctgcctcagcctcccaagtagcttggattacaggagcctgccactacgtccagctaatttttgtatttttagtagagacaggctttcaccatgttggccaggacggtctcgatttcttgacctcgtgatccgcctgcctcggcctcctgaagtgctgggattataggtgtgagccaccatgcccggcctattttcccatttcatatgaagtttccagtatctgtttctaaaaagtaaagacacttaatgtaatcacaatatggttatcacatctaaatataaatgtacattaattccttaatatcaaaaatgcagtgttcaaattgccagttgtctcataaatgttaaatgttgcattttaaagttatattttatataatcaagatctatataagggtcccatggcaaaggttgatatgtctcttaaggctattttagtctacatattcactcaccatctccccaacctcccaccttatttgttgaggaaacaaggtggtttactctcagctcgattttgcggatttcattatcatcgtgttgcttgacatgttcttctgtcctctatttcctactgaggtgtgatcaatttagattagattagattttttttgcaagttattttgtactagactcagtggttaaaagtgtgttagaaaataagagctgctaaattgttacgtggcacagaaagtggtgggcaagcacccggcagagagagacatcaagggaattgggtggccctggttaagaatagcttaatagaggtgatcttagagaatgtgtgggagaagaaagcacatataatactttcagcaagaagaacatcatcaaggtagaaagggaaataggaagaatcagatttggagggctgtgaaagccaggcagaagaatttgcagttggtgatgctactaagtatggaactaccagaggttatagaactgggatgagatatgtagtaaaggtgctgttttagaaagacaggtttggaaataattcagatagagagttgaggactgagtttggagaatttggttggggcagaggaagggtggtcaccaaaaaaggaaatgatacaggatcagttcagggaaataggaagatgtcatagaagtttgaggaagagagggccgggcgtggtggctcacgcctgtaatcccagcacttgcggaggccaaggcaggcggatcacctgaggtcaggagtttgagaccagcctggccaacatggtgaaaccctgtctctattcaaaattcaaaaattagccgggtgtggtggtgcacgtctgtaatcccagctactcgggggaggctgagacaggagaatcgcttgaacccaggaggcagaggttgcagtgagctgagattgagccactgcactccagcttgggtgacagagtgagactctgtctcaaaaaaaaaaaaaaagaaaaggaagtttaaggaagaggttgtcaatagtgtcaatgtgaaattggaatttataagaattggggagtaggcatagggaaatattaattaaatattttatagtgaattattgatattattctcttgagttatttagacagtatttgctattttggggacatgttccttccccatttaatcttcttttcctttcttttctttgtttctttttttttttttgagacagggtctcactttgtcacccaggctggagtgcagtggtgtgattttggctcactgcatcctctgcctcctgggctcaagcattccttctgcctcagcctcccaagtagctgggattacaagcgtgcactgccacgcccagctaattttttgtatttttactagagttggggtttcgccatgttgcccaggctagtcttgaactccgagttcaggcgatttgcccaccttgccttcccaaagtgctgggattgcaggggtgagccaccgcgcccggccccttcattgaatcttacgttttggtcttataagtgccttaaagtattttataatacgagcagataggaaaaacattgggaatgcctcagttttattgtgaatgcatgggatactggaaacaaatagttctctgtttttaaatctgcgctctgcagctcactgaaacggtagagtgccagcgaatggtaaacgaacaggtggtgaggggactggatccttgatctctctttgggcctcttgcactaactcgcggttgaaatccctgagaaggactaggtgacctttaagggtcttcctaaatgctgacattctatgcctctggagttgatttttctcaggttagctgaagcataggtcccagccttccactgctttgggtagtttgactaaagtagagaagggattttttaaaaacatactagccaggcaggcgtagtgactcgaacctgtaaccccagctactcggaagactgagatgggagtatcacttgagccaaggagttcaaggctgcagtgcgctacgattgtgccactgcactgcagtctgggtgacagagtgagacgttgtctaaaaaaaatttaaaatacacaaactaaaagtttaaaattgtttatgagaaattgttattgtttgtatagaagagctattttcataccctctttattttggaagtgtaaacctttgtatttactgaagagtcaactaacttgtcttattgatagcttctcttcataaattctagtagttgaacctagatgctatctaagggattatttgatttggtaaaatgagattggtgatttttttattgtgtaagtcatatccagcaagtaggctgaggatctaaggtagtttgtgtttactaaaatttttcataaactttagagctgctaggattaaagtttctgttttatgtaaaatataattctttttgatgacagcattgcccatatgaaaactgtacatctcaactttttggtataaaaatatcaaatataaacaaaagtagagaaaatagtttgatgaacttccttatacccatcaccaagctttgccaatgattaatttatggccagtctagtttcatgtttctattgcacactctcccactccatctctggatatttcaaagcaattcccagataccattattttatccataaacgtttcagtattatctgtaagatataaggatttttcttttttgtatcttttgatgttttaagaagtctgtttgaggaaatactacaatttaaaattttggtcagtgatgaaacggttggcatttattttttaatgttatttattctgttagtattccatcctgaaacttcagccattatttggaaatacttgtgttattttaaaatatataacttcgttatttaaaaacatacagcgtgaagtttgggtaatttttaatatttaagaaaaataaaattgttatttatttggtctgtttttcatctttttagatacgtgcttttcaacatgccttcagcactaatgactgctccaggaatgtctacattaagaagaatggctttactttacatcgaaaccccattgctcagagcactgatggtgcaaggaccaagattggtttcagtgagggccgccatgcatgggaagtgtggtgggagggccctctgggcactgtggcagtgattggaattgccacaaaacgggcccccatgcagtgccaaggttatgtggcattgctgggcagtgatgaccagagctggggctggaatctggtggacaataatctactacataatggagaagtcaatggcagttttccacagtgcaacaacgcaccaaaatatcaggtgagaaactggggtttttctcaagtatgggcctttgtcaaatcacgccttaatttgttttaaatttacaaatttttatatagcagtttttgtctttttggtaatttttatttttattatttttttattttttcagatacccagacttcaaggagattttttttttttaatgttagggggttatagttaattttgttgggtgttatattttgattttggctatgcagaaaaatattctttttttttttttagacagaatctcactccgttgcccaggctagagtgcagtggcgccaactcggctcactgcaacctgcacctcccaggttcaagcaattctctgcctcagcctcagtagttgggattacaggcgcccaccaccatgcctggctaatttttgtatttttagtagagacagggtttcaccatcttggccaggctggtcttgaactcctaacctcgtgattcacctgccttggcctcccaaagtgctgggattacaggcgtgagccaccatgcccagcctcaaggagattttttgaccatttttaaataaatgtataaatgatctatctcaatatttgtttcctaatacaactttaagcagcctatttttgctccagatcaggggttggcaaactttttgtaagggccacgtagtaaatctttaagtctttgcagtccatatggtctctgtcacaactttttttttttaatgtcattttcaaggtaaggatctatcacgagtttcaactctatttatagtacaaaagcagtcatcgataatacgtaaatgaacgaacatggctgtattccatagaccttatttatgggctgcaggacagatttggtccaggggctgtagtttgccagttcatgctctatatcaagcttgtccaacccacagcctgcatgcagcccaagatggctttgattgtgacccaatgcaaattcataaactttcttaaaacattatgagatttttttgcaatttttttttttaaagctgattagctatctttagtgttagtgtattttatgtgtggcccaaaacaattcttccagtgtggcccagggaagccaaaggattgaatacccctgctctagatggtcatctttcctgtatcacggcacatccaaatctttttctaggctccttaccccagtaaatacagctctgtgcatgcacatgtttgtggattcaaagcccctggaggcatcagtgagttctgcagagacaggcaaattcaggcaaactgctgtattttttattcttttcatcttaggcttaaggcatactcatttgactcaagttaaaattatagttcctatttgtaaaagccgtatttattactacagacttaacagggtgtaatatacaataatctgataagaaattggaagtctttaaagaactatagattgcatatttcagagccacctgtggcgtgaaagttccagcctcagtaatgacctcaagtcaggcatactaaagcagaagaaccaaaaatacatcccattttctgaggtataaaagctggaaggatttttttcatggaatgtttcctcactatccttttaggctctgcggatactataaggagaagggtgtgtagactttatcactaaaaacgaagtcctgtcgccacccttgtaatgattttgtaagtgaaagtccttaagtctgtttttcagagaacatgctctatggttttagtccttttaaatttattgagatttgttttattctaatatgtggtctgtctggatgagtgtcccatgtgtgcttgaaaaaatgtatattcttttgctgaatggaatattctgtaaatgagaattaggcaaagtcgattgataatgttcaagtcttacatagtgttactgatttttttctacccttctattatttactaagaggagtattgaaatctccatctatccttgctaatttgtctttcttcttttagttctctcagtgtttgcttcatgtattttggagctctgttactactggtgcatatacatttctaattgttttatctccctgcctgatttattcttttattatgaaatgacttcctttgactctagtaatcctctgtcaatctgtctttgtatttaaagtggagctcctacacagcacatagttggatcttgatttttatctaacccagtctctgtctctgactttttttttttgagacggagttttactcttgttgcccaggctggaagtgcaatggcgcaatctcggctcaccgcaacctccacctcccaggttcaagtgattctcctgcctcagcctcccgagtagctgggattagaggcatgcgcctctaaaccacgcccggctaatttaattttatatttttttagtagagaaggggtttcttttttttttttttctccttttgagacagagtttcactcttgttgcccatgctggagtgcaatggcatgatctcagctcaccgcaacctctgcctcccgggtcccggttcaagcagttctcctacctcagcctcttgggtagctgggattacaggcatgcgccaccacacccagctaatttttgtatttttagtagagacggggtttcaccacgttggccaggctggtctcgaactcctgacctcgtgatccgcctgcctcagcctcccaaagtgctcggattacaggcatgagccaccatgcctggcgagacggggtttctccatgttggtcaggctggtctcgaactcccaacctcaagtgatccacctgccttggcctcccagttgctgggattacaggttgtgagccactgcgcccagcttcggtctctgacttttaagtgtttagttcatttacctttaatgtaagtgttggattgcttgatgttgtccttatctctgcctctaaaactatgttcttgttttttcccccaaccttgtttctctctaatctttgcattagataatttcttttcctttttttttttgagatagggtctcgctctgacacctcggctggagtggtgcagtggtgcagtggcgtgatgatcttggctcactgaaacctctgcctcccaggctcaagtgatcatcccacctcagcctccagagtagctgggactacaggtgctccccaccaatgcctggctaatatttgtattttttgtagagacagggttttgccattttgcccaggctggtttcaaactcctgagctcaagcagctgcctgcctcagtctcccaaagtgctgggattataggcatgaaccactgggcttgacctaaattagataatttctgttctgtcttcaaggttataaatttttttcttttgccatctcacctctgctattgaactgggctagtaaattttgcttattgtacacttcagctttagaatttccttttttttctttttccttttttttttttttttttttttttttttgagacagtctcactctgtcgtcaggctggagtgcagtggcacgatctgggctcactgcagccaccgactcccgggttcaagtgattcttctgcctcagcctcctgagtagctgggactacaggtgtgtgccaccatgcccagctaatttttgtatttttagtagagatgaggtttcaccatgttggccaggatggtctcgatctcttgacctcgtgatccgcccgcctcggcctcccaaagtgaaagtactgggattacaggcgtgagccaccacactgggcctggttcttttttagagtaaatttccttttcgagattccttatttatttacttatactatatttgtaaaaaaatctttggacatattcataacagctgctttgaagtctttaccaaatccaacacttaggaccacttggattcagcttctgttgattgcttttttcccctaaatatgaatcacgctttcctgtttcttttcatatctagtaatttttttaactgaaacctagatgtgtagataatatgtagtagtaactcctgaatgttttgtttctagaaactgctttattctctgaaaagtataggttttcttgttttagtaggcagttaacttgcctatactcaaactataaactctgtctcatgtgatgtgtggcagctaatgtctgctcagttttttcagctttgctgcttttttagtcctggaggtttaccctgtgcctttgtaatatagtggtcactcagggatttgggaagttaattctcagattttggggttcatcctttctgtggttctgttgcttctggagttcctcctctaagtttccagttgctctgccatctccccacgttttaccccagcacctaaagatggtaagacttcgctttctccaccctgggctttgtgcgtgctgtgtgctcaaaggtgaagcagatttgcagatttcaccaggagtaatcgttacttagtttcaacttctgtaaaatagggatagttcctaggattagtgtgaggattaaatgggataatacaaatacgacacaacacaaatacccaacaaaattagcttttcatttctactttgttaatattttgttggtaggagtggtggtgatgatgatttggaggttcttagatccataaaatgaggtgtgggttaatctgtgaggtgggcaaagggaggaaaaaagcagatgttggcagttactgttaacaggaaatacagtgaaggaaagtaaatgacaatagtaggggttataatcaggtagaattaaattttgattgcaaacattaggactttctgtttccaattttgtagatgcaacatctttttataaaggcaaactaaaaagatgaaacatcctttttttttttttgcttacttttccaaatgggaaaaaactggatatattctgcttccagtttcgtttaataatcagtgctgctgttttttataacaaacaggtgtttcagagttgtgaaccacaaattgtttaataagcctattctatattctacattagaatttgtagccagattggattattcatgattccacattacatgtggaactgctttgtaaactttaaaagctgtgtgtcttactaaggtgatttttaaaattgtggtgaaacatacatatttattattttaaccatttgtaagtatacaattcagtggcattaaatacattcacacacctctctctatacccaaaactttttcctcaccccaacataatctctattatgttcattccctatttccttcactccccacccctggtaaactctgctctacaactatatatatttgagtattctagatactttatataggtggaatcataccatttagccttttgtgtctggctcatttcacttagcataatattttcagggtctatctatgttgtagcatatatcaaaatttcatttctgtttatggctgaataatattccattgtacggccgggcgcgatggctcatgcctgtaatcccagcactttgggaggctgaggcaggtggatcacgaggtcaggagatggagaccatcctggctaacacggtgaaacccgtctctactaaaaatacaaaaaattagccgggcgtggtggcgggcacctgtagtcccagctactggggaggctgaggcaggagaatggcatgaacccgggaggcggagcttgcagtgagctgagattgcaccactgcactccagcctgggcgacagagcaagactccgtctcaaaaaaaaaaaaaaaaaaagttccgttgtatgtatagtatagtaatttgagaagctgatttagattgctctttttggtaaaatatgccaagttatagattttagtgttaaccttaagaaaaacctttaaacaaagagtaaataaaatcaatctaggtagtgttcaggtggaacatttaaattgtaagtaattaagtgtagattccatgtgagtcttaaaaacaaaactatcaaagtaagcatttgtgatgtgttacctaggctggagtgcagtgggcagtggtgcgataccagctttgcgccaccacacccagctaatttttgtatttttaatagagatgggttttcaccatgttgcccaggctggtcttgaactcctgggctcaagcaatccgcccgcctcagcctcccaaagtgctgggattataggcatgagccactatgcccggccagatgtatgtcctttttttatagatgtttcttcctgactagaaagcttcccttctgatttttctagatagctttcaggataatattcttaatattttcaacttcttgatttgtgtcttgtttcttctagctacacccttggcagattttcttctaaccttttgatatctgtttgcagataggagaaagaattcgagtcatcttggacatggaagataagactttagcttttgaacgtggatatgagttcctgggggttgcttttagaggacttccaaaggtctgcttatacccagcagtttctgctgtatatggcaacacagaagtgactttggtttaccttggaaaacctttggacggatgacagtggctttcttgtgatgacagacagaatggaggagagatctgcttatgggaagtagaaccatgaagtgactgtcacacatgcatgtccaagaaacatcctgaaaacacatgaagtcgtaaactggagaagcagctctacagcagagattatcttcgtgtttcctctttctactgggccagaaaaatcctcagggttgcagttggttgagtgggcagttgacatatgcatgttgcacccgatgttgtctctaagttagcaatgtgttatttccagctttaaaggtgagattgtagagatgctgtcaaagggataaggaaatagcaagatttttaagtagtgtgtttgtgaagactgatcccattttacaactgcctgttctttctccagtccttttttttccagccagcttgactattagaaaagtatgaaactggttgggttttatttaatatttttaatatattgagaagcatggtctgcctggactgcacttctctaaaagtgagatataaaattgtgcagctattttaaaagttgtatataatatgtgtgtaaaaaaaaaaaactgtaaaaaagaaaggacaaacaggttgttttgttctagttctaatttcttaaaaaccactacatggttacaaaattggaataacatttggggacaactgggttaactacaaagaagaggattttaagaggagatgtgttgtattgactcattttgtattatttttggcttacagttcccatagctgttagagtctggtttgtttttgtttttactctcaaaatcatagtaaagatctctcagtctcctggctaaagattgaaggaaggcaaatctatttctaattatacatatatcagtaaggatgatctcaacataatagtaatgtgtatcttttggtatccagttttatttttggccttctaagaaagtgtctcataacacagaacattgccatttgctcttgtaggcctcaaatatgaaagctattagtcatagagcctaggaaaaaaagaattgattaatggtccttttattttgtaaccttataaatgctgtagatattatcaaaaaaattttaatttcatattgtttacatcatgcaactaatctaagcctcaaactcgttattggggctataaagaaaacgtttacttacccagctgaaacaggttaagaatattcttaatctcattatagataattgcccccatgggacttgaaatacaacaccttgtgctgaaaacttcaggttggcaatatttgaaggtttcgttgtagaagagtttaacattaactcctattttgacttacaaatcttgtttctcatcactaaaatgcttttgaattaataatccaacccacatgagctgagagtttttcttttgttagaaaagaaacagacatctttctgtatgaaagtataaattgtatggttttagatacataagaattgacaaaagcgagcgaaatctttgtacttctgagttcttgctgtatgtatgttttgttttaaatctgattagggacacccagcagctggccgggattcttggattgctccttgggagttaagattgtcaatactcctgtgaagcaagggatttcagccatagaacaaagatttattgttgccacctgaaaagtttacaagtatttattgtgtatttgatacattgcttgaaaagatgaaatctgttaaagattcttttcgatgtccaggttaagaagaaacctccttgtattgagtgaaattatatgttaaatgtattagagaatgtaggtggtatagaaattgatttttcttggtgtagaacaactcagttcggcaaagtttaaaatttgattaaacaagagaagtggttcaggttgaagatggacttgttaggaagtgatcaagtcctttaagtacttgtttctttttcaggttgtgatgtggccattccgaattttgttgagagtttggtttataattgtctcttttgtcttgttagtaaacattcatttgcaacagttttgaaggtgctgagtggaaaaccgaaacacatggttattgcgtattggacctagaatgaaataattgcctcaatatttaacaacaagccattcttatctcaaagatttaaattcccgaatgtcccattcgcaaatcatatgcaattgaagtgagcagcatgagcatctgggtcatgagggccttcatttacgtaaatttgtcactaaaacccagtagtagctctacaaaatcttaaactgctgcagtgctcaaggagatggaatatctttgtcattggtgctgaggagagcatttcggtagaagacagttgcgcctgaagattgagtgtaaatcattcaaaccagtggttctcagtgttggctgtatacactttgtagtcactttggaatgttggaagacacatcgatgcttgggttccgtatgccaagattctgatgttggtctggaatatgagctggtcataaggatttttaaaaactttctggtcatttcaatatgctgccaaggttgagaaccactgttgtaaaattcaccttgagttttctcatctgcaaaatagaaaaaaaaaaatccttgctccctcccttcactacctcacaaggatattgagggtaaaggagaaaataatgggaaagtgcttgtgccgtggatgaaaagtgctattaaaagtcaaaggagtgttctgtttcaattcatagtatgatcagggaaagtgtaactgagtatactttgttgacttgggaaacctggagcactttctttggttggttaacgaagcatgcagatgtggaagcagacgttactattatccctactatggtcttctgtcatactgagacaggctgttttaattacctggttttacataggaaagaagaaatattaaggcttaaagtttgtaatgatcaatggctcataattcattaaatcttttcatacaaggaatttgtggttaatgtcatttcatagttgccattattttctcattatttgacttaaatgttaagccatttatttcatctccctcattcacataaagtgtagatatggattcaataagacaccaaaagaaagtaagatttacccagttaatatttaaaatcattgttcagtgattaggcattttctgccttttagaattatttgactggagaaagagtttcaaaaatagcagagccctaaaccataaagaaactactactgtataatgaacttttgtttgtttttggagacagggtttcactctactgcctaggcaggtcttgaactcctgggctcaagcagtcttcctgcctcagcctcccaagtagctgggattacaggtgtatgccactatacccagctttaacttttaaatccccaaactatgtagattgtcatattaatattaatttttttttgttattttgaagaagtgagtaatttgaagagatagaaacttagggagtggtgtgtgtgtttcttttttggagacagagtcacgcaggctggagtgcacgatcttgactcactgcaacctttgccacccaggttcaagcaattctcgtgcctcagcctcccgagtagcatgtgccaccacacctggctaatttttttcttttttcttttagacggagtcttgctctgttgcccaggctggagtgcggtggtgtgatctcagttcactgcaacctttgcctcccgggttcaagtgattctcctgcctcagtctcccgagtagctgggattacaggcacctgccaccatgcctggctaatttttgtatttttaatagagacggggtttcaccatgttggccaggctggtctcgaactcctgaccttgtgatccacccacctcagcctcccaaagtgctgggattacaggcatgagccactgttcccgggcctaatctttgtatttttagtagagggggtttatgccatgttggccaggctggtcttgaactcctggccaacaccacccacctcgcctcccaaagtgctggggttacaggcgcgagccaccgtgccaggccagaaatttaaggagttttaaaggttagcattgaaaagattactttccagaaattgagaccaccacagttccacaattgggactgtggtagataatcaggaccacttggaagcctttattaggaacagcccacacccagcccaaatgctgtcctcaaaaacattcctcagtttctctagctgaatgtaatctctccttgaaatttccctagttttatatatctatagttgactcatgctgtatttatttataccttgtttaaaattatttattgattatttattggtgtcatatcgcccctaaactgggacaggatctctaacggactcatctttgtgccacaacatgtaagcccaataggcaggtgctcacatatttgctgaaggaacagagaaagaactgcggagaaagacaaaagctcctctgaagttttagactatagaagcaaaaattatagtagcaaaagatgaatgagaaattctgttctagtcccagtgaagcaggaaggaaagggttgcaaacttgaggctggtaaggaagaaataattactgtgaatgcatttagccactcccctctactcaaaaatactggtaaactctgatttttatatttgtttagaatttaaattagaattctgtatctttattttttggaattctgttgttttgccttagtttcttaataaaaagttaaacattaaccacctgtgattgcttacatttaaagacattttttacacattggttagaaagaaaaattggggtgccttaatagccagaggtggtgatggaatttacctataaattccatggctttaataatagaatccacattccccatgtttagaatggaaagtggacagagaacagtaattcactagggtcttatttcccaattgcctctaccgccccccaccccaccctcctgctgacatttgtttgataatgcagttgtttgccaagaattatgagagacaggcatgctattcctgaactggctgaatacacggctcctgtgatccaaaagcttaaaagagaatcagttgatgatgttgctaaacaagttggctgatatgttaaagttcaaagcattttaattttttttttttttttttttttttttttttttttttttttttttttgagacaaagtcttgctctgtcacccaggctggagagcagttgatgtgctctcggctcattgcaacccctgcctcaggtgatccgtgtgcctcggcctcccaaagtgctgggattacaggcatgagccaccgtgcccagcccaaagcatttaaattttataaaagaaaaataggtgtaaatgttctgtatttgccgctttgtttagtggaaagagacgccagagacagctttaccagtctgttgtcctgatttcttttttggatcctccctcgaactgtttgcttcttatttaatgtgttcactaaaatactgttgagagcaacatgttctctagtcttcagaataatagtttgctgaaagaagtagccctttaagatttaagattgttattcagcttttgtatgtaggatttcatgatgagtggctcaagaagtaggaatcatttggggagtttccttaggtcaccctgttgatagtgtttaatttctgtttaaggcaggaaaacattaagaaaagattagagaagtcaagtcctgtctatgatatgatatgatacttgtacaccatgttatatttctgccccctttcctgtataaataaaatggggataaaatcaagtaatggttttgaggtcatagctcccttaagaaagtctccctgaaataatgtattaaaattctagcgtctcaagttagattcattagaggcatattgtagtgggaacagaccagatatctttgtttattttaatatagctaacttgttcatattcccaacccatgtttaaagagcatatgattgatctgtgcccccttgttggtcatcttcaccttggaaggaaaggaggcttaaggttgcaatgagagttgttgatgacatctctaacccctcagtaggccaaagagtgatgtagttcatgatccaattgcccagaatagcacggacagatggttactttgctaaaagacatgttggtagcaaagacactgctctgagcagagactggtggcaaagcccagcgcaatccacccttctgagcacagcctacaggaacttcagtgccgacggagtcacggaggccactctaggttttacatggccatagttgagcttctgaaattttgaaggatctccctgcccacccagctactagtcatccacttggtaatgtagacagaatgaaaaaggcaggaaagatcattcatcaaattattttctaacatccgttatctagcaggcttttaccaggtactagagatggaaagatgagaaggaaaaatcgaagttgctgacaagcttctgtgaaagcaaatgtggaaacagactactgtgaaactgaggtaactgctttaacgaaattacaggtgaggtccagggtggcataggagagggaatagttaacctggggcgatgtttaagctgagcttagaagatagtaggtgggagctaatgaggataaatccactgttccaggcaagtgggataggacgtgctatgatacggaggcacagataggtccgctatgtctggaaccatgctggacaagtggtgggggagggcatggaacagggaaattgcgtctggattataattgccataccaaatagtttgggttttgtctattttttcatgggggaagccattcaaaagttttcagcaggggcatgattagctacaaaaaccaatatctgaaaggtgggagtcaggaggtctaggcagaaaatgatgaggacctaaactaaggtgactaaagatggaggagggatgtatttaagagaatgcaggaacacatgtggacaccatttgtatgtcaagagtgagaagctttttggtgcagacatttataaggtactgcttattaagaaagggtattgaaaaggaggaatagattgggaggtgaggggccgagcgcagtggctcacatctgtcatcccagcactttgggaggctgaggtgggcagatcacctgaggccaggagttcgagaccagcctggccaacgtggtgaaaccccgcctctactaaaaatacaaaaattagtcggttgtggtggcaggtgcctgtaatcccagctactcgggaggctgaggcaggagaatggcgggaacccaggaggcggagcttgcagtgagccgagatcgcgccattgcactccagcctgggtgacagagcgagactctgtctcaaaaaaaaagattggggggtgagggtaacgagtgcggttttgaacatgttaaatcggaggtggaaatacagaaaaggcagttggaactagtgagcctggagttaaggagatcggcagccagctggatgagagagctgctggtgtgccgcgttcctcactggccgtacgggctccacagcccagcgggtagagcgagggaggcgggcctgcaatacccccaaaggacaaccaactgccttctaaaccgtgactctgccaactaaaggctgcgggggtgttttgttgtttcgggatttttcttttccttacataccccacacctctgaataacaatcctagcagttcaattttttttttttttcttggagacagagtctcgctctgtcgcccaggctggagtgcggtggtgtgatctcggctcactgcaacctccgcctcccgggttccagccattctcctgcctcagcctcccgagtagctgggattacaggcgcccgccaccacgcccggctaatttttgtatttttaggagagatggagtttcaccgtgttagccaggatggtcttgatctcttgacctcgtgatctgcccgcctcggcctcccaaagtgctgggattacaggcgtgagccaccgcgcccagcctcagttcaaaatttttaggtgcctctttttaattttgggagaagctcagcaatgttctatcattttggtcttgaggcaagaccactggatcaacagcacaggactcatgcggtctaagtcctgggggcgctgctggtcacgacgcgattccggagcagatgtcttccttcctggggctgttgctgaggctgacctagctcaatgcttctcattttgggatgcccactagaatcacctggggagttttttatttctttaaattagctttattgagataataactgacatcaaacaagctatacctatttaccagtgcacaatttgataagctttgatgtatgtatatatccatcacaatcaagatagcctatatgtgggaagcttttaaaagataagatgcagccgggcgcggtggctcacgcctgtaatcccagcactttgggaggccgaggcaggcggatcacctgaggtcgggagttcgagaccagcctgaccagcatggagaaaccccgtctctactaaaaatacaaaaattagccgggtgtggtggcgcgtgcctgttatcccagctactcgggagactgaggcaggagaatcatttgaactcgggagggggaggttgcagtgagctgagatccagccattgcactccagcctgggcaacaagagcaaaactccttctcaaataaataaataagatgccctagcaaattaaattccatggagtagtagagtggagttttgtttgtttgtttttgttgttggttttttttgagacagagtctcactctctcccaggctggagtgcagtggcccgatctcggctcactgcaagctccgcctcccgagttcacgccattctcctgcctcagcctcccaagtagctgggactacaggcgcccgccaccacgcccagctaattttttgcatttttaatagagacggggtttcaccgtgttaaccaggatggtctcaatctcctcatctcgtgatccacccccctcggcctcccaaagtgctgggattacaggtgtgagccaacgcacccagccttttgtttgtttttaagtctccaggtacttctcccctgaactaggagaccaccattcaggaatgacatttgagcagcctcaagtggaggcaaaaatctctggtttattttatgttacgatttgattattttattttattttatttattttattttttgagacggagtctcactctgttgcctaggctggaatacagtggcgcgatcttggctcactggaacctttgcctcctggctgcaagcgactctcctgcctcagcctcttgagtagctgggattacaggcaagtgccaccatgcccagctaaattttgtatttttagtagagacggggtttcaccatgttggtcaggctggtctcgaactcctgaccttgtgatccacccgcctgggcctcccaaagtgcagggattacagacgtgagccaccgtgccaggcaaaaatctctggtttataaccaggaaaattgtatgagaaaaaagagctctagctctagagaccaagagcaaggtgatggcagtgccagagtgagcacctaaggcaagactgtctcttctgtgggtctttctatggcccttagtgagctaaagtgaggctgtcatttaaaagaggttctagcccgggtgcggtggctcacgcctgccatcccagcactttgggaggccaaggcggacagattatgagatcaggagttcaagatcaggctggcgaacatggtgaaaccccagctctactaataatacaaaaattagctgggtgtggtggtgggtgcctgtaatcccagctactcgggaggctgaggcaggagaatcgcttgaacccaggaggcagaggttgcagtgagtcaagatggtgccactgcactccagcctgggccacacagtgagactccgtctcaggaaaaaaaaaaaaaaaaaaaaaaagaggtgtccttatcaggattctttcaggaattagtgctttggtccttcctatatcggagtggcaatgacatttgggtgcctaaccaaagctgagcagctgcacctgtggtttgtcacatcttaaaatcaaacttcttatctctgataaaaggagatataatgattgaaaattgctacaggaaagaaacaataaaacctaatgtcatgggctgagttgcatccccttgaaaatttatatgttgaaatcctccagtaccgcagaatgtgaccttatttgtaaatggggtcatctcagatgttactagttaagatgaggtcataccagaaaagactgggtccctaatttaagataactggtatccttatgaaaaagagatttagacgcagacatgcacacagggaggatcccatgtgaagatgaaggcagcgatcagggccatccagcagatgccaagtgccaaaaactgccagcaaaccaacagaaaccgggcagcggcgcgaagcagattcttccgcaccaccctcagaggaaaccagccctgctgacaccttcatctcagacttctagcctccaggactgtgggacgatacttttttctttttttttttttgagacggagtctcgctctgtcgcccaggctggagtgcagtagtgcaatcttggctcactgcaagctccgcctcccgggttcaagcaattctcctgtcccagcctcctgagtagcgggggttacaggcgcccaccaccatgcccggctaatttttgtatttttagtagagacgcggtttcaccatattggtcaggctcgtcttgaactcctgaccttaggtgatccccctgcctcggcctcccaaagtgctgggattacaggcgggagccactgcgcccggcaagggacgatacatttttgtcgttgaagccaccaactttgtggtactttgctgtggcaaccctaggaaacacaccttttaatttttctctctaccaattctatttctttctggaggcaactttgattttgtgtttggttgttcgccggaaccatgggaaaggccaggaacagttttaaggtgttaaggtttgttggaaggtctttgtcaggttgcattcgtaacccagtgtttgtaaagtacttagtgtagtggttaggggcatggattctggggtcatgaattcaaacccacgttctaccacttactagttctgtgaccctgggtgggacatttgatccctccaagcctcagttcccttatctgtaaaatggggggcggggggaatcgtgctacttactttaaaaggtgatgtgagcattacatgaaacgcacattgagccacttagaacagtgccaggagtgtagtaagtattcactgtatttctcattattattactgaactgttctataataggtaagtatcattaggagccaaccatggaagaaaagcaattttagtcactaaaaaaaaaaaaattgtggtgaaatataaaacattccattcatctggttctaaaattaagaataggaaacattttaaaataggaaatgttttaaaatttaggaaacatttaaaaatattcaaagcaacagaacctgaggtagtacaagcaaaataagtttattttagagatacagggctggctcccagagatcaatagcaggaatgccttgtttttcatgaggaagttggacaaagcaatggaaagccatcaggagcctgggaataccacctcttccttattcccgagacatttcttcattctttccccaaacttcctcttctacatagtccacgttgtgaaaaatggccacccacacttctcccctccatccaagagatcacctcggggtctcagatagactccaattcctactactggtccaatcagctatggccatgggatggggagtgggctcacacggtacctaggatgccactggggtctcagccctacgactctgtggctgggggatgagggggagggaagtcataaagaagagagaatgggtactgcaggaagacactaataaacatgcttcctcccacccccaaagtttggccatatgaggaatagcacatttgaggactccccagaagaaaaacgacaaaggaggctgaaaggagtgaagaggaaaaaagatacagaggggagagcaaggtaaccccatcaagtactggagactcacagcaagacagccacccagagggggagcacagcgtctcggtgtaagactcagggtggtgccttgcccagcctctgccctgagaagcaacagacactacctgcgctgtcaggggctgtgtctgagcaggagctggtttgctaaatcaagggcaagaagagaaagctcaggtcttttgggtcttgaagaaactgtacttcttacctcgtccttctcttctctgttttaagggagagactaaagaatggtgaggtttgaaactcagaggaaaaccagcttggtgatctgttttttgtttagctgacacgaaatcattcacacccagcagctcactgcctgcttattttaagcatgaaaaatgagggtaataagtttctccctctcttgtgggaattatgttcatatctttcactggactcctttcctacacacccagagcttaattttggttacttttggaatactaaaatgaactgagggtcccagcctggaagggagtttggtgatgaggtgaaatgaagtattttagggcaaggatggcaacggaattcaaatcctctgccgtgacacccaagtgaaatgctctgcttctcacagagtgacacttagagctgtgggttttgagacagatagaaagggatctctcttggttttttgtttgttttttgagatggagtttcgctgttgttgcccgggctggagtgcgatggcgcaatctcggctcactgcaacctctgcctcccaggttcaagcgattctcctgcctcagcctcccaagtagctgggattacagatgcccgccaccatgcccagctaattttgtatttttagtagaaacaggctttctccatgttggtcaggctggtctcaaactcccaacctcaggtgatccacacgccttggcttcccgaaatgctgggattacaggcgtgagccactgcgcctggttgaaaaggatctcttgtaggaagatggaacccagaggggcttaagaggacctacgcacccgcaggcctcctctccctgcacaaaaacataggcgtcccctgatttcatgaccagttgtcatgaaatcacacccaagtccctcacttagaaacccccacgatgagttaaactattcactggccgggcgtggtggctcatgcctgtaatcccaacactttgggaggctgagacagttggactacctgaggtcaggagttcgaaaccagcctggccaagatggcaaaaccctgtctctactaaaaatacaaaaattagccgggcatggtggtgggcacctgtaatcccagctactcaggaggctgaggaaggagaatcgcttgaagctgggaggcggaggttgcagtgagccaagatcgcaccactgcactccagcccggccgacagtgagactcagtctcaaaaaacaaaaacaaaaacaaaacaaaacaaaaaaacaccgttgcctgcagcttccctgcccataaagaaacgcatgctatagtgaaggaaagtggcacagccttgtcttctatgcatctgccttccaagaccttatcagaagtggctggtgcacaatttatgattgaggtcttcttacctcttttcccatcataatcatgactagcagcaagaatggaacatgtagagccctagtctaggcaatcaatatagcactcacattcctttgactcagcccctcctccatggaatatgcagcgcgggtactgttagtgtgtctggaattggtgggttcttggtctcactgacttcaagactgaagccgcggaccctcgcggtgagtgttacagctcttaagggcgcgcgtctggagtttgttccttctgatgttcggatgtgttcggagttttttctttctggtgggctgcagactttcgcggtgagtgttacagctcttaaagcggcgcatctggagttgcttgttcctcccgctgggctcgtggtctcactggcttcaggagtgaagctgcagacttttgtggtgagtgttacagctcataaaaagcagcgtggacccagtgagcagcagcaagatttattgcaaaaagccaaagaacagagcttccacacaatggaaggggaccggaacggcttgccgctgctggctcgggcagcctgcttttattctcttatctggccccacccacatcctgttgattggtagagcctagaggcctgttttgacagggcgctgattggtgcgtttacaatccctgagctagatacaaaggttctccacgtccccatcagattagttagatacggagtttccacacacaggttctccaaggccccaccagagcagctagatacagagtgtcgattggtgcactcacaaaccctgagctagacacagggtgctgattggtgtgtttacaaaccttgagctagatacagagtgtggattggtgtgtttacaatccctgagctagacataaaggttctccacgtccccaccagactcaggagcccagctggcttcgcccagtggatcccgcactggggctgcaggtggagctgcctgccagtcctgcgcgtgcgcccgcactcctcagcccttgggtggtcgatgggactgggcatggtggagcagggggtggcgctcgtcggggaggcccgggccgcacaggagcccacggagggggtgggaagctcaggcagggcgggctgcgggtcccgagccctgccgagcgggaaggcagctaaggcccggtgagaaatcgagcacatcgctggtgggctggcactgctgggggacccagtacaccctccgcagccgctggcccgggtgctaagcccctcattgcccggggccagcagggcccgccagctgctccgagtgcggggcccgccaagcccacgcctacccggaattccagctggcccgcaagcgccgcacgcagccccggttcccgctcgcgcctctccctccacacctccctgcaagctgagggagcgggctccggtcttggccagcccagaaaggggctcccacagtgcagtggggggctgaagggctcctcaagtgccgccaaagtggaagcccaggcagaggcgggccgagagcaagcgagggctctgaggactgccagcacgctgtcacctctcattaggactctgcagcgcgggtactgttaggactctgcagcgcgggtactgttaggactgggtccctgcactccaggtcttcagagatgttgtgcttaatatttctgggcacctgctatgtgttttatctacattacttgatttatttattagaatatcttgatggtattcacattcgtggaacactgaggctcacagacgataaataacttgctaaagtcacacaccttaagtttcagagtcttgtttcagcctagatctctgactcaaaactttggttactttctcctcaagggggaggcagacgtgtcgcagataaacatccaataacaagtaagtgctcttgaagagataaacatgagtagtgctggggtggctgacttgcctggagagtcagtagatacattttgactgttgttttatttaccaggactggagaggaaaatgggaagaacatatattctctctcttcacagccagctcctctctgctcctctcctcgcttctgtgaacaattccctcagcctgtgtatgaatcatgatcaccattcactatagaaccctgacctgtgtccgggttgccagacataatacaggatgcctgatgaaatttcagatcaatgaatagttttttagtatacatacatacccaatgttgcatgaaatataatgatactaaagaattattcgtgtttaaaattcaaatttcactgtgggcactgcattttttcccaattttcaaactgtggtactgtacacataatgtaaaatgtttaccatcttaaccaatttcaagtgtacagttagtggtactaaatacattcatgatgtgtgcaaccatcagcaccatccatctccagaactttgtttgtttgcttatttgtttagtagagatggggtcttgctgtgttgcccaggctggtctcctgctccgtgactcaagtgatcctctcgcctcggcctcccaaaggctgggaatacaggcgcaagccaccatgcccggcctctcgagctcttttatcttgtaaaattgaaaccttatgtctactaaacaataactctacattcccccaactccccagtccccggcaaccaccatgctactttgtgtatctgtgattttgactcctctaaacactgcagataagtggaattacacagtatttgcccttttgtgactggcttatttcacttagtgtaatatcctcaaggttcattcatatgttgtaggatgtgtcagaatttttttcctctgtaagactgaagactgttccatcgagccacgttttgcttatccattcattcgttgatggactctgggttgcttccacgctgtagctgctgtgaggaacgctgctgtgaacacgggtgtgcaaaggtctctttgaggctctgctttcggttcttgtgggtctattctcagcagtgggatgctgaatcatacagccattctctgttttatttttcgaggaactgccagactgttttccaggctggctgcacattttacactcccaccagccgtgcacgaggattccatttctccacgtcctcaccaacgcgtctatctgatgttttcgttttcccaaatagccatcctaaagggtgtgaggtgagggcattctttatttgtatttgccaaatgtagcgaccctaaagcccagccagagacctcttgccgggctctgatgtcacaccttgcccatctaacccttgccttttctgtgtcgcatcctggcctggactcctggtcctctggtcctcacccagcctctcctcatttactgctgcccatgcctcagtgtgagactgtgtctggggctctcgtcacctcttcttgccttgctccctctgagagcacctcgctggcaccacactgacaggttggcaccataggctgagcctgaatgtagaaactggcagaacatcaactcaaaggaaatgtcccaagaggagaaaatgttgagacagcaaaagtctgtggcctaatctcagagcactcacagttatagatccctgacactttgcaggccagaagaagctgaatttttagttatttgatcctttccccagttagggttccagcttcctcctcctttccctttttcagatactaagaacccaccatgagcaccacactgacaggccggcatagacaagtaaaactctgccctcaaggatctaggcccagtgaggaagccgagacctttctaaatagttgtaacatatagaaaatgagaacagctgaaggaagtgcaggaggaacgccacatgagggcatttgcgggtgagggagggtccaaggaactttgtggagcaggtgtcatctgagcagaaccttaaaagataaatggtatttaagcatgtatcaatttgccaaataaaattgttaacacaaatttatatttatttatttatttatttggagatggagtctcgctctgtcgcccaggctggagtgcaatggtgtgatcttggctcactggaacctccacctcccaagttcaagcgattatcttgcctcagcctcccaagtagctgggactacaggtgcacaccatcacgcccggctaatttttgtatttttagtagagactggtttcaccatgttagccaggctggtgatctagccataggtgatctacccaccttggcctcccaaagtgctgggattacaggtgtgagccactgcgcctggctgcacaaatttattaatagcaatttaccaatgttgctcgctaaaactttattacttttttttttcttttttttttgagacagagtctcgctctgtcacccaggctggagtgcagtggcacgatctcagctcactctaacctccgcctcccaggttcaaaagatttttgtgcctcagcctcctgagtagctgggattataggcgtgcaccatcaagcctggctaatttttctatttttaggagagacgaggtttcaccatgttggtcaggctggtctcgaactcctgacctcatgatccccctgcctcggcctcccaaagtgctaggattacaggtgtgagccaccacgcctagccaaaactttattccttttagcaatttgtagaatgtatagcaatttaatttttaccaagctttcccaatattccatttatttatttatgttttcatttcaggcaatgtttatgtcccaaatgtcaaaaaacattttaaggttggtttttctcttccaaccatgtttttctggttttaaaagtaatctttatttttaattaatttattaattaaattaatataaattaatgtgatagaaattaggataatttaattactcttagttaatatgtgcattataagaaaccgaaaaacacaagaagcagagaacaaggccgtccacaatcacgagcagtttgcagttgaccgtgtccttccaggtcccgtgtatgtacagacacaacacccagtggatcgtgctttgtcacacaacattctgcccaattttaaatccgttttgctgcctccttgagattctgtgactctagtggcttggttcccacaggtatctccctttgcaaatctatgcttgaaggtttctctgtcatgctaagtcagtgactattatttttcaattctgacatctttgaaatatgcagaagagaccaggcgcggtgctcacgcctgtaatcccagcactttgggaggccgaggtgggcggatcacgagctcaggagatcgagaccatcctggctaacacggtgaaaccccgtctctactaaaagtacaaaaaaattagccgggcgtggtggcgggcgcctgtactcccagctactagggaggctgaggcaggagaacggggtgaacccgggaggcggagcttgcagtgagccgagatcgcgccactgaactccagcctgggtgactgagagagactctgtctcaaaaaaaaaaaaaaaaaaaaaaaagaaatatgcagaagagtaaagagaataacaacaaacacccatctgctcaatgttcagctttagcaaatcttaaccttttgccaaatttgcttcagatatttttttctcagaaacgaaatattacagatacagttgaagcctcttatacatctatgcctgtgatttgactcctttccctctctctccagaacttgacacgtgtcattgctgtgtttgttttcatgcttttctgtagtgtgatgggtccccagccaagttactaaagagtgtgtgtctgctgcctgaaccctgaaggccaggccatgagccaaggccacagtgcccagcagaggagcaggtgtccctcagaaccaagcgtcccggagggtttctaagaaactaccaagaaaaacagtccatcactcacacagtgggcaaagagccagaaaattagcttaaaggcagctcaagagtgtggccgggcacggctcatgcctgtaatcccagcactctgggaggtcaaggtgggtggttcacgaggtcaagagatcgagaccagcctggccaacatggtgaaaccccatctctactaaaaatacaaaaattagctgggcgtggtggcatgagcctgtagtcccagcaactcagaaggctgaggcaggagaatcacttgaatccaggaggcggaggttgcagcgagccaagatcacgccactgcactccagcctggagacagagcaagactccgtctcaaaaaaaaaaaaaaaagagtgggaaaatgggaggcaatgcaggtctctaaagctgtcctgctactgcccaggaggccttgtatgtaggtccaaataaactcatctacttgccaagctggacgtgtctcagtcattctttggtctctcagcctcctcctagtttgggaaaaggttttttgtttgtttgtatttttttaatacaattccaggttttctttgttatgtttctacatatccattgatctataaagaaggcttagcattttttgcatatttctaaaccatatacaggatatatacacatgcgtgtgtgccacgaaccgtttatgtcctcctgcaacttcgtgttcttgtgatttatccattcctaaacatagaactgttacttcttttttaattgctgtacagcagaggtccccaaaccccagcacaggtgcacagcctgttaggaaactgcgtcacacggcaggaggggagcagcaggcgggtgagcaagtgaagcttcatctgtattgacagccgctccccatcactcgcattactgcttgagctccgcctcctgtccgatcagcgccggcactagatactcatagctatgtgaaccctattgtgaactgagcatatgagggatctaggctgcatgctccctatgagaatctaatgcctgatgatccatcagtgtttcccatcatccccagatggaaccgtctagttgcaggaaaacaagtgcagggctccactgattctacattatgctgagttgtataattatttcattatatcttacaacgtaataataatagaaataaagtgcacaataaatgtgatgcacttgaatcatcccaaaccatcccccacccccagtccatgaaaaaatggtcttccaggaaacgggtccctagtgccagaaaggttggggaccgctgccgtacagtattccatttcaccaacatactaccgtctatcaattcttctgttcacgaccatttaggttgtttccaatttgtgattacaaacaaagctggaatgaattctgtatgtatgtgctctagtctctagaatatacattatgagaagcggcattctcaagttctggcttatgctcatctccgcctttgttagatattgcctcattgttcatcaccatcaatatttctgtttatcaagcaagggacgagggcaagcagcaaaaataacacatggtacaggtatgtttcaacctgcaggtgtgaggggatgcatatagtgcccaagattctcaccatttcatggggaagagtgcttaggctaggcatagctggacacatcatgtgttctgtacaagagagggaatataaaattccttgttgtctcacgcatttataaagtattatggagggcaggcgccgtggctcacgcctgtaatcccaacactttgggaggctgaggcaggtggatcacctgaagtcaggagttcaagaccagtctggccaacatggtgaaaccccgtctctactaaaaatacaaaaattattcatgcgtggtggtgggcacctgtaatcccagccactcgggaggctgaggcaggagaactgcttgtacctgggaggcagagctcgcagtgagccgagatcacaccaatgcactccagcctgggcaacagagcaagactctgtctccaaaaaaaaaaaaaagaattatggaggaatcagagatcatctgaccaaggtgtctttgcaattcaggtttcagcctttctggcctaagaaataatgttagaaacaacccaataatccagacagtttatacatgagggggtttgtggccctccctgaagagccagcttattgctaggttacctgaaaaaagactcacaagggtcatccacttaacaaacttgtttatccctctgcattacacctctggccctggcgatttattaaacaggctttccgacccagggcttgtattagttgacaacatcgtgacaagtttgcatcatgggccatgaaaggcataaaaggtattttgaggcttctgtccatatctgtaaaacaaaaggagaaatagtctttaaaacatttttaatataggtttttaatctatctagaatttatttttgttatggagaaagtagaaatttcattattaaatacatactgttaatattgtatcctgctcctatttattgaatagcttatgcttccattgatttacagtgcctcctctgtcacatatcaagtttccatatgtacatatacatgggccagctcctggactgtctgattcttttggcctctttgtctacacataggctagtactatacactcttagttgttctcactttataatcaatcttagggtttttgttttgttttagagtcacggtcttggtctgtcacccaggctgtggtacagtggcatggccatagctcactgtacccttgaactcttgggctcaagaaatcctcccatctcagcctccctagtagctgggacttcaggtgtgcaccatgacacctggtcaatcctttttatagatcttttataatgttttaaataagcttttttctagggctggagtctcactatgttgccaaggctgagctcgtattccagatctcaagtgatcttcctgggatcgtaggctgggattacaggcatgagccctgtgatcacggctcaccgcagcctctgtctcctgggcccaactcctgatcttgaactccttggctcaagtgatcctcccacctcagcctcccaagtagctgggactacatgcacacaccactatgctggctaatttttttgcatttttttgtacagacagggtttcaccacattgcccagggtggtcttgaactcctgggctcacgcaatccgcctgccttggcctcccaaagtgctgggattacaagcataagccagggtgcccagccccagtcttcattttgaaagagcaattccctcaaacttttggttttaaaaaattgttttggttattcttggccctttactcttctatatagattttagaacgtaccttgtgaagtcacctggaagttctgttgggatttttattgaaaattgaaaatataaatcaatatgcatgttgaatcaatagacttgggaagaattggtatctttatgatgaaatgcattctcatccatgactgtagcatatcttcatcatcttttatgtcattcaatattgtctttgaagatccaataaaaagatagggttctctgcttgggtttggcccctgtagaggccaaaatattatctttattgctggtagcgaccaggttagaggacgtagctttaggtctgttagctgagtgtttagtagatcaaggcaacaaatatacaaacaatttgataaacatatatatatatatataaaacaccgccagcagtttgctccccaaaaagaaaagcagaactaacatatccagattattcttcctaaatttactatttaacatcactctgtcctccaaggagcagaatgagtaaagaggcagagagactgagactatcacaccaatagaggtccttgaaatgaatggaaatcttaggagtaggaactaagcatgctttcctcacaggcatctaagttgtttgtgtacagatcctttgcccatttaaaaaatgagtaatttggccgggtggagtggctcatgcctgtaatcctagcactttgggaagtcgaggtgagcagattgcctgagctcaggagttcaagaccagcccgagcaacatgatgaaaccccgtctctactaaaaatatttaaaaaattagctgggcatggtggtacacacttgtaatcccagttacttgggaggctgaggcacaagaattgcttgagcctgggaggcagaggttgcagtgaactgagattgcaccactgcactccagcctgggtgacagattgagactctgtctcaaaaataaaaaataaaataaactaaaataaaaaatgcgtaatttgtctttttattgttgagttgaagtccaatttatttacttcttttgtcacttgggcttttggtttcatatctaagaaaccattgtctagttcaaagtcacaaagatttactcctttgttttcttcaaagggttttacagtttgatctctcacatttaggtctatgagaatttagaattatttttttgtttatggtgtgaggtaggaattcaacttcattctcttacatgtggatattcacatgaactataatctgttcaatcatttctcctttactgttattttcttctgaggcttttaaaaggggatatattagagacccaatgtattgtctcgattgcctagctgatgtcacatattttttacttgaaaaaatgtctttatcgtgtttactgctctgtcttgtgttaattcacaaattttctctttgtgctcagtatggagtttattctattagattttaaaagtcattaaacatatgtcatgttcgtaagatttctaacccatttttttctcatttaaaaataaactaatgaatttactatttttgaatatgaaacataggcacacagcacagaattcaaagaataaaaaatacaatgatgaggttattggctttaaaaatatttacctgttcttgtttcatttttgttagttcttgtttcataactttgttataatgtgtgttatttatagagctataagtgtgtgtgcagggggagttggtagaagacaacataggtcacagcctgtgcaaggaagaatagtgggagacagaaataaagaggtaagttggggtcagtttgtggactttggaataaaagggaagaaaacagttgtcgaagagtatgaagcttattatcttagccatgtagtctttgaataatttttttaccacttaataaacattgtgctttaagaaggctaaaatgcttcagatataccaaagggaggagatgggtagtctaggcctcattaaaaggcttccatctcaggtgggtacccaaccaccttatacttccttgaccccttttcacaggcctgtatgctgattataagccagacgtttcagacattttgtgaaaagattttagtgtctggctatatttaaatgctctgttttatcacttacccttcaaagtcccctcctctcctgcccctgatgtggccactctgaaaggagtccctctccccgggatccaacagtgttctcccagcagggggcagcagcggcacatgtcaggtgcccaggggagggtggggtgccaaggggtgccctgtggggaggagcttgcatgaggaaacacatggaatggaaaaagtaaactagttcctcagtcccacttcagagtcaaacccgcacctgtggtgagttgagccacaaatatgttttctctaaagctggcagccgtttattttggaaggaggaagatgcactcaatactattgaggacctggcttttttttctttgctttttcctaatttcttatcctctgcttcggccataaatgttctagtttctctcactcttctctttcccttccttcatgtccaacattttcccatttttttcccaatggtcaggagtataggtctggccaaataatcaccttctagtaataagaatatttctggaaataagaaacacagcataagggaagggaaaagctggttggctcccccagttcctcacctaccccagaggcatcacactgatctccaagactatcatcacccggaaggcaaaggcctctcacaatttcttacacatctctatgttccccactcacttgctagactggatgagaacatagacacccacctgcaatctggtctatagctttgtccacacccgcatggcatgtggagaaggaatgcctgggggtaggacctggggggctggggatcaaaacactgtaatgaggggtagttttgcagaaatccccaaaaatgtgatcctaggaccttctcactgcttctccctgaaatccactgttacaatgcccttatactatctcggtatctaggtgtaccacagtagaggcagcgtggtaactgtgtgacctctaacctagtcccaccatggccaaggtgacaaacatgtacatgggagtttatcatcttgggcgtggttgaactaggttagaggtcacatagttaattttgggcaagtcacttgccttctctgggcctcagttttcttttcttttttttttctgagacagagtctcactctgttgcccaggctggagtgcagtggcgtgatctcagcttactgcaagctccacctcccgggttcatgccattctcctgcctcagcctcccgagtagctgggactacaggtgcccaccaccatgcccggctaatttttttgtatttctagtagagacggggtttcaccgtgttagccaggatggtctcgatctcctgacctcgtgatctgcccgcctcggcctcccaaagtgctgggattacaggcgtgagccaccacgcccggccctcagttttgttatctataaatgggtattaataatgcctttcataaatatctcacagaggacgggcgcagtggctcatgcctgtaatctcaacactttgggaggccaaggctggaggattgcttgaggccaggagtttgagaccagcctgggcaacaaagtaagaccccatctccacaaaaaataagaattagctgggcatagtggtgcatgcctgtaatcctagctacttgggaggctgaggcaggaggatcccttgagcccagaaggtggaggctgcagtgagctgtgatcgtgccactagactctagtatggtgacagagtggcgccttgtctctaaaatataataaaaataaatacctcacagacgtgagatactcaagtaagataataatgtgaaaagtttgcatttatggtggagtgtttttaaaacattatttatcattactagctctttttcaagagcactttggcccttgtctcatgggcatgttgcttgaatttcagccaaaggattaggtgttgggacaagttggcttaaaaacatcttttaaaatttattttaatttatttttagagatatggtctctctatgttgcccaggctggtcttgaattcctggcctcaagccatcctccttgcctcagcctcccaaagtgctgggattacaggcatgagccaccaggccaggccaaaaatttcttatctttaattattacggatacataatagttgtacgtctttcaaattgaactcttgaggggtccagggccattgagaggaaagacagcacagaaccaggtggatttatttctagggatttggctcctagccccttgtcagggaaggtggcttctttctttccctggggccaagagagactaatagggagatgtatctctagaatcctaggtctgaatgagacgccaatgggtcattggttttaggtgtttttttgtttttgtttttgcccctcaggtaaggctacatcgaaaccacactaagaggatcagaaagaatatatgttaaatgtttccaaggagattctatattctttccaggtaattcaggactaaggatgttttacagcgagttcttctttttagccttttggctgcaattgagggttgaaaatgctttgagggtagtctattcatctttatatcctgtccaaacccagcacaaacaggccctagggtcccgtctattgacctgaactgcattgttctgctctgcctggagctaggaaatatgctggtcactattttttgttggctttaaatatagtatttgcaaagttcaaaacaaatcttatgatcatttggcttgtggcttctctcctaaatctccctccttttagaatggtcaggatgggaggaggacgtgccaagactgagcttctgtttcttttcaaggacagtccctgcaatggcttcgtttgacctaccctcccttttcttatcaaatgaaatcagctaccacaggaaattgacttctccagattgtaggagacaggaagcagcaccacaaagcaggttccagggagggaaggcagagatgagagaaacagctcgagtcccagctcggtcagtgcctggccccggcctcgctttccgcctctctgtctcattcttaccatctctagcctcacctacccttcttctgggtcctggtgtctgaggctgaaaggcgctgtagaagtctccaaggccagcctccctccccactcagtcactcccaacaagccttccagcctgtgcttgacccttccaggcatggaaattttactgcttcccctaagaaaccagctctgttttgccttttatccatctgaaacctccctcctccagtgttcttccactggcctcacttttccttgggacagccctttccatacctgagtctccaggctaagccctcccggggaggtctcttggtagaggcatgagtttctcagaaactcaaccagagggagtcaggaaggggtctaagcaggaaggaaaaggtgagaacaatgccatcgtgggccctttccttgccaaggagttatgtgtggtggctttaacttgatgtttagtacaacttcaacgtgcttttcttctcctgcatgactactgccttgtgggaagagtgtcttctcttttagctcacttcattaattttttatgaaatatctaaatacatatataaaggtgtcatgacattccactcctaaatacttcagtgtgtatctttaagacgtaagaatattggccgggagcggtgactcatgtctgtaatcccagcactttgggaggccaaggtgggtggatcacctgaggtcaggaattcaagactagcctggccaacacggtgaaactccatctctactaaaaatacaaaaattagccaggcgtggtggtgggtgactccaatcctagctattccagaggctgagacatgagaatcacttgaacccgggaggcggaggttgcagtgagccgagatcacaccattgcactccagtgtgggtgacaaagcgagactttgtctcaaaaaaaaaaaaaaaaaaaaaaaaaaaaaagaatatgttctgcatagccaaaatcaaaatataacacccaacaaaattaactataacctcccgacattatttaatacttaatccacaaaatttccccagttgattccaaaatgtcctttactgctgttttgttcaaaccaggatccaatccaggaccacgcatttcatctggttgttatggaacttagggctcttttatggatgatgctgataaatagaaggaagcttcattgttaaagtgctctctttttaaaaattcatatcagggccaggtgcagtggctcacgcctgtaatcccagcactttgggaggccgaggcaggcggatcacccgaggtcaagaattcaagaccagcctgggcaatgtggtaaaaccctgtcttgactaaaaatgcaaaaattagccgagcatggtggtacacacttgtaatcccagctacttgagagactgaggcaggagaatggcttgaacccaggaggcggaggttgcggtgagctgagaccacgccgctgttctctagcctgggcaacagagtgagactccatctcaaaataaaataacataaaataagtaatcaggctgggcacagtggctcactcctgcaatcccagcactttgggaggctgagggggcagatcgcttgaggccaggagtttgagaccatcctgggcaacctcgtctcctcaaaaaatacaaaaattagctgggcgaggtggcgcatgcctgtggtcccagctactcgagaggctgaggtgggaggatcctttgagtccaggaggcagtggtttcagcaagccgagatcatgccactgcactctagcctgcgccacagaaccaaaccgtctaaaaaagaaagaaagaaaaaagaaaaaccaaacaaaatacatatcatatatcatcaacatagttcattacgccattattatatcatcagtatagttcacattacacatcacatgacagtggtaccactcagacgccatgaaccttctacttgagacagttaaattcaagaataatttttttggccgggtgcggtggctcatgtctgtaatcccagcactttgggaggctgaggtgggcggagcacctaaggtcaggagttcgagaccagcctggccaacatggtcaaaccccatctctactaaaaatacaaaaattagctgggtgtggtagccggcgcctataatcccagctacttgggaggctgaggcaggagaattgcttgagcccagaaggcagaggtggcaatgagccgagatcatgccactacactccaacctgggcaacagagcaagactccatctcaaaaaaataagattaaaaaaaaaaggataaattttacaagactccatctcaaaaaaaaaaaattttttttttttttttttttgagatggagtctggctctgtcacccaggctggagtgctgtggtgcaatcttggctcactgcaacctctacctcccaggcttaaatgtttctcctgcctcagcttcccaagtagctgggactacaggcgcatgctaccacatccagctaattttcgtatttttagtagggacggggattcaccatattgggcaggctggtctcaaactcctgaccttatgatccgcctgccttggcctcccaaagtgctgggattacaggtgtgagccatagtgcccaagaataatttttttcaagaagtattcagtctatagagtcccagtaacagaggtaataaacatacacatggtagtatttcaaattcatgaatttgttcagcttgggagcaatgggaatttagctttttcttttatcttttttttttttgagatggagtcttgctctgttgcccaggctggagtgcaatggcacaatctcggctcactgcaacctctgcctcctgggttcaagcagttctcctgcctcagcctcccgagtagctgggattacaggagcccgccatcacacctggctaattttcgtatttttagtagagatggggtttcaccatgttggtcaggctggtctcagactcctgacctctagtgatctgcccaccttggcctcccagagtgctgggattacaggcgtgagccaccgtgcccagcctagagctttttcatgtttatttatttatttatttatttatttatttatttattttcagaataacctgaaatttattctagttatattggaaaaaagaaaatcctcaatcactatccacatcatacaacataccaattctgactcaaatgccgacctacatttttttttttagactgatggggtatatgcgcatgtttgttacatggttttttgtttgtttgtttgtttttgttttttttcttttttttgagacagagtcttgctctgttgcccagggtggagtgcagtagcacgatctcagctcactggaacctctgcctcctgggttcaagtgattctcctgcctcagcctcctaagtagctgggactacaggcacccgccaccacgcctggctaatttttgtatttttttagtaaagtcagggtttcatcatgttggtcaggctggtcttgaactactgacctcaagtgatcctcccaccttggcctcccagagtgctgggattccaggtgtgggccaccgcacctggccacatgggttatatcgcattatggtgaggactgggcttctggtgtacccatcacccaatagtgcacattgtacctaataggtaattttttgcccctcatccctcccaccctccccccttctggagtccattccatcttcatgtccatgtgtgcccattgtttagttcccacttagaagtaagaacatgcagtattggagtttctgtttctgagttagttcacctaggataatggcctccagctccacctatgttgctgcaaaggacataatttcattttttttttttttttgagacagagtcttacgctgccacctagactgaagtgaagtgatgcgatctcaactcactgcaacctccgtctccctggttcaagcgattctcctgcctcagcctcctgagtagctgggattacaggtgcgcgccaccatgcccggctaatttttgtattttcaggtgagacggggtttcgccatgttggccaggctggtctcacactgctggcctcaagtggtccacctgcctcaggctcctaaagtgctgggattacagacgtgagccaccgcgcccggccacatttcgttcatttttatggctgcagttacagtgttctagctggttcttctgtgtcctttatttcctataaatgatcaatgagatgttaacatttgatttaattcaagttagacacttttagcaaggatatatcctaagtgctgctgggtgcttcgtgcgcaccatggtggaagacatattctggttgttctcccatcagtgatgctaatattaacccctgcattagtgctaacagtgtgaccctctgattgtgaccccttgattgtgacccctttattgtgactcctttattgtgtttcttttcctctcttgtgaccaaagagaagtctgcatggttgctgttgcatcacacaaatgtcaggtgatgtttattttattttatttattttttttgagacggagttttgctcttgttgcccgggctggagtgcagtggcgcaatctcggctcactgcaacctccgcctccttggttcaagcaattctcctgcctaagcctcccaagtagctgggatgacaggcatgcaccaccacgcctggctaatttttttttttttttttttttttggatttttagtagagatggggtttctccatgttggtcaggctggtctcgaactcccaacctcaagtgatctgcctgcctcggcctcccaaagtgctggaattacaggcgtgagtcaccgcactcagccaagtgatgtttatttaaaagtcacaattggtcagaaaaagaaaaggcagatatgttaggattctcaaggacatatatacagagaaagagatatttttaaggaattggttcacatagattatggaggtgggctagtccaaaatctgcagcgtgagctagcaggctggagaacttcctcttcctccagggagcagtctttttgtttcaggccttcagcagactggatgaggcccactcgcattatggagggtaatctgctttgcttaaagtccactgatttaaatgttaatcttatccaaaaatatcctcacaaagacatccggaataatgtttaaccacatactgctctgaaaagtcaatgggttcattttttttctattaaaaaaccccaccacatatctcggcattgtggcccagctaagctgacatgtaaaattaagatatcacagcagcgctgagagatggagcttccgtctctgctactgtgttctgttcttgtgtaaataatgtaacacttagggcctcagttttcctctctgtaaaacaaagggtttggactaaaagatctctaagttcccttccagctttaaagttcttttaaaaattgtggtaggacaggcatagtggctcgcgcctgtaatcccagcaatttgggaggccgaggcgggcagattgctcgaggtcaggagttcgagaccagcctggccaatatcgtaaaacccccatctctactaaaaacaaaaattagccgggtgtggtggtgggcacctgtaatcccagctactcaggaggccgaagcaggagaattgcttgaacccgggaggcggaggttgcagtgagccgagatcgcgccattgcactgcagcctgggcgataagagtgaaactctgtctcaaaaaaaaaaaaaaatcgtggtaaaatacatgtaacaaaaaattaccatcttaaccatttgtaacagtacagttcaacagtgttaagtgtatccccactgttgttcaatctccaggagtgtttcatctttcagaatgaactctccatacactaaacatttatttctccctctccacagcccctggatgctttcaatgcttgtgggtatattcccataagcagaattgctgggttctgtggtaattcttattataaggttttagggagctatcacactgttttctatactggcagcaccattttatattcccaccagtagtgcacaggacttccaggttctctacatcttttctaacacttgttgctttcaggtttgtgtgtatgtttttttgtttttgtttttgttttgtttttgtttgttttggttttttttttttttgagacggagtctccctttatcaccaggctggagtgcagtggtgtgatcttggctcactgcaacctccgcctcccgggttcaagtgatcctcctgcctcagcctcctgagtagctgggattacaggtgccagccaccacgcccggctaatttttgtatttttagcagagacggggtttcaccatgttggccaggatggtctccatctcttgacctcgtgatccacccgccttggcctcccaaagtgctggggttacaggcatgagccactgcgccaagccttgtgtgtgtgttttatagcagccatcctcataggtataaggtgatatctcattaagattttgatttgcattttcctaatgattagtgctgttgagcatcttttcgtaggtttgttagtcatttgtttatcttttttgaagaattgtctacttaagccctttgcccatttttaaatgaggttgtttttgttgttgttgagttataaaagttctttatatattctggatattaactccttatcagatgtgtgattcacaaatgttttctcccgtctcatggtttgtcttatccctctgttgattgcgtcctttaatgcacataaacttctttaagcctgtgaaatttggggttgcaactcttcctcccatctgtggcccatggctgcaggctgaggaccttaacctctctgtcctaaatgagtggtatgcctgccctcctatctctttgatgatacatatttcagaatagaactctaagttcttattgctggaatcaactttggaattcttgtccaacctcattttactcatggacaaacaaggccctttgtgagcaacagagctggatctaaagtgtgagcttctctctccttccggcgctctctgcactgcgatgcaactcgacaagtcagctggtctttgtaatgaactcctcaggaaacacaagcaattacaggaaaagacaaccaggctattaagagggaattttattctattgaaactctgttatggggaaacgtgtgtgtttgttataggtaatctatttacattttcaaaaacctttttttttttggtaattattttattttattttatttttttattgatcattcttgggtgtttctcgcagagggggatttggcagggtcataggacaatagtggagggaaggtcagcaaataaacaagtgaacaaaggtctctggttttcctaggcagaggaccctggggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcaccgatcaacaggatcccaaggcagaagaatttttcttggtacagaacaaaatgaaaagtctttcaaaaacctttttactttctaaaagcaactacacatattctaggactgcaagtgctgttttctggtaaacggggagttgcttagaaaccaggaatgagggatggagaccaacggtcttctgtggatgaagtataaacagtaactcttctaaggaatcagtactaaccttgggaagaagatgagcatgatttttctctgtacaacctctacccctcttctgatgaaagcacctgcttttctttagggcctactccatcaacaggagcccatgtcgtttgggtggagcttcaggaatcggcatatgagtcagtccagaaaaataggcacatcccacccgccaaccacagtgactgattgcggaagaggcacttgaccccaggtcacacaagggggttccgtcctgggacttttgctgcactgttttgaaagaggcctctttccccctggtattgctagactagcaggccatgggcccgaaactgccagaacgcacccttgatgccacccgggtagagtcaggggagagcagggctgagagttggagacacagattcctgaaagcattgtttgagcgcgtggatccagtcttgctttaaatcagactttttagtaacatgaaccgatcaattcctctgctacaccagtttgagttgggtttctatcactagtgattaaaagagtcctcattagtccagattgtactttaagttgcttgtatacattatctggaggagagtataaaaataataggctataaatagtgagactaatattaagttattttaggtaataaaaagtcaaactgatgggaatagttctgtggggaaattgtgtgaagctatgttaacagtaagaaaagtgactaggttttggtgtaagtaaatgcctggtcacacattcgggaaataataatttaagttctatttctagtatgacacattgcaaggcaaagaataagtcattaagggctctttaagaacattcagtgcaaagatgctactgcacataacatattagaaaagtataatagaagtaaaacaggtgacaacgtttaaaaaaacaaacaaacaaaaaaaaacaggtggccagatgcagtggctcacgcctgtaatcccagcactttaggaggtcgaggtgggcagatcactcgaggtcaggagatcaagaccagcctgagccaacatggtgaaaccccatctctacttaaaaaatagaaaaaaaaaaattagcggggggtggtggtgcacgcctgtaatcccagctactcgggaggctgaggcaggagaatcacttgaatccgggaggcggaggttgcagtgagccaagatcacaccactgaactccagcctgggcgacacagcaaggatctgtctcaacacaaaacaaaacaaacaaacaaaaccaacaggtaacattcatcccactgttgcatagaatcacaacgggccggatgtattccgtctgagcttccagatccactgtctaccctctcccaccctgctctctgctcagcagacctgtgtcctttgtcctctagctggggtccctaaacagggatccccgtcagggaggggagagtggtcgcgtgtttgctcccctggtttcctcctgcagggcttcctcggggagctgcttccctagatcaggggtcacagggcttctccagtagcctctccaggcgcctgtggactctcaccttttgggctctgatcattgttgcctcccccagacctagggaagtaacagccctttggggcaagtcctgggctcccgctttgccgtgaccacactgggtactagtccctttattaaactctcctcaaattgcctaacttgcagatggcaactgtttcctatgatatgacataatatatcataacgcacgttcttttttttttttgagacagagttttgctctgttgcccaggctggagtgcagtggctcaatctcagccgctcactgcaacctccgcctcccgggttcaagcgattctcctgcctcagcctccctagtagctgggattacaggcactcgccaccatgccaggctaatttttgtgtttttagtagagatggggttttgccatattggccaggttggtctcaaactcttgacctcaggtgatttacccgccttggcctcccaaagtgctgggattacaggcgtgagccaccgtgcctggccacgcaacgcacattctatgtccacatttggaaaattacctttgattgtgagtgttcagcctcaagaaaacagcaaggcaggcaaagtctaaaggaggggaagtgaagagatcaagagctgggagtgtgagctagaacagtcatatcgggaccgattaaatgtgatgcctgaacttataatcttcatatgaataactgatcggtttgattatagactagaatgttagtaaagggaggacatcttacacctggagatatgctttaaataaataaaatggagtattacctcgtgcagaaggttgtacactcacgaaattcattactctaagaggcagtacaatttgaaagtaaaaatcaattccaaaatgctttaaatacacaaatgaaggagttttaagtcacccagggaaacctgaattttgaggttaatatcaagatgtgagaggggtaaatggactagagctgatctggaaatttttatgtttaataataaatgaaattttgaatataaataaaacttaggttagcttttcattttccaccttagttggcccttctgaaaacattcaccttatataatacatttacctctttcatttgaattctgaactactatctgctgccctctcaggacgttttaacctggagtccatggattcaaggggtctatggatagaattgtatttcaatgtagtctatttcttctccttgagtatgtatttcattttctacatttaaaaacgtgattctgaggagtccacaggagttgccagagtaccagagggttgtgtggcaagtcaagtttaagattcccttgtaggccaggtgcggtggctcacacctgtaatcccagcactttgggacgccgaggagggcgaatcatgaggtcaggagttcaagaccagcctggccaacatggtgaaaccctgtctctactaaaaatacaaaaattagccaggtgtggtggcgggctcctgtaatcccagctactcgggaggctgaggcaggagaactgcttgaaccccggaggcggaggttgcagtgagccgagatcacgccactgcactccagcctgggtgacagagcaagactccatcttgaaaaaaacaaagattcccttgtagaccaaaccagctgtctgggcttcccagggggtaacagagaagggcactgccttgcttcacaattcttgtaaggatcctggttaccagggcacttcccagcctttggagagacggggatctctctccactttggtgtggatgcagaagcacagagactagagttgaggcagaaacaagtaagaggctctcccagcccagggcctgtttgggaaggaggaagctgagctgccagggccatcttccaggcccagtacaggcggcacctcccttcctgattgctgccaacatagactctctctgcagttccactctctgatcccatcctgcacaactggatgcacttttggaccacgcactgggacaaaactgaatttaaaaatttaaattaggccaggcgcagtggctcatgcctgtcatcccagcactttgggaggctgaggtgggcagatcacctgaggttgggagtttgagaccagcctggccaacccagagaagccccatctctactaaaaatacaaaattagctgggcatggtggtgcatgactgtaatcccagctactcaggaggctgaggcaggagaattgcttcaacccggtaggtggagattgcagtgagctgagatcatgccactgcactctagcctgacaaagagaaacttcgtctcaaaaaaaaaaaaaaattaaatgaaaaataattgatcctagtgaaaaagatttcagtggaataaagatagacaaaaatggaaatgtttcaaatgagtgtcatggaaagatgaccaaagaattcaactgactgtgtgagtttgttccagaaaacatgttctttagaacaaaacgttctttagttccctacagggactcctagtgaccaccgccatctcattaataagtggctttgattcttggactcagtaaacaaaatggcttgaggcgtgtggaactgagtgtctttactcttttgaaaattgtactaaatgcttgtccctaagaggtttagcccttagacaatgcatggagggaaattatttgcaaaactccccactctctggaaaatcatttgttctggtcagattcctggaattcatatacagatactggggtctctcacagttttttctgccactttgggttaacttttcctccgggcgtttcagttctaagaatgctccctttgacagggaaaaacagaagcaaaatacacattgaggagttctgctttctcttgtcacccaccaacatgacaacactgaccgcaaacagcgtatccccttttttgctttgaatatgactttatgaagcccttgtacgggcctcaattcacgtggggctttcactttctcagaagcatgctgccatttgttccaccttacgttcctctgcgggcgaaagcaccccctgttcagctcaggctcaccttctcccacaatcacatcacaaacatctgcaaccttagggtttctttaagccccttcctcctttttcactgaattgagatttcacgggcacagtgaatgttcttaggaagtactcaattcttgagcatctttccagcgtctcaagccatggtatgttcttttaattggtaaaatctagggaccacgtctaactgggccctgccatttctctcgctattatatacttgaagaagacacagttgctttctcccaagcttcctgtcatttccactctgccaaccaattcctccttttggccaaatttagttcagagtggcagttccgcttactacttctccactctctggaagatgaaattgtcggcatgcaataataatagctgacgcctaccgagttctttctgtgccaaaggcgcctttaccatgaggaagcggaggcacggagatgctgagtgtcttgctcaagttcatccatctggcaggtggcgggatgtgggcattcgagccagggtctgactccagagcccaagttctgtttctcgctctacgcgcctgtcaaagactctggtttccgccggatggactttcagcaggtccgaggatgtgaagatctcccatcagcatctccccaccttggggtcgcctttgtgatagggaggggtctgtggtctctttcctgagtctggttgtgggagctgggtaactcccaatgcagtggacagagatacctctctggtatctctccttgctttccaccctcagccttctatccctgtgacctatgacagcacaccccctccactcctcatagggctttcttggttacttccaggatgtcttcatgttctccccggacgattcgtgcagacaggcttttcttaaacacctttgcttcttcccgcctgtggaccatcttacactgattgtagatgtggctggcaggaggataatggtggccccacctgtggaccatcttacagtcactgtagacgtggctggcaggaggataatggtggccccgcctgtggaccatcttacagtcactgtagacgtggctggcaggaggataatggtggccccgcctgtggaccatcttacagtcactgtagacgtggctggcaggaggataatggtggccccgcatctgggactggtggtgggttcccaagtggaatagttctctgtggatccctctctaaaccatggcttgagacgttggaaagagagttctgctctttccccccctaaatttcaataagttttgggaatgccacattttctgagttaagtaatctcattttaactaaatggctctccaaggctgctttcccttccatggtcattgagaatacatctccctttgccccacatgataaaaacctgcaatcacagttagaacaataaacacagagttcttaatatgcaccaggcgctgtgtctaagggcttacaggattgatttgtttcattgttcacaacaactattattatcaccattttacagatgtggaaatggaggcacagagaggccacaccactgctgaacagggcatttttgctcatagaacaaagtctatgtgagtctgtttcttttacaaattttctattaataattttcagccaatccatgtgatcaagaggaccctagattgaaagaagtatcatttcattgaaatgatttcaaatttaggccaggtgcggtggctcacgcctgtaatcccagcactttgggaggctgaggcagcagatcatcaggtcaggagttcgagaccagcctggccaacatggtgaaaccctgtctctactaaaaatacaaaaattagctgggtgtggtggtgggcacctgtaatcccagctactcgggaggctgaggcaggagaatcgcttgaacccaggaggcagaggttgcagtgaggcaagatcgcgccactgcactccagcctgggggacagagtgagactccgtctcaacgaagaaaaaaaaaaaaaagaaagaaagatttcaaatttagtattatcaaatttcacctataggccactatatacttagaatctattagcttctggtcagtaatttaaattatcacgtttgttattataattatgtagaattgtaatttcagaatagcttaaatagtaatttgacccaaactgcaaatattcttctcacataaccgactgtaagtcagttctatcaatttcttatttttaagtttggtttgagattacttcacctataaacatttatggtctattaacgtttccgctaatattttgagcatgttgcaaataaagttttttctatcttgttatgcagttttggctaacatttaactcctatgctgttaggcatttccagacctaacttaccctaaagtatagcccaccaggaaacatcatctcagaatatcagacactactgcctctgtaaataattccattactctgtcactcaagtgactcagttcccactggggtaatagactgtcatttttgacttttgccaattgaattgcagctctggtttccctgggagcccggcagctttgcacatagctgtgggtaatgcagcgggttactctggcaagacttgctgtcattgctttctgctaattccaggaaaaaacttattttacctttccaaatcccagtacctcttttcttcccctgtctctcctccttttctcctcacctttctcaacttggaggggtttagtttgcattttttttcctacatggagaatgagtcagggtttttttgtttgtttgttttgttttgtttttgtttattttttatttttattttttgacggagtcttgctctgtcgtcagactggagtgcagtgcacgatctcggctctctgcaacctctgcctcctgggttcaaacaattctcttgcctcagcctcgcaagtagctgggattacaggcacgggccaccatgcccaactaatttttgtatttttagtagggacagggtttcaccatgttgaccaggatggtctcgatctattgacctcgtgatccgcccgcctcggcctcccaaagtgctggcattacaggcgtgagccactgcgcccggcccatgagtcagagtttttaactgcaaacaacagaaactgattctgattcacttgagcaggaaaggaatttattggaaggatagtgggtaaatgtcagtgcgaaggctggagacgcaggtgagcaaatggcagcagcaggggaggtgggcagctgcacccacagccatggtcatgccagggggcggcctggttggaaggctgtgtcactgtgactgcctgggacatcagaggctgcggctgccacccctggagcgaggcagcttcctcacatacttgctccatgcccaggtttcttagcacacattccgatggttgagcccagatcatgcaaccaaatcctaatttccaagggataggcctctgtttccaaacaacgccacgcaagaaaaggctcctcttagccgtgaagaggttcagacgctgagcacccgtcaaacacaacccctgcaaatactgactattatagattccagctctggggacatcgtccttttatcctcaaacagaagaagagtcatttctgctctcaaagggatgagtgcacctttcttcttaacaaggaataccaacttcctgcagtttcctgatatttaacattatctagttactttatataaattatataattttaaaatatttatattattcttaatataattatatttaatacattatactaatatgttatataatttattaatatagtagaatatattttatatattaatgatctccctagtaatcatctccaacataagattaaggataattgtggcaattttaaaattttgttttgtttttgagacagggtctcgctttgtcacccaggcttgagtgcagtggcgcaatcttggctcactgcagcctcgactttctgggtgcaaatgatcctttcgccttagcctcccgagtagctgggacaacaggcgcgtgccaccatgcctggctaattcttttgcattttgtatttttgtagatatggggtttcaccatgttgcctaggctggtttcaatctcttgagctcaagggatccacctacctcagcctcccaaagtactgggattacaggcatgggccaccgtgcctggcccagatgattctatattttattttattttttattttattttattattgtatttttttgagacagagtctcgctctgttgccaggctggagtgcagtggtgcgatctcagctcactgcaacctacgcctcctgggttcacatcattctcctgcttcagcctcctgagtagctgggactacaggtgcccacgaccacgcctggctaaactttttttgtatttttagtagagacggggtttcaccatgttggccagaatggttttgatctcttgaccttgtgattcacccgcctcggcctcccaaagtgctgggattacaggtgtgagccaccatgcctggccgataattgtattttaaataagaaacctaaagcttcaaaatcctcaaaatataatacttaaaaacatttatacagatattaaaggaatagttcaatagcagtgaaatatttttaatttgagaagccaaatacatattcatgaatcactctagagatacaaagagaaactgcacaatttcaaaacagtatggtcaaaatatgatgtcattctgtttaactagctttaagatgttgctaggtgctccaatgttctaatttagactataataggaaaacacatgttttacataaatgtattttccaaataactagagagtatcagtttaagcactaatcttttttattctgattttcaaaaaatgttaaacaaatcccacttcacggggattacagatgtgagccgccacacttccctttcttgtatactgagtctatgttaacctattctttttttctggcgtgatctcggctcatttgcaacctccacctcccaggttcaagtgattctcctgtctcagcctcctgagtagctgggattacaagcatgcaccaccacacccaactaattttgtatttttagtagaaacagggtttcaccatgttggtcaggctggtctcgaactcctgacctcaggtgatctgcctgcctcggcctcccaaagtgctgggattacaggcgtgagccacagtgcccagtggtttatttttatagaacagctttattgagctataactcatctaccatataatttacgcatttaatgtgtacaaggcaattgcttttagcatgttcacatactcatgaaaccatcaccacaattttagaacattttcataacctcaaaaggaaaccccatacccattaccagtcactcccattttcccccaaacccccagacctaggtaaccactaatctttctctctctacagatttgccttctctgaacaattcatgtaaatgaaatcatgtaacatgtgatcatttgtgactgacttttttcacttagcataatgttttcaaagtttgtccctgttgtagcatgtatcagtactttattctcttctatggctgagaaatgttccactgcatagctgggcgcagtggctcaagccagtattcccagcactttgggaggctgaggcgggtggatcgcttgagctcagaagttcaagaccagcctgggcagaaaccccatctctaccaaaaatacaaaaaattagtcgggtgtggtggcaggcacctgtggtcccagctactggggaggctgaggtgggaggatcgcttgagcccaggaggaggttgcagtgagctgagatagcatcactgaactccagcctgggtgacagaaagagatcccatcaaaaaaaaaaaaaagaagaaagaagaaagaaagaaagaaggaaagaaaaagaaagaaagaaagagaaagaaaagaaagaaagaaagagaaaaagaaattccactgcatggatatactgtatccactcgtcagttagttgatggacatttgggttttttccacttcttggtaatcatgaatgatgctgttctgaacattcatgttcgggtgttagtatagcatggcttcaggtgttagtatagcatgtcttcaggtgtttgtatagcatgtcttcatttcttttaggtccctaggaatggaatttgtgagccacctgataactccatgcttttaccttttgaggagctgccagactcctttccaaagtttctgcaccatcttacattcccaccagcagtgtatgagggtcgcagtttctccacatacttgttttatttgaccttttgatgctaggcatcctagtgcatataaagtgatatgtcattgtagtttttgtttttggggtttttttagacagggtttcactcccgtcacccaggctggagtgcaatggcacaatctcggctcactgcaacctctgcctcctgggttcaagtgagtctcctgcctcagcctcctgagtagctgggattacaggcacaggccactgtgcccggctaatttttgtatttttttgtagagacggggtttcaccatgttggtcaggctgggtttgaactcctgggctcaagcgatccacctgcctcagcctcccaaagcgctgggattacaggtgtgagccacagcgcctggcctctcattgcagttttgatttgcatttccctgatgacaaatgatatcaagcatcttttcacatgattactggccatttgtataccttctgtggaaatgtggtaacaccctttgctgattttaaaatagggttatttgtttattattgagttgaaataattccttcttttgagtgtcagtgactgaggttcgctgtgacacagaggggttctcctggagagctatggcacatgctccatattaaaaggcaacatgatgctgtcaggaagaacacaaaagcaattataaaaacgtgttagtacatatttatgcatcttttttcttactctctctttgctatctattctcacagctctaaatatgaattatttctctaggtagaggccaagcatgagtcagcttctcccaagaatcagttgcctgggcttcgagacagttttctgccgtattttgggtaattgtagttgccaggagtctgacttctgagggtgtcaggtgccatttgccgttaagtggagatagtaggttgaacagggtgggactaattggggccagttttgaggaggtgaatctttagtgaaatcgccaagaacacagtggtgaggacctggcagagaggaggagattccaaggctgggggaattgggtagtggcgtctgggcactgggtcctgtagaagggaattggcgagatgaatgagcagggcttcacaggtgtgactgatcttggtaaagacggtgagaagccgtgaccaggcagggtgtgcatgggagcagtgaaaggtctaaaattcagcctttgagctcagtgctaggttcatgctagtaattggttccgataggttaagcttcctctggtttgccggtgtgagaagaaagaaaaacctactcctccctgtttccgcctcaccagcttcccttctctgccagccccaccctgcccccggcccgtgtggctaaactgcccaactgccgattaaaacccgcacctcccaacatacctcgcaccacccagaggccccggtccccgccattcattccgctcccggccgggagtcgctctagccaatcaccttccaggctcagggcggccgaggcagggcctctgcctcttcggggggcctctccctccccctgcccctgattgtggctgaactgccaccgcttgatagcaaaccacactcggcacaggaaggagaacagcgcccgcggccccgggcctccatgaaatcagcaagggcgcgctcctcccaccgccgcgctgctgagcctcccgcctttccttccggtcgctcgcgcctcgagaggcgccgcagggagccctctgccggtcccgcccttcgctgttagcgcttaggatctggtgccttttcacgtgggggcgggtgggcgggaggcgagtctggggtcttcgggccgggcctccgctctctggcagtttgcaccttgctccactcactggcctgcggtctgtgttcactcctcctcctctcccacgtctcaggaacctgcagctggcccccgagcccgcgccctcccggttctaggaattcaccactttcttgcctttgtttgggtatcttttgtttggagccagagccggctccaaggaggagctgccggagggtgctaggctttttgcagaggaagtgaggagcagagtgatagggcgtgaagtcagagggagcagagaaggggccgaatccagcggggcccggatcatgcagggcccggagcctgtggtgaggactccgggatttatattcaccaattatgagaaaggacttctcggccgggcgcggtggctcacacctgtaatcccagcactttgggaggctgaggccggcggatcgcctaaggtcaggagttcgggaccaccctggacaacatggtgaaactttgtctctactaaaaatacaaaaattagccaggcgtggtggtacatgcctgcaatcccagatacttgggaggctgaggcaggagaatcgcttgaacccaggaggcggaggttgccgtgagccgagatcgtgccactgtactccagcctgggcaacaagagcgaaactccgtcaaaaaaaaaaagaagaagaagaagaagaagaaaagaaaaaagcaaagaaagaaaagaaagaggacttatcaatgaccacaaatgactaagtcctcaacctctccaacagctctagagcaaatgacactttagcctgtgctgagcccctacaaggtgctagaccaagtattcttggggatatatacaaatgtgaacaagccagagaccctgcctggcaggactcactgtccagggggaaggcaaaactgcaaagatgagctgggacgccccatgggaaacgctggacagagtcagccacaaagccatccccttgcagcctcctccttggcatggccttattttccttgttggatccctagtgtcctaccccatgccaggtcccaccccaggagggtccagttcacacttccagaaagtttgggctgcactgtcccagcggctgtgcccttcgtgctctcccgctcccaggactctcccagcaccgcgtgcccattttccccaaggtcctttcggccctggaccagaccatggttagttatgggtgccccttcccctcgctgtcccactccacgccctggcactgataggacacttccatgttatctttgcaccacctggactctttgatcatatgttgatactgtcggtgtttcaggacaggaagaggcagtgtccccacagaggtcagtcaccggagtcagtggctgcgggaggccatgggcagcagggagctagaggagctgatctcaggattggagaccgccacctcctccaggaggagaaacacgcggggaagagcccccagccccaccccacccccgcactgccttcagcctctgcattgacccctccgcttttccaggatgggcatcatgaggcgttgagtggtaccaatgtgggcggtgggctctcctctttccggttttaattcttggttcttaaaaactccgttccaaatgagggaaatgaaactactgaacactctcccccagcagccagctgacgtggggcaagagaacaattcccagttaaggccccaaaggaaatcccctccctgccatgtgctgaggctggagaagtgggggctggagaactggagaagtgggggctaggagaagtggaggctggagaagtcggggctaggagaactgggggctggagaactgggggctggaaagggggggctgggagaagtgggggctggagaactggggtctggagaagtgggggctgaagaagtggaggctggagaagtggggactgggagaagtgggggctagagaagtgggggctgggagaagtggggactgggagaagtgggggctagagaagtgggggctgggagaagtggggtctggagaagtgggggctagagaagtggaggctggagaagtgggggctggagaagtgggggctgggagaagttggggaggctctatctagctcactgctccgccaccaaggtgaagggcctgtctgtggccagcggctgagagcccacagcacagcggagaaccccagaggcaggagcaagaggaccatgattttgcccggggtgagccgccagttccaggtccccatggctccactgctaggtgcaatccctgtgctcctctctcacagacctgtctggagtggggagcagccctggctcctcccatggctcccttgcacaccgagttgtgtcccctctcacaggccagctgtagccccctcccctggtcttgaataggttgccatctggaaaagcagtcaggggtcggggtggagggcagaagccaaggctccctttgatctccttgggaggctgagaagtcccacaagtgacaaactcttatgaagcttagtttaagaaagaaaagagatccccacaccctcagagggcaacagctagagaattatacaaagtgggttgaccgccatcattccttccttccctctcttcgtttctttcctccttctttcttttttgtggagatggagtttcgctcttattgcccaggctggagtgtaatggcacgatctcagctcactgcaactgccacctcccgggttccagcaattctcctgcctcaacctcctgagtagttgggactacaggaatgcaccaccacgcccagctaattttttgtatttttagtagagatggggtttcactatgttggccaggatggtcttgaatgcctgacctcaggtgatccacccaccttggcctcccaaagtgctgggatgacaggcgtgagccactgcgcccggcctcctcctcctttctttgagcaaatagtcaccaagcccctttatgtgcataagatagtatattttttggaataacacatgaccctgcctccaaaagtttgtagtgggccaggcatggtggctcacgcctgtaatcccagcactttgggaggctgaagcgggcggatcacctgaggtcaggagttcaagaccagcctggccaacatggtgaaaccccgtctctactaaaaatacaaaaaattagctggaagtggtggcgggcgcctgtaatctcagctacttgggaggctgaggcaggagaattgcttgaacccaggaggcggaggttgcagtgagccgagatggcaccattgcactccagcctgggcaacgggagtgaaactctgtctcaaaagaaaaaaaaagtctgtagtgtagttgtggaaaaaaggcagaagtccaaaaaattaaatcacaacacaagagatgtcatgaggtcggtggattatgggaacgctggcaccatgtgttcacaggacaaggtggcaattgcagtggggaaggcttcatggaggaggggagtccaagccatgcctttgggatggggagggttggggtaggcagaagaggccattccaaacaagggaaccctctgccagagagagtagagagtggggagcgtttgttctgtgtttgggaaaatcgtgatcagcccgggctgggtgaacccacctgcaggccatgtgtgcagtgatcatgaagcatgggcggtagtcgtgaagagaggctggaggcagctcaggccgaatggactttctcctccagccgggagccgcctgggttcttgctttcacttcggatcagagacgctgctgcgctgcttgacactagacttgctttattcctgttgagtggaatacagcaaacaccccaataggtggagcaggctcaaagcaagaggcacatggccccccagaaattctcatgatcctgtggaggggtgagcttggtcagggcaaccaggcctggatgcaccagggttgcatctgagaggaagcaccctggtctcctctgcctcgaaaagcatagtgaggggggagcccaaccaagttggaggatgctgagctgtgcagtcgggcttccagccgtgctggcacgttctcctttcagctgaaatctgcattggtttcagctggacgtccaggcttccacccactgaggcagcgtgctgctagcctaggggagggctgctggtgttgccaaccaactggcttgtctctacacatccatcaagagcactggggccgggtgcagtggctcacacctgtaattccagcactttgggaggccaaggtaggcagattgcttgagcccaggagtttgagatcagcctggacaacatggtgagacccctgtctctaccaaaaatacaaaagacatggtggtgtgtgcctgtggtcccagctactgaggaggctgaggtaggaggatcacctgatcccaaaggtcgaggctgcagtgagccttgattgcgtcactgaactccagcctgggcaacagagtgagaccctgtctcaaaaaaaaaaaaaaaaaaaaaaaaaaagaaagaaaaagaattaaaaagaaaaaaaaaagaccattggtttactagattttttttttaggggtagcagctgcctttctcaaaagaaattctatagagaatctcccaatgtataaaacatatcaaagtagaattcttgggatgtggagggaatggggtacctggatcccacctgccagtctttaggcattcatgaggaacccttgaacctgctgaaccctgtaaaagggctttaagcagagagtgagatgacccaatacacattttagaaagatgcccgtggcagctaggtggagttgacattggacagggatgagattaggggcagggagcgagtttcaggaggctatgaaagtggtccagacatgagctgatgaggtctagacccagggcaacagcctaaggatgaaaagcaggttggattccagaaacatttctgagttagaatcagcaggaattgggggtcaattagatatgaaggatgaagtctgtgagggctggactgcctgggctgaaacataccgtaaagtgtgacagccatacaggagagaaactgctgggacaaaggataagagttgagtttggggccaggcacagtggctcatgcctgtaatcccaggactctgagactgaggtgggcggatcacctgaggtcaggagtttgagaccaccctggccaacatggtgaaatcccatctctactaaaaacacaaaaattagctgggcgtggtggtgggcgcctgtaattccagctacttgggaggttgaggcaggagaatcacttgaacctgggaggcagaggttgcagtgagctgagattgcgccactgctccagcctgggtgacagagcaagactgtctcaaaaaaaaagagagagagttgagtttgggatacatcatgttatggtgactctgggacatgtagcagttgattgaccagtagacagttaaaaatgcaagtctggatcttctctcgtggaagagaatgttggagctagaaattaaaattggggagttaccaactgattggtagacacaaaagacatgaagtagagaatgtgcatacaagagagaaagaggcctgaatcaagcacctgggtttgcaacaatttgatctttatttagctttttcattggtgtgattgttattaccattatgagataatattttatttttaaaattatttttatttttttaaagacggagtcacactctatcacacaggctgaagtgcaatggcgtgatcttggctcactgcagcctcaacctccctgtgctcaggtgatcctcccacctcagcctcccaaatagctgggactacaggtgcgtgccaccaggtctggctaagttttaaattttttgtacatatggagtctcagtatgttgcccaggctggtcttgcactcaggcggtccacctgccttggtctgccaaaatgctaggattacaagcctgagcctctgtgcccggccatgagtgaatattgtagaaagcagagacaatgtgccagatgtttggagtgaaaaggacttggctcctgttctcttaggatggacaatgctacacacaatcccaaatcacaggctataagagaggtgacccaatcctgcaggacagttcaacgtttcagatttgaaggggagtgagagagatcagaactggaggccccttgtctgagcccccgactatggtggtccacgtcactccacacgcagcaggcactgtaaatatttcaccttctctagacgacagtagttcctcgagaacaggagcgctggggtaatgcatatgaagctcttagcacagtgtctggcgctgcttcaatgatggctatatgatcaattattcttactcctttgaattcttggcaagagctggcagggaactttgtacacatcaggtacaaaaaaacccatccgcgcagtctaagatcaagaagctcttggcactctctgacagtcctcgacaaagcaattccccttctttctaacacagggtccgtaaaggagatgatccacaaggaccggctgagtggataagaagacagactggctgagcggctgaccctgccagacgacaggctgtgcctctttaccacggtgctgccgttcccaaagtcggcctcagcttggtccttggctggaagctcgtagcaaagtttctgggtcagcagacctcataggcaaggggcccctagctggccgcccccagccctgccaaggcaccaacgcaagaaagccgggggagcctcggtcgcattgctggaagatcgtctaaacatccccgctgctcggccgctaggccggcaggtgttcgggccccgctcccccggcccgccccacccccgcgcccgcgccgcgcttccctctaagaggccgggtctgagtgagcctgtgctgagtcgccgagcagcccgctctccatgtgacttcagtttccgtccgttccttccgctggtgctaaaataatctgatgccccacagcaaggaggtagcccagccccgcgttcggctgctctcgaggaggccggagcccccggagacgatgcgccccgcgcagccgcctgcgcctgcgggagccgtgagtatttcccgcgtgggggcgtccccggggcacagccggggcccttctccaggtgggcgagctcgagcgaggttgggtggtaggaggtcagcgtccgcggcccgcagctcagggctcacgaggaagctgtggcttgctgcgtccaagcgccgccgcttttgtgctgggcgtgggggctgcagctctgggtggaggtggaaatacctccctccaggagcacttagagctgagaaaggtggtgcgacgtagtggaaaccacgagggcttcagattcagacgtgggtttgagtcctggctctgcagggagcatgtgagcagacagttaaggtttctgagcctcagttttctcatctgcaaaatgggaacagagatgctccctccctgggctgggcgactggatatgatgagaccgctctgtgcacactcagcatgctgagcactgggctctcctttcctgtcccacaacgtggattgagaaccactatctcatagatgaagacactaagactggttaacagcaacacctatcacagatgccgtccacgtgccaggcctgtccaaggccctggggatacagctgtgaaaatgtgcaaagccccttctcccacagaacgtttgtccttgggagattcactggggctctgtgacttggatcttagcctagacttagatccatggcttatcagagggagactaacaggagggcgacgaagactcggacgctcttccgtagccctcgtggcccctgcatgtgggccggcttctgaaggggtcagcgtacttccccacgtacccaggagctagacggaaagaagtaaggagccactggtgtggctttgtgctgcctctgagagaaggtggacacgtgccagttggtggctgcgactggaggaggccggatcgggggtcctaggaatggagcctctccggacagggctggtcggggctgctgtgcttccctaggggctgaggggaccccaccggaggcttcttcatgatgggcacagcccgttaggagtctgggtgctagaaacattcagcgtctgtggccctccatgctttcctgtgtgctcctcacctgccggctgtgacacacagactgttctgtggatgctgagggtttgctgggctttacatttacaatacgtatttattctcctcacacacctcttaggtttgtgtgtgtgtgcccgagagtccctaaaggagattatagaatcatgggcccaggaaaaaaccttaactcctgcctttaggttaaaaaaacaaaacaaaacaaaacaaaacaaaacaaactcagcttcacaaagaaggcactttttaaaaatatatatatttatttatttatttttagagacaggctcttgctctgttgcccagactggagttctgtggcacgatcacagatcactgcagcctcaaactcttgggctcaaataatgctcctgcttcagtcacctgaggagctaggacaacaggtgcacaccaccatgccagctaatttttaaaatttttttgtagacacaggatcttgctgtgttgcccaggctggtctcaaactcctgggctcaagcaatcctcctgccttggcctcccaaagtgctgggagtgtgggcgtgagtcaccgcccccagctttcatgtaatgagtgccctcatgggaacttcatgaaaacacattctcttatagtttttaaattcatcatccaagagttcctgctctttgatgatgagacatacctggtagactccaaaacagagagcagacgcctagtatctttgttctggggtgtgcattaagagtacattgacctgtctgtctccagtcttgactcttttggaagagagatgctagtactgatgacaacctgcattctggctgcggtgtgcgtccacactgcacagtgtgcaccagactctcgtatggacaatgactgtccctcacatcaggcgcagatccattttagagcctcagaagtcaggagagggtggactttcaaccacgactgaaaacactgtctttcttaggacatgctgtgtgtatgacacacttacagatgtctgtgctcactgatgcttgttgatgtgtcatcgcacatcagtgacaaacatttgtcatgtttttgcctttggtggaacttctttattatactcactttcctcccaaaccatttttctcaacttcatcatgaagcaaatgtcatgtggtcattctgtgatggggctcagggctaggttaggtgatgatttctgaaagctcagagacgtgaaggaaaaaggacatcagtgcttggatcttagctcttataagcctcacgtgcaacaataaacccgagttcaagaatcagattcttagatagattggtttggtagcaaatgacaaaaaaccaacgtaaatatgcttcggcaaaaaagaaaaaaaaaaaggatttattgtttcaaataactgaaaagtgtatgggcaatagtttcaggcatggctgagtccagatgctcaaatggcattgccaggaatccatctgtctcctttcctcagctttgccttcctctctgtgggcctctttaccaggcaagtcccggagctggtggcaaagatggctgcctgcagctccaactatattcctactggtttggcatctgaaacagaaagagcaagtctcctttccatgagttctagcaactgcccgtggattgattctcatgggcttggcttttatgatgagcctgttaggaaaatggagtgctctcacgggcccagccttactcataggccccgccctggaaccaggagctgggatcagacccgaacacacagacttttgaagaaaggaagggggttggttgcacagccgcgtaagggtacttaacactactgaattgtacacctaaaaatggttaagatggtcactttcggccgggcgcggtggctcatccctgtaatcccagcactttgggaggccgaggcgggtggatcaggaggtcaggagtttgagaccagcctggccaaaatggtgaaaccccgtcactactaaaaatacaaaaattagctgggtgtggtggtgagtccctgtaatcccagctactcaggaggctgaggcaggagagtcgcttgaaccttggaggcggaggttgcagtgagccgagatgattgtgccattgcactccagcctgagccacaagagcaaaattctgtctcaaaaaaaaaaaaaaaaagataatcgctttcatgttttgtgtattttactacaattaaacattttctaaagaaaaaaaggaaagaaagggggtgattttctcaaaggggaattgaggggttgttaccagaaggagaaacgaatgtgagtgagtaggcgaaaccaaccaatttccagagcgaacggagtcaggtgctgaccccaagccaatgtgtcttttctcactttaatgcctgagggatttcagagtgaacagagtgaagaaaggaggaagtggaacctcgtcatggtcctcacccacgaggtgggcgcgaggagcaggctggtactggataggctcaatgtggccacaaagcctggtgaggtcacagggactcccctcctccagccccaacccaaaaggttgcctaaggcaggtgctgcgccatgtgcaccaagcaactttctgctgccacctccaagaaagagaaggaccgggaggggatttctcccaggagagagagcacataacgctccgtcttttcacctgtctgttctcaagcaggacctaagtgtctaaggcaaccccacacccacagtgcctggcaggggcccacccatgggtacacatcgtgttctcctaagctcatgtcactccatttcagatgtcaactggacatggactcctgctgatcctccctactgtcattcactcctctcctgctccagccctgatccctgaggtctcttctacccttgcagtgtctcccctctgtggtcctcaggcaccaaggctgagccctttccctcggccctgcagtgtctcccctctgtggtcgtcagacaccaaggctgagccttttcccttggccctgcaggctcagtggggagcagggctttccctgcctggccctggaccacctccttcaacttcagcaagttagcggtctccctgtcaccagccagcctgacaccctgagacctcctcatgggcctcggccgttctcttgttctaggttattgggcccttcctcaggtccttaaactgatgcttccattcagcttctcatctccttccaaatccccagttttcttctaggctctctggctagagaaggttagagccattttgaaggcctctgacagcccccgtcttgctttgtctccacagaaggccatggtcccatgatacactcaggggtgctgttcagaatatcaggcaccgcatggcacagctacttgggaggctgaggcaggagaattgcttgtaccctggaggcggaggttgcagtgagccaaggtcacgccgctgcactctagcctgggtaacagagtgagaccccgtctcaaaaaaaaaaaaaaaagttaaatcacttgatatgcattctgaaatatttaaaggaaagtatatcaatgactgcaatgtactttgaaatgcacgatcaggctgggtgcagtggctcacacctgtaatcccagcactttgggaggccagggcgggagtttgagaccagtctggccaacatggtgaaaccccatctctattaaaaatacaaaaattacccgggtgtgatggtgatctgtagtgatctggtgcctgtgatcccagctacttgggaggctgaggcaggagaatctcttgaaccccggaggcagagatctcagcgagcagagatcgcaccattgcactccagtctggcgacagagtgagactctgtcaaaaaaaaaaaaaaaaaaaaaagaaagaaagaaaggtggcatgggtggtgctgtgtgcctgtagccccagctactcggtagccctaggtgggaggactacttgaggctgggagcttgaggctgtagtgtgctacaatcccatctgtgaataactactgcactccagcctgggcaacatagcaagacctctaaaaaaaaaggagaaagaaagatggacagaaggatagatagatggatagatgtatgttgttggggaaaagttaaatgactaacagtacctagtaactgttcacattccttgtcatgatcataaaaatcaaataataagaaattagaaaacttccataggaaatgtagctacctataatacactgccatatgaattactgggttattgctccactcaacttttagcttgtgatgaggaggtgataccagcactgagcctgcaggatgagtaagagctttgcaggtgaacaagaccagcaaaagagcctttcccacagaggacagagcgtgtgggcatgcgtgatttagtcaagggtcgcaggcatcccagggtggctggggcttgtggtattgaggttgagctgatgcagaagtcacagacctgggtttgaattgtggctctaacattctctagctgtacagcctaaacctatgtgagccgccattgaccaagtgtgaaatggagatgacaacatttacctgctaggatttttgtgggaattatatgtaaagtacccggtatagcccgtgttccaaggtgagcactcagtaagcatgagctgtcacagtgaagagcccggacagaatctgggagtgattatgcagacctcgaacaccactgaattgacctttgaatcggcctcttgtcaggaatccatatgctttcgttcttcaatcgtacactttctcaaggaaaccaagtagtcggggtggggggatatattttcattgttttcccactggggccactaagccgctgtcatcacccataaaaaacccctgcccacagtctaccgtggaccctgggtgctcgcttctcccctggacatcccagggtccacacgctgcagctcccaggggtgggagaagggacgaaagctccttctccttcactgtatttccctcaacaccagcttgctgtttgcacagaggaactctgctttccctttgattaatacacctctttgtctcactatggaaagcgtctgtccccctccagtgggggcgtgtcctcctgcaggccttggaaggcttggtggggtcccccgcccactaaacgtgaagtccgaacattcccttacatcgacaaagccttttcacacacactgtcccattcagtctcgacacaaccctgtgaggccatcaaggcaagtgctgtcctccgtggtcaccaccagagtgaaggagccaggcttgggcccaggcctccttccccagcccagggtcccttcctctacacaggtcccacctgctccttcttatcgagaagggcggtggcaggtagccactccctcagaagtgaccagagggaacaaacttgtgatactgaagggaaatcagatgctaatgcgttatgcggttgagcgcctatcagcagagattatgtgggtctctcctatagaaaggtgacaccgaggacctaccaccagccaccaccagcatgcaagggcgaggtgtcacctcccagtgggagcaggtttgcatttattaagacctgtggccagatggcagcctgtgggcatggaacaggacgaggtgggctgacctctgatggctctaccaggccgacgctgaccacgtagggaagccagttggcttattcgtggccctaaggaagtgagggctgagcagggaggtgctcaaagcgggctcctcacactggctgtctggagtcgctgtgggaagggcccaggggaagaagggttgctggggcctctgaatccccccccgatggaggcagagcctcatccattcccagagagtctctcgccacgagccccggtacagcgcaggctgaccagagaaccggagaaccgggtgggaaccggagatctgagttgaaccagtgctgggaaccatggcactgccttcgccgagccgccgcgtgcctctcttttcacctctctggcctgcatattcttttagcaaacttggggattatactacacattctgctttacactttcctttccttgatattattttattatgaacgtctttctgcgtcaatcaatatattgctaccaaagcatttttttatcataccacgtcattcctatcatgtagttttaccataacttatttagccagtgcttccattattggacttttgatggtttccacttttttattattcttactaatgttacaatgaatatttcttttaaaatatttttatgtacattgtatttccttaggataaattcctagaacttgagtcattgaatcaaaaagaatccagactttcaaggtctttgataaattggctaaattgttcttcagaaaaagtgtgccaattttctgttctacctgcagggtgtgagacagttcttagggggggagaagtcaaaacaattgtattgtctatattttgacaaattcattattaagagaaagctagagaagcaaatcacaagctctgaattcacacatcacaattctaaatgtttgttgttctaatcctcaatttcaagttcttgttaatgcatccaccatttgaatatttactttttcaaaatataggaatgtgttaatttaccaaagatcacaatcggttctttgctttttgcttattttttgagacagagtcccacttcgttgtccaggctggagtgcaatggcatgatctcggctcactgcaacctctgcctcccaggttcaaatgacactcttggctcagcctcccgagtagctggaattacaggtgcctgccactatgctcggctaatttttgtatttttagtagagacggggtttcaccatgttggtcaggctggtctcaaattcctgacctcaggtgatctgctggccttggcctcccaaagtgctgggattacaagcgtgagccactgcgcccagccacctggctaatttttgtatttttagtagagacggggtttctctatgttggccaggctggtctcgaacccctgatctcaggtgatccacccacctcggactcccaaagtgctgggattgcaggtgtgagccactgtgcccagcctgtatttccatttttaacataacaaatgtttcctgagcacctttctgagaagagtgtttgaaaaaggtatgttaatgattcctggaaatatggggacagagattaccataatttaacatctcttttcaggaacacttatttcattttcctcatttttaaatgtgagtactttaaaacttacagaaaagtttacaagaaagtacaatactaaatttaccgagtagtaatattttgctttactgtctctattgagccatttgaaggtagtttacataaattacggacatcatgaaagttccctgtaagtgcttcagcatgcatttcctaacaatagaggcgatgtcttacataaccacaggcttgttatccgacctgcagacctcatatcatctgtgcatctgaaaactcatcacttagtgcctatttaaatttccccaattgtctcatacttttctgttagagattctttaaaatccaacatccggccaagctcagtggctcacgactgtaatcccagcattttgggaggctgagttgggtggatcacctgaggtcgggagttcaagaccagcctgaccaaaatggaaaaaccccatctctactaaaaatacaaaattagccaggcatgctggtgcatgcctgtaatcccagctactcaggaggctgaggcaggagaatcacttgaacccgggaggcggaggttgcaatgagccgagattatgccattgcactccagcctgggcaacaagagtgaaactccatctcaaaaaaaaaaaaaaaaaaaaaaaattccaacatccactcaaggttcattcactgcacttggttaaatgcttcttagtcacttgtaatctagaacagacacccccagccccactccagcctttctttgattttcaagactgactcttgagaagtccaggccagttaccttgcaggacgtcttacagcccagatctgtcagaggctttcctcatgactggattcagggcaagtgtttctggcaggcgttccaccaggacagtaccctgtttcctaagtcatcacactcagaggctcagaatggcaggagctctcaccacgggggtgttgagtttggacatttggtgaaagttgaggtcatcctaatgttttgctaagaatcagagggaccagagctgcttgcttgagacttcccagtgcttcctggagaagggactgttggaaatggtcacagactgggggttggttttgttctgtatcatctgttctcagtggtctgtgaccagctgcccttcccattctcccagatcccaggtgcaattgctctttttcttgcagtcaaaggcagactccctttcttgtggaggcctccatccggcaccgtgtgcccttgtgtgtccatgagtgtcactgtcacacatttaccactgcacctgtgcgcactctgcctctggagagccctcccccagacccagggagaaatatttgtttctctcttttttttttgagacggagtctcgctctgtcgcccaggctggagtgcagtggcgtgatctcggctcactgcaagctccacctcccgggttcacgccattctcctgcctcagcctcccgagtagctgggactacaggcgcccgccaccgcgcccggctaattttttgtatttttagtagagacggggtttcactgtgttagccaggatggtctcgatctcctgacctcgtgatcacccgcctcggcctcccaaagtgctgggattacaggcgtgagccactgcgcccggccaaaatatttgtttctagcacagagtgccccgagagctgcccactttctccaggagacctctttccgtaaagctttttcagcttctctgattactttgaggagaaaattcttaactacgtggtaacatacgtatggcacttgctcagagcccctttagcggagagggtccggtcccagctctggcagcagctgctcacgtagtagcagtcaggggaggtgggggtggggacggtaaggtgtccgagcagctccaacaaggagaggccgtcactctggccgggataacaattcagatatccagcgtgcacctgaatagtagaaatccagcatccttttctaaaaacaaaacaatagcaaaattcagatctgagctactctgtagcatttctttttttagagacagagtctcgctctgctgcccaggttggagtgcaatagcgagatctctgctcactgcagcctccacctcccaggttcgattgtcctgcctcagcctcccgagtagctgggattacaggcatccgccaccacgcccagctaatttttgtatttttagtagagacagggtttcaccaggttggccaggctggtctcaaactcctgacctcaggtgatccacctgcctcggcctcccaaagtgctgggattacaggagtgagccactgcgcccggccatttttgtattttttttagagaggcagggttttgccaccttgctcaggctggtctcgaactcctgagacccagtgaccccccactccttggcctcccaaagtgctgggattacaggcgtaagccaccgcacctgttcgcaacaaacataatttctaaaacaaaggagactctttgcagcggctgtacgttcttcttcctcactgtcagcattctcttgttgcagaatacaacctccattcatgttgtttttatgaatgaatctttttaccactttcttactatgaccaggtctggaggcagaaaaccacgttgtcttctctgcctaaaaagcaacaccacatcttcatagacaaggttggctatggagtagactcacagcattccatgataactagttagaatgcagcagtgttccaaatgggccaaaccttgtccagacaggagcaacaggcagctcagggtcccaggaacactcaccagctggcagcccctcgggaagcggctgggctttccacctgttcctgcatgctgggcacactctggcttagatgccctcttacagctgcagatgctgtggcgtggtcctcagccctgaggatgtgggaggagaggaagcagtcctgtgcatgcaggggatgagtcacgggattttgcagagagatatggcaagaggattgtttatcttggactctttgcagtgccatggctctgaggaagctctctgcagctacacactctacgaagagtgtttctcaacctcaatggtcactattttgaaagccttttatttctttacagtcattacatacttttaatttagcactgggtcttggccattctcacatgattgtattagtcagggtccaaccaggaaacggaaactgcccagattatttaagacagaggatatttaatgcaagaaagtggcaacacatggtggaaaaggctgagaaagcaaataaacagtcaacacagcgacgagcagcttcaggaagcttcttatcctcacctaggtagggtgaggacaagaggagaaggtgggccaggcaccatgactcacgcctgtaatcccatcactttgggaggtcaaggcgggcagatcacctgaggtcatgagattgagaccagcctggccaacatggtggaacctcatctctactaaaaatacaaaaattagccaggcgtggtggcgtgcacctgtaatcccagctacttgggaggctgaggcaggagaattgttgaacccgggaggtggagtttgcagtgaggcgagatcacaacattgtactccaacctgggcaacaagagcaaaactccgtctcaaaaaacaaaacaaaacgaacaaaaacaaagaggaggaggtggtgtcaccagagcctaggggtcagcggaagaaactctaggatgtctctgtccaaggcagagaggaagggagagaagtatgctggattctttctgccctctactgtctgacctcccaggaggagtgtcttccattgactaaaccagcagagtttgtgacaggtgacagcagtttgaggccaggtgacagcagagtttgagattcagaaccttcagaagtcagagccctgccacactgaggagggcagggaaggggaaggcgcagctctggggacaaaccgctgtcagccagcatagtcatctgtgctcagggctagccttgctctgcaatttatgaatgcagagtttttaattgaaccttcctgcatatgttttacatatctagttggtataattcatccttccagccacattactcaggcctttattttagactttgtgtagctgttgaactaccttggagattacacaggaataaccagcactcagtcaactcactggtgtttggaactcacaagtaataattaataattgtgttacttgctacctttacagccatgaagccctttcacattcatgagactggttattctcatgcaactctggaatagttattattactcccattttgtagacggattctctgagtcttggagactttgtctgaattcctaaaggacaaataacaaataacagaggcagaattcaaactctggtctgcttggttccaaattccatgatcttcccatgatatcctgctgcttcctgccagggccacaacaagagtttttttctgggctggttggctgagtttaggaggaaggagaggatatgttttaaacttgcaaaattcttgatgacccataaattaaaatgcccctcctgagtgtgacacaaggcctggcttgccttccagtctgaaggttgccttttcgctgagggacctgcactcttgccccttacacgtctagattcagttcttcgatacgcagggctggctcttccagagagactggagtcacagcagcaggtaccaccccacacctgacaagaggtggccagggaggaagggagggttcttacctccccatctcccctcagtaaaattcaggatgcccagtgaagtttgaatgtcagataaacaatttgttagtataaggatgtatctagcattgaaatgatgccttgtaatttactaaatctgcaactatgcagccttatttcatggcgggcagtggtggtgatcccaggtttcaggggcggggaagggtgctggggggatcctgaggtcaggaacccgtacacctctgcttctgccctctcttccctgtgccggccacaaggcaatgactcctgtgtgggtgcagaggcagaaatgggtctggaaggggattcccagtgtctggcaagttctggtaaattctgcattggaggttctctctgtagtaaggggagttggcctggcctgaagtgaaagctggcttacccggtttcattgagctcttcaattagtctgtttgcactggtgagcattcaaatctgatcaagaaggtaaaatgagctttcaagatccctaaatgcatttgaagaaaggaaagaggaggcccctgagtggctggagcgagcaggtggggtgagctggtgccgctggcccaggagaagatgggagggcagacactgggcctccggtaggtgtcaaggaatgggcagatggaatgctggggccagctcttgcctctgggtctgcagaatgcagagctgggggcatgcactgggcgtcaggtccccagcagggcagcagtgagtgcagcctcgctgctgggagaaactgccctgctcactcatcggagctcggggagcgaggcggggctgctcttagccctgccactaagttcatccacaacctcgagtagtatctctgggcctttgttcacctggcaaatgtgatgagtatattgcatttcccttatggctccccttagttctgaatctctgctggtgcgtgtataccttcaagccttctcattattgctgttctctgtgcactggccaggcaagcgggctggcaaccacgtttcgttaaccacctttattctacccaaagattgcttcttcattttccctccgtgtttcccccgtccaagcaaaatatcaaacctcttttttcaaagggtcatagtcaaatgagtgaaccaaagagatcaacgcttttgtaacagccccacatcagcagctgaggagtaactctgggacagaggcccccatccgtgtttccgtctccgtccactctccagttgttcattcattcactcagcaagtacttactgagctcaggggatgcatcagaccgattggagctggaggcaggaaaacttcagcagaattacaaaatatgggaaactccaggtgactggaggcctggttactcaagctttttgcttctcccttctgtgctggactcgctgaagtttagtgttcagccacccgtccatcaagtggtagaggcaaaatgaaattgagttcttgtcaacagtttcagtgaaaggccggaagtcttggctaaatggaggtatctgagtatcctgtgggctgcacctctatggagctccacagagctccaagaccacatagaattggaactggctccttctgccgataatacaaacagccctctgggatgtccttctctgacttacctcttccctgctctctgtccacagggctgcccttgagatggagttgctgcctctttggctctgcctgggttttcacttcctgaccgtgggctggaggaacagaagcggaacagccacagcagcctcccaaggagtctgcaagttggtgagtttcccttgaaccctgatctgtcggctgctcctgtcctgacaaggcttggtccatttggaaagctgacagattgtccatcaggaagggcagagaatgaaggagcctgcatcactctgtgcctgcctagcacaggggcatgtgcagctgccctttaaccacaggattttaagatgcttcctgggaagagccaggcagtccctgccccgccgttctcacgcctgctgaggataggaggcatccgagaccagcctagggcatcctcccggaacaagaacaacttgttaaaaatctggatgattcaggccgggtgcagtggctcaggcctgtaatcccagcactttaggaggccgaggcaggcagatcacttgagcccaggagttggagactagcctgggcaacatgatgaaaccacatctctacaaaatacaagaatcagtcaggtgcggtggcacacacctatagtcccagctacttgggaggctgagatgtgagggtggcttgagcccaggaagtggaggttgcagtgagctgagatcatgcccctgcactccaacctaggtgatggggccagaccttgtctttaaaaaaaaaaaaaaaaaagccaggcgcggtggctcacgcctgtcatcccagtacttagggaggccaagtccggcggatcacctgaggtcaggagttcgagactagcctggccaacatggtgaaaccccgtctctactaaaaatacaaaaattagctgggcgtggtggtgcatgcctgtaattccagctacttgggaagctgaaggaggagaatcgcttgaacccgggagacggaggttgcagtgagccgagatcacacccctgcactccatcctgggcgacagagtgagactctctcaaaaaaagaaaaaaacaaaacaaaacaaaaaactggatgactgagctgcaccgatggtatgagaatctccgggtgaggtgcttgagagctggagaagcctgcctcggagtttgtggacgagttgaccgctaaggcttacacagctgcggggaggacttgctgccatgccactctgcagagcggcagcccggaccacgctcaggctaagaagacccggagcgtggatacccaagcctcctctagggctttcagcctagatgtgaaaatagacttgggtccaaactgagaaatttccagtaattttccccttcatctatataacaatgatatcaaaagtctgctcaagaaacacatatttaggccaggtgcatggctcacgcctgtcatcccagcactttgggaggccgaggcgggcagatcacaaggtcaagaggtcgagaccagcctggccaacatagtaaaaacccgtctctactaaaaatacaaaaattacccaggcatggtggcacatgcttgtagtcccagctactcgggaggctgaggaagattgcttgaacctgggaggcagaggttgcagtgagctgacatcgtgccactgcactccagcctgggtgacagagtgatactccatctcaaaaaagaaaaaaaaaatgaaacacatatttaataaacatttcttgagccatattatatactaggcgttgggaagacaaattggatgtcagggctaacacttacattcaagtatgtattcttaaagcatagctgtcatggtttttaacctcttttagtaggaacctataaccactgtgctagagtctattccaatatgacatagaggttacaagctagactggcctggtttaaacccagccccacccttagctggtgacattggggtcactctaggtcatagtttctccatctgtagaatatatacgtaataataatatctaccaataacatcatgctgtgttgactgatgattaaatgggttaatacatgtaaagcactcaggacagtgcctggtaggtagtcagtgctacgcgttttatccgttatcactcatattattattaatctctgctatgtttgacctccagcattctcttacagaggcaataaaggattaactacacagtagttattcaggggttaccaggcacaggaagaggagagataaatgaacagcctttcagagttcaggcaaggccctctgcttgacactttctggcccagtgggcaggagtagagaattggctgccaggaagcccaaagagtgggtttcctgtggctcttccgagttgaggactgagaattggagagtctgggtgccctccactggccctcatcacattatccatttgaccttattagaaagtggacgttggccaggtgcggtggctcccgcctgtaatctcagcactttgggaggccgaagcaggcagatcacctgaggtcaggagtttgagaccagcctgaccaacatggtgaaagcccgtctctactaaaaatacaaaaattagccaggcatggtgacgggcacctgtgatctcagctactcaggaggctgaggcaggcgaatcgcttgaaccagggaggccgaggttgcagtgagctgagatcgcgccactgcactccagcctgggcgacagagcaagactccgtatcaaaaaaaaaaaaaagaaaaagaaagtggacatggtaagcttttctgggatggccatatggtccttctacatcacttcagcggggccacagggaattgcagaggtgtgacccacgactgcagcagctgtggtggaacagcaccccatagcgtgaagaaagcccctgaccacaacattctccagtgagtccacacgcagggaggagcgcaacacccactcacataaagacacacacctggccgggcgcggtggctcacacctgtaatcccagcacttggggaggccaaggcaggtggatcacccgaggtcagggtggccaacatggcaaaactctgcctctactaaaaatacaaaattagcccggtgtggtggtgtgagtctgtaatcccagctacgtgggaggctaaggcagcagaatcgcttgaacccggcaggcagaggttgcagcaagcagagatggcgccattgcactccagcctggacgacaagagtgagactctgtctcaaaaaaaaaaaaaaaagataaaaattctcttccagagtactttgtaattataatgcaatcccaatcaaaataccaaagagggaagggggatgtggaaagaacttggcaaatcctttctaacgttcgtctggaaattagagaaacccaaatgctcaacaataggagatgattaattagatcatcctaataattatagctcacatttattaagcacagtaaatgtgtttcacctcaacagtcacacttgatcctgaaaaaaaacgctatgcgaaaatgacgagtataatttcggttttacaggcagggtaatggaggtctctttcggttccgtaaccatccaaaggtcacccatttgatcaaaagcagagccacgaagcattggccctggaactcttgctctcagccactgtgctattcatgagatgaatgcatatgcttcctaaaaagattatgatcacatttatttgtactgccaaggcaataagtccgtcatactttattgacagggggagaaaaataggttactgaacagtttgcacagtatggtcttatttttgttttttagacaaaggtaggtaatatcttacgaaagatccagaaagacatggaacagaaggtgactggtgtttctctgagagagaggcggaggtgacagaagagttgaggtttccatatgtcaatacagtatcaatgtttaattattggaaggttttattttaattatcagataaagaacccgaggggccaagaaattccactgctagtggtggtagagccgagattcagattgagtctgtcctccaaacctgtgcttcttctaacctctctctcgggattttcctcttctgttgccgtgctgcacttgccctctgggattgaacccacaattgtaggcaaccactgcccttgtattactgataaacttgtgcaaacgaatgccattgctcctctatcttatcacttaaaacttctttctggccgggcacggtggctcacgcctgtaatcccagcacttttgggaggccgaggcaggcagatcacctgaagtcaggagttcgagaccagcctggtcaacatggtgaaaccccgtctctactaaaaatacaaaaaaagttagctgggcgtggtggcatgtgcctgtaatcccagctactcgggaggctgaaacaggagaattgctcgaacccaggaggcagagattgcagtgagctgagatcacaccattgcactccagcctgggtgacagggtaagacttcatctcaaaaaaacaaaaaacaaaaaaaccatttttgtcctagacacctaaataacatcctatggctgatggttgtttttgccaattttgcaaagcgtggggtgaattaaagtatcctgcacgtgtgctttctgcagtgcgaccagggtggcctcgtccctcccgcctccttattctgcatgatcagagtagagccctgtttaggaaaagcactgaactgggcattcagagccctgggctccagtcccggcacagccactggctcttcacttctcccctccagacccactttacttccctgtacaattcaggatggtgaaagctctcaagtccttttttttttttttttttttttgagatggagtcttgctctgtcgcccaggctggagtgcagtggtgcagtggtgcagtctcggctcactgcaatctctgcctcctgggttcaagcaattctctgcctcagcctccggagtagctgggattacaggtgtccaccaccacacccggctagttttttgtatttcctgtagagacaggacctcaccatgttggccaggctggttttgaactcctgacctcaagtgatccacctgcctcggcctcccaaagtgctgggattacaggcatgaaccaccgtgcccggccttgtctatcctatttttaaaatgaacatctctagagccatccccggcggttgcagggacagtctgataagtgaactaagtttctatgcataaatgcttgcctctgggcctcctcgctgctgaccggtgtggttttggccgcaggtgggtggagccgctgactgccgagggcagagcctcgcttcggtgcccagcagcctcccgccccacgcccggatgctcaccctggatgccaaccctctcaagaccctgtggaatcactccctccagccttaccctctcctggagagcctcagcctgcacagctgccacctggagcgcatcagccgcggcgccttccaggagcaaggtcacctgcgcagcctggtcctgggggacaactgcctctcagagaactacgaagagacggcagccgccctccacgccctgccgggcctgcggaggctggacttgtcaggaaacgccctgacggaggacatggcagccctcatgctccagaacctctcctcgctgcggtccgtgtccctggcggggaacaccatcatgcggctggacgactccgtcttcgagggcctggagcgtctccgggagctggatctgcagaggaactacatcttcgagatcgagggcggcgctttcgacggcctggctgagctgaggcacctcaacctggccttcaacaacctcccctgcatcgtggacttcgggctcacgcggctgcgggtcctcaacgtcagctacaacgtcctggagtggttcctcgcgaccgggggagaggctgccttcgagctggagacgctggacctgtctcacaaccagctgctgttcttcccgctgctgccccagtacagcaagttgcggaccctcctgctgcgcgacaacaacatgggcttctaccgggacctgtacaacacctcgtcgccgagggagatggtggcccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagcacgagccccccggagcgctcaccgagctggacctgagccacaaccagctgtcggagctgcacctggctccggggctggccagctgcctgggcagcctgcgcttgttcaacctgagctccaaccagctcctgggcgtcccccctggcctcttcgccaatgctaggaacatcactacacttgacatgagccacaatcagatctcactttgtcccctgccagctgcctcggaccgggtgggcccccctagctgtgtggatttcaggaatatggcatctttaaggagcctgtctctggagggctgtggcctgggggcattgccagactgcccattccaagggacctccctgacctacttagacctctcaagcaactggggggttctgaatgggagcctcgccccactccaggatgttgcccccatgttacaggtcctgtctctcaggaacatgggcctccactccagctttatggcgttggacttctctgggtttgggaatctcagggacttagatctgtcggggaattgcttgaccaccttcccaaggtttgggggcagcctggccctggagaccctggatctccgtagaaactcgctcacagcccttccccagaaggctgtgtctgagcagctctcgagaggtctgcggaccatctacctcagtcagaatccatatgactgctgtggggtggatggctggggggccctgcagcatgggcagacggtggccgactgggccatggtcacctgcaacctctcctccaagatcatccgcgtgacggagctgcccggaggtgtgcctcgggactgcaagtgggagcggctggacctgggcctgctctacctcgtgctcatcctccccagctgcctcaccctgctggtggcctgcactgtcatcgtcctcacttttaagaagcctctgcttcaggtcatcaagagccgctgccactggtcctccgtttactgacctggctgtgtgccaagactcgaaattcggtccgcacacaacaggacactttctctgccagctttcaagatgtgatgcagaggccaagtctgacgaattgaagtttcaattaaaatttaatatgtttccattcctcatcgcccaccccacccccgcccccaccaccgcccaagttctttttccatcattataattcatcctcattatcttggtaaaatatttattaagtgactttttcagaaataaaaggcaacgtgtctcataaatattttttaaattaaatgcagcttgtgtttttttttattgttccttggtttcccttggattattttgtagtgtcctccccttggtgacatccatggagccgagggtagcaattcaatgcaacctactggaaaaagaactccaagagcaggtgctagagatggtgagtcagtgccctggggactcaacagggacaaggatttcatagcaggacgacgacacaaggatttcatagcaggacgacgacaacaaagcatttcaaagcacagctggagggtctgacataagatcataagatgaggcctctcacctgctgcgtgactggccaccgccgtcagaacggtcctgtgatcctagcactttgggaggctgaggcgggtcacctgaggtcaggagttcgagaccagcttggcgaacatggtgaaaccccgtctctactaaaaatacagaaattagccgggtgtggtggcgggcgcctgtaatcccagctacttgggaggctgagacaggagaattgcttgaacccaggaggcggaggttgcagtgaaccgagatcacaccactgcaccccagcctgggcgatggagcaagaccccgtctcaaaaaataaacaaataaataaaataatggacctctagctgggccctctccaggtgccctggcttcatacccggagtctctggcagacagacatgactcttccatggagaaaccaagagaataataactggccccgagtttatccagtcagtaagccgactgccagagacagtcctcgttctgaagggaagtaaagaggaatgcagaaaggaatgaattctgctcacttgtgaaccctcctaactcttcacaaaaaattgcttacaacttcatagcagatgttcagtatctgtattcactagattcttagcttcccttctccctctgttcaatgactaacgaacaatgtctgtgctcctctctgagagaaaagataacaaggacacagcccccgtcctctggtagtttagaatttacactgtcctcaaagtttttaatccctgcttactaaatcataaaggaattaaacgcaatgggggagggatggggagggagagaggctagaaatcccacaaactgatagctattaccatgcagactaactgtcagcagaaatatttaggcaaatcaaagagataaaatcagtggtcttactctgacacagcagaaacttcccttggatgctctacagaggtttgaacaaggccatctcaggccccacattcagtagcgttagcggcaggtcctgttaggctttgccatctcaggccccacattcagtagcgttagcggcaggtcctgttgggctttgcccttgctatgaccccaccgttccctcctgcactgcgcccagcctagtgtcgtggatgtctctcaggttgccttgaagccttccgggcaagtcccatcagccaacgcaacatcagaccagactctcctgatttcctctccccatcaacaaaacccttctctggggtcctgctgtttcctaatgtgaacactagctaattagacaaatgcatctatctgtggctggtgcactgacggcttctcttgagttaatgcgtcacctctggtatccatcagtgttcttagtctcatgcaactgaagacggttctgtctgatttaagtagcttacgcatttagtaagagaatattagtaagctctggactctcgggaaggctgaggaacaggcttggaaaatgggcaggaacagaagatgctgtgtagcaattgggaccagctggtctcgaactcctgacctcagcccaaaccatgccatgagcagtaactgtgggagcatggctgcagccacccctgccaccttctgctgaaataaatgctccccaaattctgctgcatcgccagctcctgaccgtggtcatgtgcccctgccctgagtacaagaaggactggcacggcaatgctgtaccccttggcgaggtgtctatggcagaagataggctccgtgtcctccaaattcttatgagggggcagagttcttgaaacctaagaaaggaagtgagacgttgagcaaacaaaatgaatgaaaagtaagtcccgtatccttttatggctgcatgtacattttatttatttatttatttatttatttatttatttatttattagcctgagtctcgctttgttgcccaggctggagtgcagtggcgtgatctctgctcactgcaacctctgcctcccaggttcaagcgattctcctgcctcagcctcctgaatagctgggactacaggcgcccgccaccacacccagctaatttttgtatttttagtagagacacggtttcaccatgttggccaggctggtcttgaactcctggcctcagggtgatccgcccactgtggcctcccaaagtgttgggattacaggcgtgagccaccgcgcccaggcagcgtgtacattttagcaggcaacttctggaagcaaattcttagcacaaagaaatgactcaaatgatggaaacttcagacagaaactcagggcagtcggggagatagtttggggttcagcaggacttttgaagcccctcaagtcacaccatgtagctgaccacccactctttctgttcttggggtccagcccgggaggatgacaaattgagccccagccctgcctgtgactgtgactttagaaggctgtgggctttccttcctagtgttttccatcacaaggatccaaaggtgatttcctgccgggtgcggtggctcatgcctataatcccagcactttgggaagctgaggtgggtggatcacctgaggtcaggagttcgagacccgcctggccaatatggtgaaaccccatctctactaaaaatacaaaaattagctgggcgtggtggcgtgtgcctgtagtcccagctactcgggaggctgaggcaggagaatcgcttgaacctgggaggcggaggttgcagtgagcagagatggcgccactgtagtccagcctggtcgacaagacaaaattccgtctcaaaaaaaaaaggatgattttctaggtttctctcagtatgcggaaagttacatagggaaggtgctttctgccttcagtgctcagctatggttcccccagcaaattctgtcccctttccctgcttctcccactccgacctggacccataggagaacctactggcgagggaaggacccacaaagcctgttaccagagttcttcggtggggccagaatggtgtctgcctaagagctcccattcagccaggtggggcaccacgtggttcttcctcagtgggtgggcagtagggggccatttccggttgccacatgccagaatattcacacaggaggatattcagaatcacagataaatcatgtcagagactggtctgtgaacatgagtaacagtaacttagattttggaaatccagtcataaaacaaaagctgaaggtttttctggaggcatttaagttagggatcaattgatttttttccgttctttctttttttgagatggagtcttgctctgtcacccaggctggagtgcaatggcgcaatctcggctcactgcaaactccgcctcccgggttcaagcgattctcctgcctcagcctcctgagtagctgggatgacaggtgcctgccaccacgcccagctaatttttgtatttttagtagagatggggtttcaccatgttggccaggccggcctcgaactcctgaccttgtgatccgcccgcctcggcctcccacagtgctgggatgacaggctgagccacggcgcctgctgatttctttttttaaacgaccccagttgcaagcaattggacaaactctaatccttggtttgtatcactggtcatatcactttttatttatttaatgtgccagataacttccatttgcccctccagatctacttcccactcttttccaccctgccccaggaggctggcctcaatgggctcccttgccctttggcttccagtggtatttggctaagaaggaggtttggcaaatcacaggggaggaagaaagtgaggtcagagtatttattctcctgactcctccctgtagatttgtctcaaactggctgcacctatcaaccaaactcacactcgtctcaaggcggctctttgcacacgaatctctgccttaggtatctaggaaccactcactcccctggctctcttctctgggcctagcatgggtaacagctctgcctcaccagctcgtgtaattgcattatcctttgcggtttgccctcccctctccaccgctttgtgaatcgtccctttgtaaatcctcctgacttgtccttgtttgaacgtgccatctggttcctgctgggtccctgcatgacgcagctggctactcatttagtaatcctgagcccgagagattccagcacttgtgtcagggagccacagagtgctaaggatgcgcggccagcgctaggaaagcaaatctcccgaagatggagtcccctgatttccatggagtccatgcgtggacatgaggaagaaggtggacatgaggaagatggcacgcctcagtgtgttacaaacatattcatattttacccaaattagagtgggagaagtttccagccttggagaccttctttaaaagagtgtgggtgttgcaatgaccaaagcaaacagatgatggagctggggaaaaaaaaagtgttatttaaaaaaatccttctcggccgggtgcagtggctcatgcctataatcccagcactctggaaggctgaagcaggcggatcacctgaggtcaggagtttgagaccagcctgcccaacatggcgaaaccccgtctccactaaaaatacaaaaaattacccggcgtggtggcacatgcctgtaatcccagctactgcgggggctgaggcaggaggatctcttgaacccgggaggcggaggttgcattgagccaagatcgtgccactgcactccagcctgggtgacaagagcgaaactgtgtctcaaaaaaacaaaaacgaaaaacaaaaaaaaacacttctcaccaactagtcatcttctatttcatcctcatcaacaagtaccaagcacttattttgtgctaagtgctttatgtggataatttcgcttaatcttggagaaaactctaggctgagagcgcttaagatttgttcaaggtggctgggcgtgggggctcatgcctgtaatctcagcacttagggaggccatggtgggaggatcacttgagggtaggattttgagaccagcctgggcaacagagcaagaccccatctctacaaaaaaatacaaaaattagtcaggcatggtagcatgcgcctgcaggctcagctactcgagaggctgatcacttgagcccaggaggtggaagctgcagggagccacgatcgcaccatggcactccagcctgggcaatagaatgagaccctctctcaaaaaaaaaaaaaaaaaaaaaaaaaaagatgatttgcccaagaactgtggtgaagatgttaacattacgcaaagaagagcaaacagcatcaacaacttgtcatctttatcaagtctatcagactgtcagccgatagtggttagtggctgcggaacagcacgtttgctaatgaaatggcagacgtggagaaggttcgtatggggtacaggtgacgaagcacatagtgatggaagatcactcacttccactgagactgttcaaaggcagcagcatgatgcagtgatagcttggaggtaattaacaacagaggaaccttactcaattccttcctccttcagccaagcaacatcttcctgctgaacagtcaggatcaaaggctgatgtagggggaccctggttttcaccatgattttaatggttcatggtgggtgtgggcactgattaggaaaaccatcttgccagggaggaaactgtttctgagataatcacctgatccaaatttttcaaacgtagaacccaattatagatgtcatttctctgggcctaggcaaagactgggcacagtggctcatgcctgtaatcccagcactttgggaggccgaggtgggtggatcacctgaggtcaggagttcgagaccagtctgaccaatatggtgaaaccccatctctactaaaaatacgaaaattagctaggcttggtggcgtgcccctgtagtcccagctactcgggaagctgagacaggataattgcttgaacctgggagacggaggttgcagtgagcagagatcatgccactgcactccagcctgggcgacagagcaagactgcgtcaaaaaaaaaaagagagagagagagaaagaaaaagaaagaaataaaagaaagaaagaaagaaggaaagaaagagaaagagagagagagagaaatgaaggaaggaaggaatgaaggaaggaaggaagaaaagcagaaagaaagattaggctaaataccaagatggactactcattcagagacttagtagttgttgaagcattgattcattcactccaggaccttgagagctcaagcagttggttcttgttctcagctttaccaagaatggtaggtggtggaaggatgagagccagctaaaccccaggaaagactggaagaggaggatcacaaggcacagaccttgactccccaaggagtcactctcaaattatacttctcagggctccttaaaaatggtcttctttaaggctgaggcaggtggattgcctgcggtcaggagttcgagacccgcctaggcaacatggtgaaacccccgtctctactaaaaatacaaaaattagccaggcgtggtggcgggctcctgtagtcccaactactaggaaggctgaggcatgagaattgcttgaactcgggaggcggaggttgcagtgagccgagagatcacgccattgcaccccagcctgggtgacagagtgagactcttgtctccaaaaaaaaaaaaagggtcctctgtaattggtcccaagagcctctgtgactttcactcattcgggacacggcttttgttcaaggtcccatcttcctcccagtgcaatcggtgcaatgactgtcctcagcagctttttggaccttctgtccaaagttggttctgtcgaaggacagtcaaactctggaaaaaaattaaaaaaaaaaaaaaaaaaaaaaaaatatatatatatatatatatatatatatatatatttttttttttttttttttttttttgagacagagtcttgctctgtcccccaggctggagtgcagttgcacgatctcggctcactgcaacctctgcctctggtgttcgatcaattctctgcctcagtctcccgagtagctggcattacagatgccagccaccatgcctggctaatttttgtatttttagtagagatggggtttcaccatgttggccaggcttgtttcgcactcctgacctcaggtgatccacttgcctcggcctcccaatgtgctggggattacaggtgtgagccaccatgtctggccagaactctataaaatatttgaagagacttatagaactctgtaaaatacttgaagagatttattctgagccaaatacgagtgaccatggcccatgacaagtcctgagaacgtgtgccgaaggtggtcagggcacggcttggttttatacattttagagaggcaggagacttcaatcaaatacatttaagaaatgcattgcagccaggcacggtggctcacgcctgtaatcccagcattctaggaggctgaggcaggcggatcacaaggtcaagagatcgagaccatcctggccaacatggtgaaaccccgtctctactaaaaatacaaaaattagctgggcgtggtggggcacacctgtaatcccacctactcgggaggctgaggcaggagaattgcttgaacccaagaggcagaggttgttgtgagctgagatcctgccactgcactccagcctggctgacagagttagactccatgtcaagaaaaattaaaaaaattaaaaacttgcatcatatttaaaactcttaaccctgtacacactgagtttgcaaccagtattccctccctttgcttctttcaagggtgtttagcttataaatggcaacacagcaaaccattttacatataagaacatgcagagcaattctgacactaagtgagtctgtgtctcagtgactgattaaccctgattgatttgattgattaacccttagtaactttacataacagcatcttatcttgctgagactgagagaagtttcttgcatcatctcataatcttaagagagatggtattggcagatcacagttcaaaaccagtcttcccacagacctccaaaacctttgtctaggagaacatgggaaggtacacatacagccacatcaaatctcagtggggataaagctggcatggacactgcgggggcctgcacactgctaccccagtggggcctcccagtcattgagggagaagtggggccggcatggggagggcagagagagcaaggaggagggggagaggtcatgctctggaagatgggtgtgtgctctcttttccggctactgttttcagtgtggtaagcaaatcccttcagctgaatgccctggagaggaagcccagtgcttcctgttgtcttaccaacgctgtaaaatgcaagttagaaataaagcaaaaagggggaaaggggaaaaaaatgggaagctctcctggctagatcggaacgccagcctttaggaggaaactcagctcacttcttttccccggagatgcagaggaagaggcacacctcacatgtgagttgtttctcaaatcaatcaggattcagaaaataatctctctatataaaaagggcatttttggccgggctcggtggctcaagcctgtaacccttgcactttgggaggctgaggtgggaggatcacctgaggtcaagagtttgagaccagcctggccaacatggtgaaaccccatctctactaaaaacacaaaaatcagccgagtgtggtggtgcacacctgtggtcccagctactcgggaggctgaggcaggataatcgctggaactcgggaggcagaggttgtagtgatcagagatcgcaccactgcactccagcctgagtgacagagcaagattctgtctcaaaaaaaaaaaaaaaaaaaagaaagaaagaaagaaaaagaaaaagaaaagacaagaaaaacagcagaataaacaacagagttgaaagtcctaaaaggatgactaaggagatatgtgtatgagatacagccaaagaaatacacccaccccctgtttaatgccctcaaaatccttccattctgtgagaatctaccccaagggtttgtagtgttggaaagaatcatttaaatatcagattttgtttgattgctttgctgctctgagcatcttagctgcctatgagatacttcatgagatgtagcagaaacatcctggcccccagggtagagtacacaggcagtcctgacaggtcacccggtattcatatacttatttatttatatcaccatcattaatatacatacattcatttatttttaacattaccatacagcttaccacttacgaaaatagcctctctttggctggcatttcactgacaaacttttttcttctattttcaaaaagccaatatagctccattcaaattttatttggccatttgccttccccacacccccttcttagataatgtctttgagaaatctgtgcgaaggactgtgtttaaaccgtcttctgctaatgacacctctcctgaaattttcagattatacaagaaacttctcttaaaagtttcaagcgaaccctgactttcttgatctagatttcttgaacaatatcatcttcctctactgcctgtgtttcactttgtagaacatccttcctctgaaagagcgataacaacaacaaaaattccactttgatcgtaacagtcgattagaaaaggaaatgcccttcaattctctaacttttcaaaaatgtcacatgctttcggccgggtgcagtggctcacgcctgtaatcccagcactttgggaggctgagacgggcggatcacgaggtcaggagatcgagaccatcctggctaacatggtgaaaccccgtccctactaaaaaatacaaaaaattagccgggcgtggtggtggatgcctgtaatcccagctactcgggaggctgaagcaggagaatggcgtgaacccgggaggcggagcttgcagtgagccgagatcgcgccactgcgctccagcctgggcgacaaagtgagactcgtttctcaaaaaaaaaaaaaaaaaaaaaaaaaaaaagtcatgctttccttttgaatgcaagtcagtgttgcctccccagctccgcttcctacagttgtcctaacaggaaactaatttttcttcttttatttctttatggccactgtcctgatttaatttattatttttaacttttgtgggtacagaaaagtgtatttatttatggggtacatgagatattttgatacgggtacacaatgtataataatcacatcagggtaaatggggtacccattacctcaagcatttatcttttctttgtgttacaaacaatccaaatatactcctttaggtatttaaaaatatacagtaaattactgttgactgtagtcactctattttgctattaaatactagattttattcattcattcttttttttcccctgagacagggtctcgctctgtcatccaggctgaagcacagtggccggatctcggctcactgccttctcaacttcctcggctcaaatgattctcccacctcagcctcctgggtactgggattacaggcgtgcaccagcacgcccggctaatattttttatttatttttatttttttcaagacgaagtctcactctgtcgcccaggctggagtgcagtggctcaatccggactcactgcaacctccgcctcctgggttcaagcgattcccctgcctcagtctcacgagtagctgggattacaggtgcccgccaccatgtcaggctcatttttgtatttttagtaaagaaaaggtttcaccatgttggccaggctggtcttaaactcccaaccgcaggcaatctgcccacctcggcctcccaaagtgctgggattacaggcgttagccacggagcccggccattttttaaattttttgtagagatggcgtctcactatgttgcccaggatggtcttgaacttctaggctcaatcattctcccaaattggcttcccacagcgctagtagcataagcccctgcacccagcccattgtttctttttctctcttttttttttttttgagacagagtttttctcctgttgctcaggctggaaggcaatggcgcgatcttggctcactgcaaccactgcctcccaggttcaaacgattctcctgcctcagcctcccgagtagctgggatgacaggcatgcgccaccgtgcctggctaattttgtatttttagtagaaatggggtttcaccatgttggtcaggctggtctcaaattcctgacctcatgtgatcagcccacctcggcttcccaaagtgctgggattgcaggtgtgagccaccgcgcctgctccattgtttgtaactgtatttttgtacccattaactatcccagttctctctgaccaatcaccctttccagcctctggaaaccatcattctactctatatctccggggattcaactgttttactatttttagctcccacaaataaatgaaaacgtgaagtttgtctttttgtacttggcttatttgacttaacacaatgacctccagttccatccatactgtggcaaatgacaggatctcattctttttcttggctgaatagtactccattgtctatatggaccagtttctttatccattcatcttttgatggatacttaggttgcttccaaatcttggctattgtgaatagtgctgcaataaacatgggagggcaggtatctcttcgatatacagatttcctttcttttgggtatatacctagcagtgggattgatggatcagatgctagctctatttttagtttttgtttgtgtgttttgagacagggtctcaccctgtcgcccaggctagagtgcagtggcatgagctcggctccctgcagcctgaaactcccgtgctcaagcgatcctctcacctcagcctcccaagtaggtgggactacaggcatccgctaccatgccctgctaattttttgtatattttgtatatatatatgtatatgtatatgtatatatgtatatatagagaacgagcgatggagtttcgatcttgtttccctggctggagtgcaatggcatgacctcggctcattgcaacctccgcctcccgagttcaagtgattctcctgcctcagcctcctgaggagctgggattacaggcatgcgccaccctgcccggctaattttgtatttttagtagagatggggtttcaccacgttggtcaggctggtcttgaactcctgatctcaggtgatccgcccacctcggcctcccaaagtgctgggattacaggcatgagccactgcactcggccccaaatacttttttttaaaagttacgtttaaaaataaaagaactctttgcataacgcatgtgttcacaaataagaaagtggcatatattaattcagtggctgaaatataattctgcgtatgaaagtacaaagtcttttttaaaatgtgctttatttacttttgattgctagtgcttctactgaggctctcatggtgggcgcagttctgcagctattcacctttctatgggtattttgggtctcccactctcctccctgtcaaccctgctccagcacccagcaggtaggacatccttgttcatactttcaaagtttatttagaccaacagtgaaatactttaacaactcagtttttttttctttcgatggctattaactctagtagtctcctctttttggcatttaaaatcttataaataggcacaatttgtttctcaggcttcaaaggaagaaaagagctgatacttgcttgagcagctcagcctctggtgactgccatcaaattccattagcccatcattgaatttatcgtcttttcccttcctgacttatttaatcttttttttctcccaatttgtacccactcagtcctttttcatttcattttcaagtgtccttcttgggtgtatttttgtgagttcatgaacaaattttacttcttttggggggcttagttttccagtgttgatttcttagcttgtgaatctctccacagtccttgcaaaatgttgtacttactggccgggcgcggtggctcccgcctgtaatcgcagcactttgggaggccgaggcgggcggatcacgaggtcaggagatcgagaccatcctggctaacacggtgaaaccccgtctctactaaaaatacaaaaaattagccgggcatgttggcacgcgcctgtagtcccggccactcgggaggctgaggcaggagaatggcgggaacccgggaggcagagcttgcagtgagccgagatcgcaccactgcactccagcctgggcgacagagcaagactccgtctcaaaaaaaaaaaaaaaagtttcacttactgttgtttacttttgtagtttgtggggttttttgcttgtttgtttgcttgttttgagacggagtcttcttccgtcaccaggctggaatccagtggcgcgatctcggctcactgcaagctccgcctcccgggttcccgccattctcctgcctcagcctcccgagtggccgggactacaggcgcccgccaccgcgcccggctaattttttgtatttttagtagagacggggtttcaccatgttgaccagcctcgtcttgaactcctgacctcaggtgatccgcccacctcggcctcccaaagtgctgggatgacaggcgtgagccaccacctggccgagtttgcggttttcatcactcagtcacttgaggagctgtattcccggcgcgtggtatccaagatggcgaccgccacggcttctttgttaagccttaagcggtacctgggttttgatgttgtgaggtttgttcattctcagagggcattttaatgttgcgttactactatgttgccatgttactgggattcaatgttaaattctagatcctgtttaatttttggtagtagatgacagggctcatcaccttttttgagatgatggagtatagcctactttgggaacttgtatcaagagagggagggttgctggttgaatggtatcaatcctttaagtcatcgccagttcacaatttctatcttcctgtggaacatactgtttttcccaatcccaagaagccttttgctagatacatgatttttaaaaatcaacgttttttgttttttttttgagacggagtcttgctctgtcgcccaggctggagtgcagtggcgcgatctcggctcactgcaagctccgcctcccgggtccaagtgattctcctgcctcagcctcccaagtagctggaactacaggcgcccatcaccacgcccggctaattttttgtgtttttagtagagacggggtttcgccatgttagccaggatggtctcgatctcctgacctcgtgatttgcctgccttggcctcccaaagtgctgggattacaggcgggagccaccgcgcccggccccgtttttattttttattgttgttaagttttccactgtcagttcctgagcttccgcaggtggaaaggtaggtcagcctgcggtctggctgttgcatccactctgaggttactcaaggtggaggagcagcaccagaataacagagatggctttctactgggcgttagcactgaggttacagtcctaggttgactctaacgaaacatgcccttgagctaagcattgccctcctgggcttcactttcctcacctacaaaataaggaggttgaactagataatttctactgtttcctgcaagtctaatgttctgtgattctaagagctttctgttagattatctgagtgaattagacagatattagaaatatttataaataaaatatcgattgtaaataaaattagaaagagtgggaggggtcagcttagttaagaaagggagcaatgtggaggtgtttggtttgcccgtggcccagaggtgatgaggaagcagccttcccttcctgtccccacaacctttatctgattgtttataactgtgagcttccagtctgtgagaacacctatgtggattttgtttgttatcactgagggtttcagctaactcatagccacaaagtcattggactattggacttagagggctattgagccctctaagatgggtatgtctcagctctctttctcatccaggtgccagcacctacctgtgagatactgaccaggaatctctttcctaacacccctaaaataggctggaatctgccccccacccctcaagccagctgacagcaacatcaggacaagtttagatgtttctaagctgacaaagggcactctgcttgggaactgcccactggtttcttggtatcaataaactagagcttcaccacccacccccacatcctcaaatctgatgtcctaatcagggaattacagctcggtcttcccttatgatttcaacatcataaaccttttaggtctgttcacttctagaaagatgcatttatttgcttgaggcttatttaaagtccaaatacacagaaatcttactccttgtttgagcaaatccctaagacattcatttattcagcaaatatttaccaagctgctgctctgtgccaggcactgcttagctctggggatacatacaaagctatatttttaattcattggttgtcacttacaagttacttttcttcacttccatcccccatccctccactgttcttgactcccccaagtatcctgagagctgagtgctgaactactcccgtcagcactgggtcaaggttctctgtgctgcatttggacaatgacaagaagggtgtgtggcatatgtatcatataagctgttttctgtgtcttcatttttcttaatttaatgtgctcctgaaagaggaatcagtttctcttcctgtgtcacccatgcatttgccacatactataacacaataggccatttctgttcttagtctcaaagctggatgacacagaacatcagtttgccacatatctaatcatccaacagacacattagtccagactctgggctcagaatctcaaagaaactagaaaacaagtaatattggcttagccctagtgccagtcagttgcctctttactttcagatcccttctccaccctttcctgttttgctctgtatccatccatactgatataaataaatgtctaaataaattaataagtgggaaagaagaattataaataatgtgtgtagattctttccattctaggaagtgaatcttatcctcctctgctgccctccctcaactttggagtgtggttggacttagtgatgtacttccaaaaaataaaatatggagaggcaaaaatagtaacgtcacagtaaagcaacctggcagatactacttgaaccgagtgatgaaggttaacatcaccaatggtgtcatgcaagtagtatgtaccccttgatacgatgtgatgagaacggcacatcacctctggtattccttccaataacccatcaccccagtcctataatgagaaaaatacaagacaacccaatctgaaatacattctacaaaatatctgaccagtcctcttcaaaactatcaaggtcatgaaacacaaggaaagcctaagaaagtaataactaatcacaatacagtattctggattggatcctggaagaaacaaagatcactaatgaaaatatctggtgaactatgagtaaagtctggagtttattaatagcaatgtatcaatgttgttttcttagttttgacaaatgtattggataaacaaattgggtgagaggtatatggaaacgttttgtagtatcttcagaacttttctgtgactctgaaattattctaaaacaaaaaaattttagtaaactctcaagaggaaaaaaatgaattaccaatgtcaggaattaaaatgagaatattgctacagaccctacaacaatagaagataatacgatgttgtaactatctttgcacaataatttgaataatttagatgaaatcagcagaggctttggaaaatacaagtaaataaatatgagatgagaagaaagaataaaatctgaatagtcctgtaggttagatttgtaattaaaaccgttctacaaagaaaactccatgtccagatggctttactagtgaatgactcaaaatattgaagaaagaaaaatattaatattcttcagaaattttttaaaacgatagaggttcatgaccaacatggtgaaacgccatctctcctaaaaatacaaaaattagctaggtatggtggctcatgcctataatcccagctactcggaaggctgaggtaggagaattgcttgaacctgggagacggaggttgcagtgagctgagatcgcgccactgcactccagcctgggcgacagagcaagactctgtctcaaaaaagaaaaaaaaaaggaaaagttaatatattccaacatgttttatgaggtgggcaaaatcctgatatcgagactcaaaaccagacattgcaaaaagagaaaattgttggacgacctctttaatgagcttggatataaatattctcaacaaaatattaacaaagcaaatctggcaatataccccaaaaagacttcacaccttgctcagtaatgccaggtttattctagtaatgcaagattagtataacatttgaaagtcaatcaacacaaattttacatgaacagactaaaagaataatcatgtaatcatctcaatatgcaaaaaagcacctgaaaaaattcaatacctgttaatgtaataacactcaggaaaccaataatagaagattttttaattcattaaatagtatccatctgtgccaggtgcggtggctcatacctgtaatcccagcactttgggaggctgaggcaggtggatcatgaggtcaggagttcaagagcagcctgaccaagatggtgaaactctgtctctactaaaaatacaaaaattagtcgggcgtggtggggggcacctgtaatcccagctactcaggaggctgaggcaggagaatcacttgaacccaggaggcagaggttgcagtgagccaagatcatgccactgaactccagcctgggcaacagagcaagactccatctcaaataataataataaaatagtatccacctgcaaaaggtttttgcgaaatactgcaaaaatagtatccatctgcaaaaagcactttttgcagaacttttctgtgactctgaacttttctgtgactctgaaattattctaaaacacaagaacattttaattaggtataggtatcatcaaactgaatgctgaaatattgaatacttccccctgacatcagaaacatggtaatgatatgtaccatcaccaccaatacccaacagtgtactggaggttctagccattactgtcaagaaagggggggaaggaataaaaactggaaagcaaaatacctgtcattattcacaaatgacgtgacgacatacatagaaagtctgaaagaatctgcaaataaatgatgcgatttcacagatgaatttagcacagttgctagaaggaaggtcagtatacaaaaaccaactgtatttgtacatgcttctacaatcaactagaaaataaaaatctttaagacaccatttatactaacacccagcaattccattcctagtacttatccaaggaaaatgaatcccccaaaagacatgtacacacttttagcagctttatcacagtaataaaaaactgacaaccacctaaaagcccatccacagagggctgaatcaccaaactgtaatatattcatatatagaaataccacacagcaatacaaaagagaaagtaccattttatgccacagagtcaatgaatctcactgccccacgttgagcagagaaaccagatgccaaaaagtatatactgtttttgttttgtttttgtcttattagtagagacggggtttcagcatcttggccaggctggtcttgaactcctgacctcatgatccacccgcctcggcctcccaaagtgctgggattacaagcgtgagccaccgcgcctggccaagtatatactgttttattcaattacattcaagatgacgaaagcaatctaaggtggtagaagttacagtggttcacccttttgggggtttggtattgacaaggaaggggatgaggcagccttttggaggtgctggagacgtgtgctggtgcccacaggggtgtacatctgtgtcaacgttcattgaactgtacacttcaaattgatgcactttgctgtacgtccgttaaataaaaatgactatggaataatcgcaaccaatctagacaatgataatactgtagacagcatatgacgaaagcctggtccaaagcacctgaggagggggatcgtaatgtctgagactgactcttcaggacttagaatctccttagaaagaaagataagtgtaaaagttaccaccctataatgatgacatagattttttttctttgcaattttatctttttttttttttttttgagatggagtttcactgttgttgcccaggctggagtgcaatggcacaatctcggctcaccgcaacctccgcctcccaggttcaaacgattctcctgcctcagcttcctgagtatctgggattacaggcatgcaccaccacgcctggctaattttgtatttttagtagagacggagtttcaccatgttggtcaggctcaaactcccgacctcagatgattcgcccacctcagcctcccaaagtgctgggattacaggtgtgagccaccgtgcccagcccttatattttaaaggatattgttgttttacgcattttgtatcagtcgttttcaaaaagtgaattgcctatgtgttactatctagcttggaaaaacttgcaggtctctttagcaaacacacattgtgtggaaaacacgctactctctgtgagaaagccagaaaggagcctcaggaaatgaacctgtaaattaaagaaaggagggagatgtttcctccagctagtgggaaacctggagagaggacagaggtgactcttccccaactcccacacctggacttttccctcacggaggaaggaaggagatgcaggtatatttgctggagggattttctctgaagtgggatgtaaacaaaatactgtgaaaccaacttaaggcaatttgtccgtttataatcgttggtagataacagatgaggtccacagatgtcctgacccaaacatcatggcatgatggaagcaagtctcagcccagacagagccatatgcacatcatgtttactatcaggcaggtacaggaacagttttcaaatgtgttctgtgtacttgacgaagccccagatctccgaccttttcggtactactccatttcacttgacacaaatgaaacgctagtctccagtgaggatccagctagcctcttgtcaaactcaaagggccaagactatttttttttgaaacagagtcttgctctgttgtccaggctggagtgcaatggcatgatctcggctcactgcaacctccaccttccaggttcaagcgattctcctgcctcagcctcccgagtagctgggattacaggtgcacaccaccactcctggctaattttttttgtattttcagtagagacagggtttctccatgttggtcaggccggtctcgaactcccgaccttgggtgatctgcccgcctcggcttcccgaagtgctgagattacaggcatgagccactgtgcccagcccagaaaggttttcttttcttttctttttctttttttttttttttttgagacagagtctccctctgtcacccaggctgcagtgcagtggcacgatctcggctcactgcaacctctgctaccaggggacctgccccgataatcacgtacgttcttttctcgtttccctaagcgtccgccggcttgagaaataaagggacagagtacaaaagagagaaattttaaagccgggcatctggggaagacatcacatgtcggtaggttccgtgatgccccacaagccacaaaaaccagcaagtttttattagggattttcaaaaggggagggagtgtgcgaataggtgtgggtcacagacatcaagtatttaacagggtaatagaatatcacaaggcaagtggaggaagggcgagatcacaggaccacaggaccaaagtgaaattaaaattgctaatgaagtttcgggcaccattgtcattgataacatcttatcaggagacaggcttttgagatcaactggtctgaccaaaatttattaggcgggaatttcctcttcctaataagcctgagagcgctatgggagactggagtttatttcatccctacagtctcgaccatagaagatggccacacctaagggggccacaccgaagggggccatttatagacccaccctcaggggtgcattctctttctcagggatgtcccatgctgagaaaaagaattcagcgatatttctgccatttgcttttgaaagaagagaaatatggctgtgttctgccctgctcacatgtggtcagagtttaaggttatctctcttgttccctgaacaattgctgttatcctgttcttttttcaaggtgcccacatttcatattgctcaaacacacatgctgtacaatttgtgcagttaatgcaattattacagggtcctgaggtgacatacatcctcctcagctgacaggattaagagattaaagtaaagacaggcataggaaatcacaagggtattgattggggaagtgataagtgtccatgaaatcttcacaatttatgtttagagattgcagtaaagataggcataagaaattacaaaagtattaatttggggaactaataaatgtccataaaatcttcacaatccacgttcttctgtcatggcttcagctggtgacttcctgcaacactccgcctcccgggttcaagtgattctcctgcctcagcctccccagtagctgggactacaggcacccgccaccacacccggctaattttttgtattttcagtagagatggggtttcaccatgttggccaggctggtctcgatctcctgacctcatgatccacccgtctcggcctcccaaagtgctgggattacaggcttgagccaccgcgcctggccaaggttttcttaatggagggacataaagtcgatattagtcgaaaggggcaagtccccctcttttacaatggacacagagctgaaaagactatgagtgacaaaaactggtgataagtgaaacacaaaacaggaaaatagaaggagttacagtaacattgtttgaagtgttttgtttttgtttgagacggagtcttgctctgtcacccaggctggagtgcagtggtgcgatctcggctcactgcaacctccatctcccgggttcaagcgattctcctgcctcagcctcctgagtggctgggattacaggtgttcaccacaatgcccgtatttttgtatttttagtagagatggggtttcaccacggtggccaggttggtctcgaactcctgacctcaggtgatccgcctgcctcggccttccaaagtgttgtgatcacaggcgtgagccaccgcgcctggcctgtttgaagttttcttaatgtattgcatttaatcaaagaggattgtaaaatgtttttaaactcaggtgagctctgaaagtgcctagtccttgtatttacccaaaccagtgtttaactcctgccactgccactcacaaaatgctggattgcctaccacttacttcactctgctccttggtttcttaatctgtataataggatcagaaattcttctgtgaggaaattcggaaaggaaaacccaaacgtagcagagacaatggacattggcacccttctgccccctggtggtaatttttagaaccatgtgggcagtggcgaggctaaaaataaaatgtgcaaagtgtaaaacaaaaaccacgcagtgtcttccttgtcatgcacagccgcgttcgaatcgctcattgtcttgcctcctcagtgctttctcccgcccacgactatcagtggtccaaccacacattgcaggaagttccaggagtcatccacttaccctagagcaagcttgtcccacctgctgcccgcgggctgcatgtggcccaggtggctttgaatgcagcccaacacaaattgataagcttttttttgtgactttttttttttttagttcatcagctatcattagtgttagtgtattttttaatgtatggcccaagacaattcttcttttaatgtggggagaaaaaagattggacacccctaccctagaggaatgatagtgtttagtatttgttttcattcttattttccttctcctctatatcgcatggattgtggagcgtgtccatgtcttcaggtcatcagcatgacttttaggggaggtgactacagagtcaaagccatgggagatgcggaattcagctgaagatcacttaaacatccagcaccgctgtagcactagtcatagaaagaatatgaagagaattcaagattaaacagattggccaggcgcggtggctcaggcctgtaatcccagcactttgggaggccgaggcaggcggatcacctgaggtcaggagttagaaaccagcctggccaacatggtgaaacccatctctattaaaagtacaaaaaatttagccgggtgtggtggcacatgcctgtaatcccagctactcgggaggctgaggcaggagaatcgcttgaacccgggaggcagaggttgcagtgagccgagattgtgccactgcactccagcctggacgacagatcaagactctgtctggaaaaaaaaaaaaaaaagattgagcaaagcagtcaatagattaattggatttaattaagtgatgaaagaattgagtaatggaacttcacccattctaaccatgtgataaagtagaaaaggttcaaagatttagtaggggtttaaaatgagtttaagagaatgggattacaattccaatcccattggtaagacaaattttatttctaaaaattcatgtatttcccccctttatacaactgcaaatgcgagtttggagctagagtgggagaggaaagcaaagaatgaagggaaagaaataggaggaagattctagaaatgggggcagcatgggagaagtggtgggagcaaagtcctggcatatagatgccacaatcaaaacttctgccctgtttcctagctgcttggtgtcagcactggggccattcccccagcctgtgaccttggcatcccctatgttgacctgggctcttcctctgtccttccacctggatgtcctttagtgggtcctggccagggtcctattgctccctttaacctctggagcttttgtctgctacattttcttacactgatgctgactcagacctaatgctgggtgaagttgtgatgtggctgaagtgtctgggtgtaattcaagaatcctcgagggagaatcaggagttttgggttccggttccaacttggtaatttaccaagtcacagcctcctggagcctggttttccctatcaataaaatgaagaaatctgtcttctctagttcataagttgtcaagatcaaatgtgtaaatacataggaagttcttaggaaagggaaggcttctatcactgtaaagaagtatcattgataactagtatatgatagtctgctgccgtctgccttccccatatgtaccctatcatgctctgagtccctccttcctgccttttccccatctcttatcacaacctgctttttgtatgtgattgctatttacaccttgataatattaaatcagagatatacacaattaaatttgagatagttacgccttgtccagaaatattcacatattaagcttgatcgctatttgggtggtaaaaagttagtccttgttcaagaaatgttaaccaacagtttggggtaggagggagaagtgaggctttccttgtgttctgaaatcactatatttcatgcctgaattagcctgtctgagctggaattcagagtgaatctttggatccatgttttaaagggacaactatagagactcccattgctttttctatgcacatagtttttgtgcggtttttactggaatcttattacagttacagttaccatcccatggaccaacatggtccatcgagggccttgcagtgagagggtcagtccatagatgctggagccacatgacgtgggttcaaatttcaactctcccacttattagtgtgtgaccttggacaggctgcttcactgctccggccctcagttttctaatttgcaaaatgggggagattaataatacctatctccagaggtttgttgggaggattaaataataggcctaaaacacctagagcagtgtctggcactgagtacacattagctggaatttatttcaattgcatgtttgaaaaaatttaaaccattcagaaatttaattttaaaaataaaaaatgaaaagtcacttaagctctctatctcccactttaaccccactcctctttccacaggcaaactgttaacagtcactttgcacacatcattcaagagttttgttttgtttttgtttttgttttgagactgagttttgctcttgttgcccaggctggagtgcaatggtgtgatctcggctcactgcaacctctgcctcccaggctcaagcgattctcctgcctcagcctcccgagtagctgggattaaaggcatgcgccaccacgcccggctaaattttgtatttttagtagagatggggtttctacatgttggttaggctggtctcaaactcctgccctcaggtgatccgcccgcctcggcctcccaaagtcctgggatcacaggtgtgagccactgcacctggcctcattcaagagtttttactgatatattttttaaatcaaagaattataatatactatttggcaacttgttttcctcacttaaccatgtagctaggagttatttccaggtcactatgcccagtgctaccttcttctgcctaagggtttcatagtatgccgcagcatggacactgcgcaattcacttaaccaatgtcttattgatggatatttggagtgtttccagttttcgatatttggagtgtttccagttttccacgatcatattcgctttttgcacattcttttctctttataattcagaaccatcaagctgaagcccagcagggcttcctcatttcatcatcatagctcatttcctattgagcaaagcttcttcctcgggtcagctcttgccacacttctttctacagaaacaagaagtggagttatctgtcctgggcttcgggagtgaacacacccattcccacgctgctgctgcccacgctgctttgcccacacagcaccactgtccctggggatcctgaataacaatctgctgagcaaaatcaacatccctttggctacagcgaggctaattgcacttaataggttgtaagagttctggtacagacaggctccttcccatgatgtatttcaccacctcattgaagagatgtgtgttccagtgagagtctgttcctccgtgtcatcccaacaaatgctcctatgtccaggagccattgtcaggaatgctcgttcctctcccttctacacagacaaatctccctttgaggacacactcaactccaactccttttgtgaagctttccctgttgctccagcctgcatgaatccttccctccgccgaatttcttcagcaagaatgccttctaggccaggcacggtggctcatgcctgtaatcccagcactttgggaggccgaggcgggcagatcacctgaggtcgggagttcgagaccagcctgaccaacatggagaaaccctgtctctactaaaatacaaaattagctgggtgtggtggtgtgtgcctataatcctagctactcaggaggctgaggcaggagaatcacttgaacccgggaggcggaggcggaggttgtggtgagctgagatggcgccactgcactccagcctgggcaacaagagcgaaactccatctgaaaaaaaaaaaaaaaaaaaaaaaaagaatgccttctaagtgcatagcacctgtgtgagggtgaaaccctggcccacagagccagtggtcgtaggatagttaaaatagaaggccacagtatattgggaggccaaggcgggcggatcacgaggtcaggagatcgagaccatcctggctaacatggtgaaaccccgtctctactaaaaatacaagaaattagccgggcgtggtggcgggcgcctgtagtcccagctactcgggaggctgaggcaggagaatggcgtgaacctgggaggcggggcttgcagtgagcagagatcgtgccactgcactccagcctgggcgacagagcaagactccgtctcaaaaaaaaaaaaaaaaaggccatagtatatcagaattccatagaaataagattattacaaaaagcctataagcagagagacactggaatatactgaagctagtatgagcaaaagggaattgtgggttggaacaccaatacccacagcaacagtgaaggaaagcaaaagcctcgcacagcgcttctcaaagtgtggtctgggggcttgttagaaatgcaatttcttggccaggcgcagtggctcacacctgtaatcccagcactttgggaggccaaggcaggcggatcacctgaggtcaggagttcaagaccagcctggccaacacggcaaaaccctgtccctactaaaaatataaaaattagccaggcgtggtggcacacgtctgtaatcccagctactcaggaggctgagacaggataattgcttaaacctgggaggtgggagttgcagtgagctgagattgcgccactgcactccaggctgggtgacaagagcgagactctatctcaaacaaattaaaaaaagaaaaaggaaaataaatgcaaattcttaggctccaccccagacttactgaatcagaaattctgggggtggaacgcagcaatctgcgctatcgtgagtcccacagatgagtctggtgcatgctgaagtctaagaaccactagcttgagtagagattcaaagtttgggtctctagcacagaaagacttttgcaacaacgagtctcgggaggcgtaaagcaagcagagaggactgcagctgttaaaagtagtcctaagaagattctaggtaggagaactcaagcgtggggagctgggaaaccccagctggcagggaggggtcctacctggcgagctgccccccaagggcctgcgctggtcaagtgtctcccgaagggtctgcctgcgggcaggagaaacacaggtgtccaggactagtgttctgactgatacgtggccctaggatttctctcctgggaccacttggagaggcaacccttggctgccagaggaagagactgatggaggcagcaggacgggaggaaggcctgtgggaggagggtgccagagtgggaagggagcatgtgaggagagtcttgatggttaatgccaattacctctagaaaattaccaggctttacagactcaagagctactacccaaaagattgaaaaaactgccttaaaaaaaaaaaaagcaacccaccccagggaagagagagagctatttagaaaactccagaagtaaataagctcagacaaatctgagatttatctggtctctgctcctgagtcctgtctgagaatcaggcacctaagagacggggtgttgtgtccaccagagacggtggagaggccgggcacggtggctcacacctgtaatcccagcacttcgggaggccgaggtgggcagatcacctgaggtcaggagttcaagaccagcctggccaaggtggtgagactctgtctcttctaaaaatacaaaaattagccagacttggtggcgcacacctgtaatcccagctactcgggaggctgaggcaggagaatcgcttgaacccgggaggcagaggatgcagtaagccaagatcacgccattgcactccagcctgggtgacagagcgagactccatctcaaaaaagaaaagagatagcgaagaaagccatcatctctggtggtttgcaggtttgattttcatagcagaacccttaatgaagatctcaagtagaactctgaaatgggaaaaacttcaacatgtaagaattgagctgctgtggataaattaggagtccagttcccacctccttattctttttatcactcagaacaatgaccacttttacacccgaccccaaccctagctccccaggatgctgctccacagaaggcagcttgaaaaacgccaatggttaacctctctggtgccttgctgggctgctgtagggacagcggggtcactgcttcacaaagtcacccttcccgttgctggcggttttgatcttcagagagttctgtcttttcttttttcttcttcttctttttttttttttttctgaggcggagttttatgcttttcccccaggctagagtgtgcaatggcgtgatctgggcttgctgcaacctctgtctcctgggttcaagtgattctcctgcctcagcctcccgagtaactggaattacaggtgcacacaaccacgcccagctaatttttggatttttagtagagacggggtttcaccatgttggccaggctagtctcgaactcctgacctcaagtgatccaccctccttggcctcccaaagtgctgagattacaggcgtgagccaccgcgcctggccagaaagttctgtcttttcttgaggtgagagctgctccctaaatttccaatcactgtgcctagtttttccctctagaagtagtaatatattcttctacgtgaaagatctgtaaagaactaaagagctttaagagcaatcttttaacttttgccttttccaggcaaaaatctcatcacttcttgcaaaggattctcatgtgacatggtcactctctgtgggacacactccagtttgtcaacatcttttaaaatgaggctcctggaagaaaacatggctccagacaggatctgatcaggacctttcccccatctgagcactaaccctcaattaatgtagcgtaggcttacattagctttctgggcagccagtccacagagtgttcatactgcgactgctgccaattggatgccctctgtctgtttcacgttgtttttaggttaactgtttcctgtcctgtgctcttgcagttggcatttcttaatgcaagtcatggactttacttgtgtctccataatatcttgtcctgtaggtgttagtccagtcactcaaaatattataaaatacagatcttttccttttctttttttttttttgagatggagttttgctcttgttgcccaggctggagtgcagtggtgcagtctcagctcactgcaacctccgcctcctgggttcaagcaattctcctgcctcagcctcccgagtatccaggattgcaggcgtgcaccaccacgcctggctaattttgtatttttagtagagacggggttccaccatgttggccaggatggtctccatctcctgacctagtgatccacccacctcggcctcccatagtgctgggattataggcatgagccaccacgcccggctggcaaaagactttttaaaaaaactttcacatattgaacacttactccatgacagatgctgtactatgcatatggtatctaacttcctccttacgctggcccagtggaaacaggtattaacgtcccattttacaaatgagaaaactggggaaaggaacaaagatgaatgtatcctgatttctgagggtcttttcggctgatgactgagcagggagatgttctacacacacagccatttaagccccacccagcagtcctaagggaagagttaggctcagcaccggatgaaaggcttgaaccacgggagcgagagcagaagaaaaactcactcctggttccttctccctagggtgacacctcatccaccttttgaagaaagtggggccaggcataggaatggaccaagaaaatgaaaaacagttaaagctggattttaaaaataaagcttattgagcatataatgctataaaatgtgcttgctcatgcagttgtcttggatgtaagaccctgatatttggatacagtggctttatcaggatgaaatattttttcttccttgacttccaccatgcccagttaattttttgtatttttagtagagacggggtttcaccgtgttagccaggatggtctccatctcctgacctcgtgagccgctggcctcggcctcccaaagtgctggaattacaggcgtgagccaccacgcccggccttgacttccttttttggttttgcgggagggaatggattgagtgaaggaggaaccccacacagtctactctatctacacagcatttatgaccgtgtgatatttttctttttctttttttttgcctatagtttcttgttggaaaaagacacgttttcttgttgactgttgctccccgacagaaatgtgagctccacgaaagaaaagtcctggcttttcctctctgtatacctgttacccagaacagtgcttggcacctgtgaagtgcttcagacatattcgatcaataattaaagaatgggtctatgtatggcacagacaacctagcgtttttaaaagatgatttaaaaacagtgtaaattctgagcaaggctcactctagatgtggaggtagtcacgtttaaattacaagaaaaaattgcagccaggcgtggtggctcacgcctgtaatcccaacactctgggaggccgaggcgggcggttcacttgtggtcaggagttcaagcccagcctgacactcctctaatcccaactactcaggaggctgaggcaggagaatcgcttgaacccgggagggggaggttgcagtgagccgagactgctccactgcactccagcctgggcaacagagcaagataccatctcaaaaaataaataaataaataaaaataaaataaaattttaaaaaaggataagaaatagaaaaagaaaaaattgctaatacccagtgccaagccagagctaccttttgataaaaaacaaatactgccctctgatggtagtagttttttaatttttaattttagcagcaataaacatcctcatttcctgaataccaaactatggctgcccacgatggcagagccagtgggagggacaagaagatgcacaatgtgctttgccatctgagtccaggataattctctcagctaccacccactacacacccacacactacacacccacacccacccactacacacccacacactacacaccccacccattacacacccacacccacacactacacacccacacctacacacccacacccacccactacacacccacacactacacacccacacctacatacccacacccacccactacacacccacacactacacaccccacacactacacacccacacccacccactacacacccacacacccacacccacccactacacacccacacacccacacccacccactacacacccacacacccacacccacccactacacacccacacactacacacccacccactacacacccacccactacacaccccacccactacacacccacacccacccactacacacctacccactacacacccacacctacacacccacccactacacaccccacacccactacacacccacacacctacacacccacccactacacaccccacacactacacaccccacacccactacacacccacacactacacacccacacccaacacccgtacacccacaccacaccccgcacacccacacactacacacccacacccaacacccatacacccacaccccacacacacccgcatgcccacactcacacacccacaccccacacacacacccacacacccacattcacacacccacacacccacacccgcacacctgcacaccgcacagccaaacactacacacccacacactacacaccctaaacatctacacacccacacacccaaacacacacaccacacacccacacacctgcacactcgcacactgcacacccacacacccagacaccccacacaccacatcccatacccacacaccacaccacacacccacacaccccacacccacacacccacacaccacacaccccacacaaccacacacaccacacacacacccacacacacccacacccacagaccctggacaccgccacccacacaccacatacccacacaccccacacacccacacacccacacacccacatgcacccacacaccccacacacccacacaccacacacaccccacacaccacacacccacacacaccacacgcacgcacccacacaccacacacccacacaccccatacacccacacaccccaaccttccaactacattactgcccctagccttttttttttttttttgatacggagtttcactctgttgcccaggctggactgcagtggcgcgatcttggctcactgcaacctccacctcccggattcaagcgattctccttcctcagcctcctgagtagctgggattacaggcgcccgccaccatgcccggctaattttgtatttttactagagacgggatttcaccatgttggtcaggctggtctcgaactcctgacctcagatgatccacccacctcagcctctcaaagtgctgggattacaggcatgagccaccaggcccagccctagcctctcttatatagaaattctagaaccccactgattaacttggcagtgctagggtgggcctgtccagacgcagtgtcaggaagatagtgacacagcttgcttgcttgcgccagctgggatccagaggcgggtaacccgtaacatggcaattgttctttattctgtctggcttctcaacttgacctcttcttttttttgcctccaacttgctgctctttcctgcttcctgttatcagctcctctcataggtagaaatgtggaaaatctaaaatatattagtccgatgcatcaaaagcataccctaaaagggaggccaggcgtggtggctcatgcctgtaatctcagcattttgggagaccaaggcaggtggattacttgagctcaggagtttgagaccagcctggccaacatggtgacaccccatctctactaaaaatacaaaaattagctgggcgtggtggtgggtgcctgtagccccagctactcgggaggctgaggcaagagaattgcttgaacctgggaggtggaagttgcagtgagctgagattgtgccactgcactccagcctgggcgacagagcaagactctgcctcaaaaaacgaaacaaaacaaaacgcaaaagcatccaagcatgccataaaaggctaatagatttttttaaatttgttatttatttatttttgagacaaggtcttgctcagtcgcccaggctggagtgcaatgactcaatctcagttccctgcagcctccacttcccaggctcaagcgatcctcccacctcagcctccctagtagctgagaccacaggtgcacaccatcatatccagctaatttttttgtatttttttcagagatgaggtctcactttttgcccacactggtcttgaactcctggactcacctgatcctcctgcctcagactcccaaagtgttgggactataggcatgagccactgcacctggccctaagtgttgggactacaggcatgagccactgcacctggccctaaaaagatgttaatctgtttatcatacaggctatcagtgccaaagtataattttcaaaattcaaaaaacataattctcatataaatagaaaatgaatccatgtttaagacttattaacccattggtgaagaagaccagtaagatgtaaagctagttcaaagaatgtttacaggcattcacaaagggatgttaaaataagactgttagtttagatataatagtggttaatggactggacgcagtggctcacaattgtaatcctttgggaggccaaggtgggtggatcgctttaggttaggagttcgagaccagcctggctaacatagtgaaaccccatctctactaaaaatacaaaaattatcagtcatggtggtgcacacttgtaatctcagctacttgggaggctgaggcgggaggatcacttgagtctgggaggtggaggctgcagtgagccagcatacggccactgcactgtattctgggcaatggagtgagtcgctgtctcaagggaaaaaaaaagcggttaatgtcctctagggaaatgaaaataaccttcacagttatattttttagtgtgcagaaatcttcaagttaatatgcagctgcaccatgtctaggctctaatcaaatagtaaatagcaaagtcaaacagttacattgttctagaaaattaacccttgtggaagcttttaaataatgccccagtatgacattgaaaagacatgtggccctgatttttgccttattgtaagttttgggtagttttggatagttaacacaagtttatgtattcttcaacgtcttaccttcttctattagtctttccctgttttggagtgtgttagtacttctcaaattaaacagtggatatgagaaacagaaaatgtaaatctctgaaaacttctgttgttactagttgacaattctaatttcagggtggggagaaaaaaggaaaagtgagggaagagatgaaaagttttgagttaggccaggcgcagtggctcatgcctgtaatcccagcactttgggaggccgagcagggcagacacgcggtcaagagatcaagaccatcctaggcaacatagtgaaaccccgtctttactaaaaaaaaatacaaaaattagctgggcatggtggtgcacgcctgtaatcccagctacttgggaggttgaagcacgagaatcgcttgaacctgggaggcggagcttgcagtgagccgagattgcgccactgcactccagcctggcgacagagcaagactccgtctcaaaggaaaaacaaaacaaaacaaaacaaaaagtctgggtgcagtggctcatgcctgtaatcccagcactttgggaggccgaagagggcggatcacctgaggtcaatagttcgaaaccagcctgaccaacatggagaaaccccatctctactaaaaatacaaaaaattagccgggcatggtggcacatgcctgtaatcccagctactcgggaggccgaggcaggagaattgcttgaaccctggaggcagaggttgcagtgagctgaggtcatgccattgcactctagcctgggcaacaagagtgaaactccgtctcaaaaaaaaaaaaattttgagttaaatgaattttgaggattatatataatgaggtttaatgtatccattctatttctattgttcattattagaaataacagatacctctaagtttcctgagggcagagaaggcctctggccaaaaatgtgaaaattatctagtatccagtatataatatcaggaaagagggagaatggaatcaagaaatatttaatagtagtgatgacagatgtcttggctgtggctaaaatttgcttctcagtagagaggcatatggcaatcttactggcccaactacacaaggctacagttaggccacggaggggagaagaaggcagccttaaaaggttcctggattaggcgtccacgtttaagttaggcccaaggaacattcattccatttgaagactgccctatctgtcttgagcatgtaccaccatttttttccttttggtggaccatgtgtatatacatatatgtgtgtgtggaaattttttttccatttttttacaaatggaaaatatatatatttttaaatctaaccttcctaatctttttaattttattttattttatttgagatggagtttcgctcttgttacccaggctggagtgcaatggcgcaatctcggctcactgcaacctccgcctcccaagttcaagtgagtctcctgcctcagcttcccgagtagctgggattacaggcacctgccaccacgcccagctaattttttgtatttttagtagagatggggtttctccatgttggtcaggctggtctcgaactcctgacttcaggtgatccccttgcctcggcctcccaaagtgccaggattacaggcgtgagccaccgcgcccagcctaaccttcctaatcttttatcacttctcttctctgtacttcttcttccctttttcctatctactataggaattagctactatatattatctactatatatatattatctactataattccatctttttacattttcttcttcaaattgttggtgcagttgccaataccatagtaagcattttgtacccacccaagtgactttaggatctggctgattttattctccattttgccactcatcaatgttcccaggatctttcaacatctgagctgttgctcctttagactcctcgatttcacaggactctgtaactttcttgatttcctgtacttccctctctatctgtcttggtttggaatgtgaagaggccggatctgattagcaccagggcttctaaacttctgagatctctttactcagcattccccttctatgacccaattgctttacctattttctcccaagcaaacctgccacaagttgctagaactgccctgtgcaacgagtcagcccctgtcattttacacgctgtctgctggctccacaggactctatccagccttagattccaagctccactgctttgcgctgcccttgccagcttcccggccttcctcagtccctgatgcctgctctgtccactgtatcagtctcttcccggaggtctcccggcctattcttgagagacagttggtccacattgtgtccagagatgggagaggctaatggaagaggcttattcccttgttaatggaattttttgctgcaagaaacagaaaaataccaatttaaattgttttttatctttattatctttatttatttatttatttggacagagtcttgctctgtctccaggctggactgcaatggtgcaatctgggctcactgcgacctctgcctcccaggttcaagcgattctcctgcctcagcctcctgagtagctgggactacaggcatgctccaccatgcccggccaatttttgtatttttagtagagatggggtttcaccatgttggccaagctgatctcgaactcttgacctcaggtgatccgcctgctttggcctcccacagtgctgagattacaggtgtgagccactgtgtccagcctaaattggtttttgaaatgtgaaatttggccgggtgcagtggctcatgcctataatcccagcgctttgggaggccaaggcgggcagatcacaaggtcaggagtctgagaccagcctggccaacatggtgaaatcccatctctactaaaaatacaaaaatttctgggcgtggtggcgggcgcctgtagtcccagctactcgggaggctgaggcaggagaatcgcttgaacccgggaggtggaggttgcagtgaaccgagatcgcaccactgcactccagcctgggagacagagcaagactctgtctcaatcaatcaatcaatcaatcaataaaatgggaaatttgttaattcatataacgaggtagggcagcctccatgtgcagcatatcagggttctgtatccttctttctgtgattctctttgttctgccctcattaatgatgactgtcatcctcaggctggcaacaaaacgaccacagtatttcccaatatcacattcagacacaaccacgtctagagaagcagagaggccttttcttttctcccacaaatatagaacacctttctacagttgatctcagccgaaaggcagagaagaaatctagaacatctttctcacaagtcctcatagatgctgctttcacatctcattggtcagaaacaggtaatgtgcccatctctaaacaaatcacagacaatggaatgggatcactggtatttctttattattcatttttaaattttattctttatttatttctttttcttttctttttttttttttgagagagagtttcactcttgttgcccaggctggaatgcaatggcacgatctcggctcactgcaacctctgccttccaggttcaaacgattctcctgtctcagcctcccaagtagctgggattacaggcatgtgccaccatgcctggctaattttgtatttttagtagagacggggtttctccatgttggtcaggctggtctcaaactcccaacctcaggtgatctgcccacctcagcctcccaaagtgctgggattataggcatgagccactgcacctggcctattctttatttcttttagagacagcgtcattctgtctctcacccagcctggagtgcagtggaataatcatagctcactgcggccttgaactcctggctcaagcaatcctcctgccccagcctcccaagtagttggaactacaggtgtgctaattttttaaaatttctgtagagatgggcagggagcactctcactatattgcccaggctggtcttgaactccaggcctcaagcaatcctctcacctcggcttctcaaagtgctgggattacaggcatgagcacaccgtgcccagagatttatttagatcagtcaggatttgcctccggatctgagacttgtgtgggaggcttatacttgaacaacaaaattggacttctgcaggcaataaagaaggagattaaggatgttgagtaggtaatcagcagtatctgctatagtgtgaaatggtggaccattgagaggaagactttataaacacttttcagcttgaaggtcgctaatttaaccattaacggtctcttcttgtaaatttgaccatgggaagttcttttgttagtttgtcggttgttttttcaggggagatggtgaggatgggggagattctttttaatttctaactcctggccgggtgcaatggctcacgcctggaatcccagcactttgggaggccgaggtgggcggatcacaaggtcaggagtttgagaccatcctgacgaacatgaaaccacgtctctactaaaaataaaaaattagctgggtgcggtggctcacgcctggaatcccagcactttgggaagccgaggcgggcgaatcacttgaggtcaggagttcaagaccagcctgaccaacatggtgaaaccacatctctactaaaaatacaaaaattagccaggcatggtggcgggtgcctgtaatcccagctactcgggaggctgaggcaggagaatcactgaacctgggaggtggaggttgcagtgagccaagatctcaccactgtactccagcctgggcgacaaagttagattccatctcaaaaaaaaaaaaaaaaaaaaaagtaactcctggattatccatttttgtttgacatccccagaatatactttctccatctatgttgaacatatccaaccttagccttgcatctgaaaaaaggtcctctgctcacctgctcttttcaccctaactactccctctctcctatgcttcttcccatctcgctctaatcccatggctctgcttgcgccatttaggggaacacagaaatcgttaacctcaacctgctgtcggcatcataaactgacctgaccataactacatcagtcttttgtcttgttcttccttctccttgaaagctgtctgtttccagacatcctgaggagtttccacagagtaaatactcaaaagtgtttactgaataaatgcatttattctgtcccttctccagcctttttcaacctccacctttgtgtgggcgcaaggaatttttacatgtatttttggtcccccttgctcagtcttcaaacaatggtctgcagacatttgttttctattttttaacagctttatcgagacataatttatatagctcagtatataccataacatttacctgtttttaagtgcacaaatcaattcagtgaatttatagaattgtgaaaacaagacacaatccagttttaaagtgtttgcatcaacctccaaaaaatcatctcccatccccagccccaggcagccataatcaattcccatccccagacccaggcagccataatcaattcccatcctcagccccaggcagccataatcaattcccatccccagccccaggcagccataatcaattcccatccccagccccaggcagccataatcaattcccatccgcagccccaggcagccataatcaattcccatccccagccccaggcagccataatcaattcccatccgcagccccaggcagccataatcaattcccatcccccgccccaggcagccataatcaattcccatccccagccccaggcagccataatcaattctcatccccagccccaggcagccataatcaattcccatccgcagccccaggcagccctcatctgctttctgtctctatagagctgctttaaaaaaaaatatttcatggccgggtgcagtggctcatgcccgtaatcccagcaccttgggaggccaaggcgggtggatcacctgaggtcaggagtttgagaccagcctggccaacatggcgaaacctcatctctactaaaaatacaaaaattagccaggcgtggtggcgggcgcctgcagtcccagctactggagaggctgaggcaggagaatcgcttgaatctgggaggcagaggttgcagtgagccaagatcacatcactacactccagcccgggcaacagagtgagtctccatctcaaaaaaaaaaaaaaaagaaaagaaaaatcttgtggggaatgcctttctacgtatgacaaaaggtgcagatgtgtagagaaaaatattcataaattttaccacattaaacaattctaccaggaaaaaatatcaaatttttttaaatgacaaggtggaaatatttgcaacttatttcatagactaaggactaatttccttgataaacaacttttataaatctgtaagaaaaagaccagcaacccaataaaaaaatgaacaaaggacttaagttatttcataaaaaatgggtcttggccgtgtgcggtggctcacgcctgtaatcctagcactttgggaggccgaggtgggcggatcatgaggtcaagaaatcaagaccatcctggccaacatggtgaagccctgtctctactaaaaatacaaaaattagcctggcatggtggtgcatgcctgtagtcccagctactcaggaggctgaggtgggagaattgcttgaacccaggagggctgcagtgagctgagaggttgcagtgaggttgcagtgagctgagatcgcaccactgcactctggcctggcgacagagcgagactcagtctaaaaaaaaaaaaaaaatggttcttaaatatatgatactcagaccccctcaaaataagagaaatgcaaatcaaaactataagataccatttttatattagaatattggcaaaactcaaaaagtttgataacattctccattgatgagtatatgggggaaatgggtactcaaatgtattgctgatagtttaagttggtacaaccttcgtggtaagtactacgcattggtaaaatgcactccaacctcatctcctaccatttcttctcttgcacaatttgtattagccacattggcctcctgctcctcctcaaacatgcaaggcacactccagccccagggctaatacacttacctttccccgctaatcctgaaatgcataccaatttttccttgcctccttcaggcctttgctcatcatgtgatctaaaacagtggctcccatcccctctatcattctccttttcatcccattttgagcacttaccatctgatgacactattctatgcatttatgtctctgctctccaactgtaaacccaggactttgctgtatatactgctgtaaccccaaactccagaacagtacaggcttagaatgtagtaagtgcttattaactacaaataatgaatgaatgaacgtctattggtgacaacttagtatctattaaaacttagaatgcacatacttagtaattcccctttaggcatttatctaatagatatccttgcatatgtgcaaaacagagaatgtacaaggttatttgttgtagcactgtttgtagtcatgaaaggagaaaacaacccaaggataaatttttttttttttttttgagacagagtttcactcttgttgcccaggctggagtgcaataatggcatgacctcggctcaccacaacctccacctcccgggttcaagcgattctcctgcctcagcctccggagtagctgggattacaggcatgcaccaccacacccggctaattttgtatttttagtagagacggggtttcttcatgttggtcaggctggtcttgaactcccaacctcacgtgatctgcccgcctcagcctctcaaagtgctgggattacaggcatgagccactgcgcccagcaacccaaggacaaattttaaaataagttacctatagccaggcacagtggctcacatctgtaatcctagcactttggtaggctgaggtgggtggatcacttgagcccaggagttccagacaagcctaggcaacatggtgaaaccctgtctctacaaaaaatacaaaaattagccaggtgtggtggtgggcacctgtactcacagctacttgggaggctgagaggggaggctcacttgagcccaggaggttgaggctttggtgagctgtgatcatgccactgcactccagcctgggtgacagagtgagaccctgtctcaaataaaaaataaactacctatatctatacaataaagaataaaggaatactatgtagatatggaaagatctctaattcagaaaattatttggctccctttggctactgtatgtatgagatctgactatttcaaaactctggtgatatcactacaagaatgagctcccttttaatgaagtgcttaatggtaaggagagtggaagtgaacaggtagaaacactgagtaattattttcagttttatttaataaacatcaatttccttgtagaaaacatagaatttctaccaactaaacaatattgtaataaggataaatgtatcaaatcacagataatgttgttaaacgaagatgctgtcttgcagatccattcatgaacaggcctaaactggcagtgcctattgttcatttattatgggtggatttcccattttacaaacaaaccttttatttatgggaagaggttcagcgtttcgcaatgtctttagtatgtatttcccgataccggaggggcagaattccccctctgtccatcaagtgacatctgcttgcagctgtagggaattttgcagggtactcttttccagagataaataatataaagatataacacataagaggtaattccctggtaaccatatatgtcccccaatcttgtcttgtcaaactataatttgcttatggttcctcaaaaaaaaaattgtttcttgtccctttactacttcccctctccttcttttcagttgctcttatcaggaatcctacacaagcatctacctaaacactactatttcaagggccaggccacctcctatctctttactaaaggacaaagtcttcccttactattctactctacagtaatatatgctctggccttctttagcctttatcatgcatttggcactaatgtttgtgttgcttaatactgctaattagcttttcacaggttttgacatcttccagtcagattgtaagcttttttttttttttttttttgagatggagttttgctcatcgcccaggctggagtacaatggcgcgatctcggctcactgcaacctcagcctcccaggttcaagcgaatctcctgcctcagcctcctgagtagccgggattacaggcacccgccaccacgcctggctaatttttgtatttttagtagaggcgaggtttcaccatgttggctaggctggtctcgaactcctgaccttaggtgatccacccgcctcagcctcccaaagtgctgggattacaggcgtgagccaccgcacccggcatgattgtaagctccttaaaggcagattcctttattctgtttttcccatactcctcatgcacctacatagtagatgctttaaatgtcctggttttgaaaagtaacatggtcaatcccctataacccaacatatttagtattctttacagcttcttccagaaccagtctggtaataaacatggatattctgctagcccaatgcatgttttgagtgtttggtatcagaactcatcagctgactctgtgtcccagccacaggactgcagttgatcgtcctgtggaaattcaacctcaatgtcataaacaaaatttggatcatccttcttcttctgatttttctcaaaaagttcatccatgatgctctttcttttggcaagctccttgtcatctagtttgttcaggtcttcctcaggatcaatggttgtttcccgttgaatttgttccattgtttctgccagactctgccccgacaagtaacctcgtaaaaaactgaatagcttctctagctgcctcagggatacttgttctaggtaactcttgtgtcgcggattattctttaattgttcagcagctctggtgcaatctgggagagagaagaaaactatataccacatacgtaccacgtacatcatatacgccataaactactgcaacagccaaaacagaacaaaaactctgaaccctgaaaatattatctccattatagtcaagtagctaaatggcttgattggaatgaattactttgtagaaccattcctttatattgagctttcagtgtggtgggagaaggacagatacagttttgacttctttaacttaaaaatcactttgtagagatattaaacactttcaactggagaatatgtctgagaagaaaagtgatattatagcttttagatagcagtagtggtattaataaaatattaagactacaaataaaaaacatttggaatgagagaagggaattaatattattgaataatgctatatcatttaacctaggcagcaatcccaaaaggattattaattatcagattggaaaaaaacactacaattcccttttatagattaggaaactgaagctcactgagagtaagtaattcatccagtgtcacacatccagtccctgacagagtcatgatgtgaacctgtatttagagaatatttaagacaggaggcaagataagacatgaggtacctgaaaactttgaaaagtttcgaactggcataatgcgctggcgaattttccccttgatttcactctcatagattaagataatagctggaggctgaaacctaatcccacatttcttggcagtgcacatcattcccatgtacatgtccgggtaagtcagaggaaatctgatgaatatgtgtaagttgcataatgacttcctgctaaagggaaaaaacaactaggtgttggataaatgtcattcattcccctcgcccctttgccccagaagatctggttctagtccggctctggccacacacgctcagcctgtgaaactcattttttttaaaattaaaatacggactgcttcatgaatttgtgtgtcatccttgcgcaggggccatgctgatcctctctgtatcattccaattgtggggtatgtgcgcgggaacgaccacaaagctcagttattttgagaactgccctgaaagttcagcttggccctgggttagtttcaacctgttggatccctaagatctggttttttcaaggatatagacttgttcatatgtgaatctggggatgcaatccagtttgaacctcttagtgtactgcactcttactgaagatcgaatatgaacccctaagtcagcccaatagctgacctatagggtctttactatttatcaattaagaaagggcatatcgagcatcctcggtatcaaggtactatgataaggtaagttttttaaccttaatcattttgtcctgagaggttcaccaatccagaactgtctcctttgtactttcccaattattttactagagttttttgtcattatttatttaatcatctatcttcccttctagtcaatatgctccatgagggtggggggcatattcattttccaccacaatatctcagcataatacctggaacgtagtgggcattccatacattgtttaatgctatgaattaacatgatggtccctgtacatttttgaaagcatttacagtctagaagcctgatcaaaaagcagacctgctgcagaatcagcttcttcatatacacgtcagtaacgtctgcagctacatcatatacatcacatatctcagcttcttcatatacaatagtcagtaatgtctgcagggcttttattttggcctgtgtgtctcactatatgataattttctagctacaagaaacagctatttgtagatgaatacttactattctctcttcctttccccaccctcagtgcccaaagaatacacttaaccctaagcactgcttttgatgtgactgtgacattcccagaaagatttgtaaatgtcaagaaacattgaggtaaagtggcatagggtgatgatatcttcgtgaactcagttctgctggagaatcactattaggaacatactttttattaaatacttagcagtgattatacacgtcattgtagaatactgggggcaaaggagaggggaaacctatagaaaataatcacccttgattgtgtccagtcttttttctaggcatatagtttatagtatgtttcatacataccttatcatacaagctatttcctgacgttcaaatttaacaacatatattattattttgtcatcaaatgttttactacaatgtaacattttatatgactgctaaatgttttattttatggatgtactataatcatattattcaccacttattgttgggcatgagaatttttactcttagaaaattaatcacatataagcccaggcacagtggctcaccccagccagcactttgggaggtcaaggtgggcagatcatttgaggtcaggagttcgagaccagcctggccaacatggtgaaaaccacgtctgtactaaaaatacaaaaattagctggacatagtggcaggtgcctgtaatcccagctactcgagaggccaaggcaggagaatcacttgaacctgggaggcggaggttgcagtgagctgagatggtaccactgcactccagcatgggtgacaagagcaagactccatctcaaaaagatggaggcaggtgtggtggctcaggcctgtaatcccaacactttgggaggccaaggagaggagataccttgaggccaggagtttgagaccagcctgggcaacacagcgagaccatgcatgtctctacaaaaaatttaaaaattggccaggcatggcagcatgcacctgtagtcccagccacaccaaaggccaaggtgggagaatcgcctgaacccaggagtttggggctgcagtgagttgagatggtgccactgcacaacagcctctccaaagcatgatacgcctattcttaaaaaaaaaaaaaaaaaaaaaaaaaactactttaaaaaattactgtgctctacctctaatctgatgcaatgagctcacaccatttctccttcttttccttctcttttcttgctttttttttttttttaacgaatactattcccaattcacctaactaaaatttgatgttagtaaactacaacctacggggcacatataaactccacacactgaagcaatggctgtactcgtcaaagatgtatgcagttggtactcaaataatgtagttttttttttactagactctttttaaaatttaactttaatttttgctaaagtaatgtttgtatttggaatataaaataattctatgaggcttataacaacaaactatcgtccttggccctactcctcttcatagggagccagactgaattttaaaaggcatatcttccaaaatttctctctccatttcttaagaaacatgcttatactaccattttcagtttttttttttcttttgaaacagagtctccctctgtcgcctaggctgcagtgcagtggcgtgatctcccctcgctgcaacctccgcctcctgggttcaagcgattctcgtgcctcagcctcccgagtagctggaattacaggtgcctaccaccatgcccagctaatctttgtattttcagtagagacggggtttcgccatcttggccaggctggtctcgaactcctgacctcaggtgattcgcccaaagtgctggggctataggcgtgagccacctgcccggctattttcagttttggatagtatgttttgacatacactctgtttcctctttgagacacccgctctagagccctctattccactccaagccgcctggatgctctcttggcctgcttacagattccactctgtttaggaagaaggacggcacgtttatccaattattcttcctggacacgaatactcctctccccagagatcagtaactgcccacaatcttgttaggaagccccacagcacctaagggtacgaatgtccccaaagagtagacgattctctccctactcacgtctccactagtgcaaggctggctttcttacccttagaggaatacagaaatgacatcgtctgcaggccaacgtctaaacaaccaggagtgggtttttccacccaaccgcagtgcacgcaaagcccctaagccgactgtgagaccgggcggagcctggcgctgcaggaagaggcgacagccacagccctactgacgagcccgaggggtgaactccccggcgggaggcccgaaccctcaaacaccgggaagcggaggtgggggccggctgggggaccggtccaccggctcccacctcggcgtacagggattccaggtcccggcgagcgctggcctagcggtttccacagcgacaggccgggcgcgcgtccccgcgcgtgcgcagctcctcgcccgcccccgggtgggcggagcaaggaacagctgggcggggacgaccgccccacgccgcgcgggaacccttgggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggtaaggggggcggggcttggggggccagagcgtgggagcggtcccggctcccgggcctctcggcgggttgcggggatgtggggacccggcgcgggacctagatcagtagggcgagccggaggaggtcagacactagagccgtgtgccctccttccctcccgtgcgctttgctctgcggcggatcccgggtctccgggagagtcgggctcgggccctgcggttcccaggctggactggccgccctgttactaaagttctgagaaggaaagtcagccgtcaagcgtcttgggatgctcttgagctgcacgaagcttctgatcaccaaggggccaggcaaggccttagcgccctgtgaggcctgagaatccccaaactgaatgtaggactccgtggcaaactgctagttgttcgtgcaagtagtagttggcaaactgcttgtactactgagacgggcaagtgcgggaataattacaataaagggtaaggtttgatgggaggaaagcacaaaccctacaagtttctccatctgtaaaatgaggatgtttctgtcatccttggtatcatttagatccgtttagtatctgtcaatcagtgcagttctgcttgtgtgtttacatattgggttttcaagtttatctaaacaaaggattatgaggccaagaagattttttttttgagatggagtctcactctgttgccaggctggagtgcaatggcgcgatctcggctcactgcaacctccgcctttcccaagttcaagcaattcttctgcttcagcctcccaagtagctgggattattacaggtgcccgccaccatgcccagctaattttttgtatttttagtagagacggggtttcgccgtattggtcaagctggtcttgaactcctgacctcaggtggtccaccctcctcagcctcccaaagtgccaggattacaggtgtgaactaccatgctcggccagaagaatttttaaacagttggatttggtaatctgtagaggcttccaacgttagcattttataattgaaaaggggtcaaaattagcggggcgtgatggcgtgcccctgtagtcccagctactcagggggctaaggcaggagaatcgcttgaactagggaggcggaggttgcagtgagccgagatcgcgccattgcactccagcctgggtgacagagggagactctgtctcaaaaaaaaaaaaaaaaaggaaaaagaagtcaatttccagagccagttcaccactaccaaagtaatagttaagaggaaaaatgttgaaggtaaattcacattcaacaaattcgttttaaaaatggtacttttgcctttaaaatcatgacattctagtatttgctgtactatttgtaaattagcctttctccggtcccaatgatcaactgctgtctggtgtacataccagtagaatttaagcctgttcataatttttcttctaatttaatttatagttggatagcagtcctcacttcccaccctacccccattaaaattaaacaggatgaagaaagatctggatttgtgctgggcacagtggctcacacctgaaattctaacacattgggaggctgaggtggaaggattgcttgaggccaagagttcaagaccagcctggaaaacatagcaagaccctgtctctgcaaaaaaatttaaaagtagccaggtgtggtggcgtgggcctataatcctagctacttgggaggccgatgtgggaggattgcttgagctcagaagttcaaggctgcagtgagctgtgatcatgccactgcattccagcttgtgtgacagagtaaggccctgtctctttttttttttttttttttgagacggagtcttgctctcttgccaggctagtgcagtggcgcaatctcggcttattgcaaccttcacctcccaggttcaagcgattctcctgcctcagcctcccaagtagcgggaactacaggtgcacaccacgacgcccggctaattttttgtattttagtaaagacggggtttcaccatgttggccaggttggtcttaaactgttgaccttgtgatctgcctgcctccccctcccaaagtgctgggattacaggcatgagtcactgcacccaggctatttgttcttttttttaagaggcagagccttgctcggctgggcgctgtggcccatgcctgtaatcccagcattttggaaggccagggtgggcagatcaccaggtcaggagatcgagaccagcctggccaacgtggtgaaactccatctctactaaaaatacaagaattagccgggcgtagtggcgcgtgcctgtagtcccagctactctggaggctgaggcaggagaattgcttgaacctgggaggcagaggttgcagtgagccaagatcgtgcaactgcagtgcagcctggcaacagagtgagactccgtctcaaaaaataaataaataaataaataaaaataaaaaaagaacaaataaaaatctggattggtacaagatacatatggaatttggggatttgtttattcaggaaaagatcatatgcttctccaaagcaaatacaatttcttttttgagggctggagatttttcagtgaaatgtaactagacaaattctcgaagagctgtaacactaaaatttcattcaattttagtgttgaaagtggaagtatcttaggctttaaaaatcaggcaaacctttcttctaatcggtcacgtagttagttgtatgacccagggccatttactaatgctttagaagttcaagtttcctcctgcaaacaaatggcagtgattttgcttattttgctatagatcgtgaaagttaaaacacatatgaaagcaccaagtagaggatctagcatgttagatattatttaaccagttatttttttctattcttttttcattccttcaaatagtttcaccttcacatcatttttcttaatgcatcttttcagaaatacatctaatggattcagcaatattcaatgataataacaggattatgtaaataatatatagttttctgtatgtgtttggggtttgtttgtttgttttgagacaaggtctggctttgtcacccaggctggagtgcagtggtgcagtctctgctcactgcagcctccctctgcctcctggcctcaagccatgctcccacctcagcctcctaagtagctaatttttgtatttttcttaatggagatggagtcttgctatgttgtccaggcttgtgtgtgttttttaaatgttcttcccacagatttacagcttttgaaatgggacaaagttccatagcaaatgcctggcagagttgctggtcaatagtaactgaattttcagttttaagatgcttacattgagtaatagttttctttttttgtgtttagagacaaggtctctctctgtcacccaggcttgagtgcagtggtataatcatagctcactgaagcccccatcccctgggttcaagcaatcctcccacctcaagtgcgagctggcacacctggctcagagtaacagcttgagtgtctggaatctggatgaagtcagtatactgagatttgtgcttattctaagtttacagtggaacccgttgaacctttacgtgcctccagctttgctttttgttttttttttaaaccttccagcatctccacaaggcataaatgtaccattttcctggttttgtaggcatggatgttagaatatagaagttgccagtatgtatctatctgatacacagtttcagtgaacaaggattaaaatggagatttcctggctctttagccatcctgttcctttttggtatcttgggatcacctgaataaagtaatattaataaaaaacacttacatagaacacttaatatgtattcttactactgttctaagtgcttctacttacattaaattcttacgacagctagtagagagataaactatcttgcccaaagttaacacagctgttaagttacagactgggatttgaaatcaggcaatctaactccagagtcactgttcttaaccacagtgctatattggaagtagatttatatatatatttcaaattgcttaaattttaaaaggttttgtttttaggttggttagattttctaggcaagtaaagcctactaaaataactcttttataattatttaaatattattttattcagtgcttttgtttttaaaaaaaaatcgtttggttcttataggcataagggccatgtgttctgaaattattttgaggcaagaagttttgaaagatggtttccacaggtaagttgcctgttgatttctatttctattaaaataatgtgtcatataattgagagcaaaaaattgatggttgaaatttgtataaattgaaaaatcaggccagatgcggtggctctcatctgtaatcccaacactttgggaggccgaggcaggcggatcacaaggtcaggagtttgataccagcctggccaacatagtgaaacgctgtctctactaaaaatacaaaaattagttgggcatgatggtacacacacctatagtcccagctacttcagaggctgaggcaggagaatcacttgaacccgggaggtggagattgtggtgagccgagatcatgccactgcactccagcctgggcaacagagtgagactctgtctcaaaaaaagaaaaaagaaaaatcacttgcttcctcaaagttactcagtgatggcatatgtggttcacactttgaaataatgattaactgagtggagcaaagaagaaaacaagtatgtattgtttaccacgtacagttgtcccttggtatctgaggggattggttcctcctggacctcccctgaggacaccaaagtcctcagatgctcaagttccctatatcaaatggcatagtacttgtatagaacctacacacaccctctcatatacagaggttgttatatatatacaactagtgcctatatatacaatattccatttaatcttcacagtggcatgagatagatgattttttcttatttttcagatgagggaggtagagctcaaacaatttaaataatttggtagaaattagggtgatagagctctgactctagcttagtactattatacttcaaagccatctcaagtactatgatacactgctctaaatcactatgtcttactacagttgattctaaatgaccaagctgtttccaaaaaagaaattatcttcaaaagatgaatatttgcccatattgaagatctttaaaagtctggtaaaaaggtgtggaaactgttccttaagaaaacttgcccaaactgaagcttcgcaaggtgattattttgaaatgattctcagatacttaatatgtaaattctgattcatttatttttttttaatttttttatgctgggcacggtggctcatgcctgtaatcccagcactttgggaggtcgaggaccccggatcacgaggtcacgagttcgagaccagcgtggcaaacacggtgaaaccccatctctactaaaaatacaaaacattagccaggcgtggtggtgggcgcctgtaatcccagctactcaggaagctgaggcagtagaatcgcttgaacccgggaggcagaggttgcagtgagccgagattatgccaccgcacttcagcctggcaacagagcgaggcaaaactccgtctgaagaaaaaaaaaagggggggaagggtatagttatttcaccatgaagtatatttgtgttaggttttttgtagatagctttttatgagttgaggacttaatcttaagtttctagtttcctgagagttttctttcatgattgggtgttaaattttgtcagataccttttcttcctctgttttgagaggatcatacaatttttatattttattctcttaatatgatgaagtacattgatgtttccagtagtgaacgtactccttggtcatgcgatattatcttcttgaaatatatctggatatgttttgctaataacttgcttagtatttttacttgtatgttcatgaaggctactggcccatgactctgttgtgatgccttattctggtttcactgtctgggtattcttggccttataaaatagtttgggaaacattttcttctctagtttctgcttgtgtagcattggtattatttattcctttaatgtttaatagaatttaacaatgaagctctgtttttgtgtgtgtgtgctacatttaggattgttcttgatgctcttgataatttcttgatgaattggatgaattgacccttttatctttgtgtaatgtctttctttatgactgacaatattccttgtcccgaagtcaccttattctaatattaatatagccatcccatatttattattaatatttgcatatcttttttatccttttacttttatcgtctttatcttcagtgtgtttcctgtagatagcatatagttcagggtggccaatttttttctttccaaatcccaagaccttgtgaaaggagttgctgttttatccatctgtcagtctctgcattctaattggagtgattagaccgtttatttttaatgtaaatattaatatggttggtctggtttaaatctgtctagctacttttttatctatttgtttttctctttgttgcatctagtcttctccttcttttcttgccttattttgggtaaattgagtatttattttttatttttttattattatactttaagttctagggtacatgtgcacaatgtgcaggtttgttacatatgtatatgtgtgccatgttggtgtgctgcacccattaactcgtcatttagcattaggttaaattgagtacttattaagcattctattttatctcaatttttggatgattagctatacctctctgtttttaatttgttgctttagggtttacaacctgcaatcgttacctatcacagtctaccttcaaataattttattccatgtcacagatactgttttatcaggatagcttcatctccttctcttttctatgctgttgttatcacatattttactttattttttacttgtgttatgaaccccacaatatattgttactggtttttctttaagcagtcacttttcacattatttattttaattgtgataaaatacccataacataaaatttacaattttaacttttttttttttggtatggggtctcgctctgttgccaggctggagtgcatggcgcgatctcggcgcactgcaacttccgattccctggttcaagtgattcttctgcctcagcctcccgattacaggcgcctgccaccacacccagctaattttcgtattttcagtagagatgggatttcaccatgttggccaggctagtttccatctcctgacctcgtgatccgcctgcttcggcctcccgaagtgtggggattacaggcgtgagccaccgcgcccggcctaattttaacgatttgtaagtgtgcaattcagtggcatcaagtacattcacgttattgtgctaccatcaccaccatccatttatggaactcttcgttttgtacaactgaaactccttgcctattgagcaataactactcattcctcctcctcccagctcctggcaaccagcatgcttgtctctgtgaatttgactcctctgggtacctcatataagtggaatcatataatgtttgtgaagcttatttcacatagcatgatgttctcacagttccttcatgttttagggtatgtgagaatttcccttctttttaaagctgagtaatattccattgtatgtttgtaccacattttgcttatttgttcattgttgatgggcactttggttgctcctgccttttggctgttgcaaataatgccgttgtgaacaggatttacggttgtctcttaaatgcctgcttcatattcccagaagtggaattgctggatcatgtgataattctattgtaattttttgagaaattgtcatagagttttctgtagtggccacatcattttacattcccaccagtgatgctcaagggctccaatttgtctagcaatcatatttgaaagcaattaaaacatgagaaagaagtcttttatattcccccacatacttatcatttctgatctcttctttcttatagatttatgtttctatctagtatcatttactttctgtcatttcttgcagtgacaaattctcttagtttgtgtttgtctgaatctttattttgcctttatttttgaaggattttcctcctggatataaaattctagatcgacagcctcttttcttttagtaatttaaataagttgctccattatcttctagcttattcttatctttgttaatctctccatcattattgatagcttttaagattgttttccattgactggataataatgtgccttgatgtgattttctttgtatttatcctgcttagggttggttggcttcttggatttgtagacttataattttatgaaattcagaaagtgttcagccattatatcttcattttttttctgttacattctcttctcttttttaggaactccaaatatatgtatactagactacttgatattgtttaaaggccatggaggcggttccttttttctccctggtcttttttcctctctgtgcttcagtgtgggtagtttctgttgctgtgtctccaagtcactgatcttttcttcttcagcatctaatggcttttaattacatctgggtaagtttttatttcggaaattatattcttcatctcttaaagttgcatttagttttttaaaaaatatcttctctctctctctcttttttttttcttgagacagggtcttgtctctgtcctccaagctggaatataatggcgctatcagagctcactgcagcctcgacctcctgggctcaaaagattctcctaccacaccctcccttgtagttgggactataggcacacatcaccatgtctggctaatttttttatttttttagagacaggggtctctccatattgcttaggctggtctcaaactcctggcttcaaatgatcctcctgcatcatttgaatcccagcctcccaatgtgctgggattacaggcatgagccaccatccccggcctattttttcttttttctttttttttagatggggatttgctctgtcacccaggctggagtacaggggcatgatcttggttcattgcaccctccacctcccaggctcaaaagattctcctgcctcagcctcctgagtagctagaccacaggcatgtgccaccatgcccggctaaattttgtatttttggtagagactaggtctcactgtgttacccaggctggtctcgaattcctgagctcaggcagtccacctgcctcagccttccaaagtgctaggattataggcatgaggcaccatgcctgccctctggcctgtttttttctgtgtaaatatccagttgtttcagtgccatttgttgaaaagactatcctttccccattaaattacgttggtacctttattgaaaattgtgtgaatgttattggattccattccttttcattgatctttgtctatttttacaataatgctatagtggcttatgacatgaattatgaaagatctaatggatgattctgacatgttataaatatttcatttgaccttataatctacttttggaaaatgaattttgaaatacagtgttttcactaataggaatacagtgttatgttatctcatttaacagttgaatgaagagatttactttcaatgtacttgtcttacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggtacagttattaggggattttttgggagagaaattaatttaggggtgctgtagtttggattaaggaaaaatagtaggttttcttttcattttgttaaagtgtataaagtgacatttttagagatagactgggcatagtctttgacaagtgagtgactcttgtcaggaataagccaactaaactgagctagttaaatgctttttaaggtggttcatagttcagtgactaagaaaattatctgggtgtatgtgtatgtcttgagaaaattaatgattaataaatagtgcctcaacagtaactttgttaatgagaatgacatataccccaacatctgggtaagtttgatatgtgaggagaagaaactaatatttaatagatgtctatatgccagatatcttcattttcttttaaaaagaaagatcgtgtcctgcaccctttacataaattaatctttataacaaccctggaggtggaatctccattttatatatagggaaactgagggctgggtgcagcgtcttacgcttgtaatcccagcactttgggaggccaaggcaggcagattgcctgagcttgggaattcgaaaccagcctgggcaacatggcgaaaccctgtttctacaaaaatacaaaaattagccaggtgtggtggtgggcgcctgtaatcccagctacttgggaggctgaggccggagaatcacttgaacctgggaggcggaggttgcagtgagccgagatcgcatcattgcactccagcctgggtgacagaatgagactttgtctcaaagaaaaaagaaactgaggcgcaaagaggccaagtaacttatccaaaatcacatagataattggaagagccaaaaaatggatccaagattgtctagttgtaatgttgttgcccttgttggacctgaatcttaccccgtagttagaaaagtttccccaactttggtaagaattccctgggggcacttttgtacagagtattgccttccagggaaatcctgattcagtaggcctagattgggccccaaaatctggtttgaagaacccagatgatttctttttttttttttttttaattattgtgggtacgcagtaggtatatgtaacctaggtgatttctgttaagaaattttgggagacactgtcttagttgataagattataatctacttacgaatttttaaaactgtaaaatagatgcatctatagttattcatgatggcagtttatttctaatcgtggtttaggccagtttctttatccatttattttattttaattgtttttgaataagtaattacattctcatgggttcattgagtagatataaaaaggtatgcaatgataacattctgcctgtgtcaaccactaatcagcaagtgtgttctcagttttttgtgtatgtatgacagtttacatacacatacaattatggaaggacctcatttttttttaatttaatgtttttttttttttttttgagacagagtctctgttgcctaggctggagtgcggtggcacaatcttggctcactgaaacctctgcctcccaggttcaagttctcctgcctcagcctcccgagtagctaggattacaggtgcatgccaccatgcctggctaatttttgtatttttagtagaggtggggtttcacaatgttggcctggctgatctcgaactcctgacctcaggttatctgcccaccttggcctcccaaagtgctgggattacaggcatgagccaccggccagaaggatctcatttcttttcttcaatgaattatgaattctaaatgaggctattcaaatttaaaataatagatttcaaatttcaacacagtttttggcttgtaaggatatgggttggaatcatatttaaatctacttaataaaatcacttaccgtgttctaagaaaatcaaagttttttggatgggggttacccaaaaattcatatctttggatggggatgagatttggatgtttgaaggttgactgttagaagaaaagggtacaggtagagagtgccattatagattgattaacaagtttatcttgatcttgattttctgctttctaatcttctaatccataattataagccttgtaagtgtatttacttctttattttggaaacttctagaaaaatagatgttacatttgtgacgtttaaatatatggaatttgatgcctgacatattccttctgcctagttgagattatggcccaattcctcgtacagagaaactttgttatgctaagtgttattatataataagtgtaactgggtagaaggaatttatatgtagggactgattgatgcttgtatacctggattaatgtcttgactctgctccaggaaataaaatttttggctgcaacaaatggaactgtgggcccagattaaatgagtggtgtgccagcaaaatgctttgtaaggagtttgtgatggtttgtgaataatttgaaaataaatgcaagccttaagtaggttcaccaaggataaggcagatcaaataaacctcatttcacttttttaggtagggttattaaacatattttttcatcagaagtctcttagattctttgaaagcagtataatattagattgaaacgtataaaattgctgttttgtgggtcaaaatggaaacagtttttgaaaccataagttttactcaaagtatgtagtattaaggcttctgcttctggtcaagtggagaacaggtaacaaatttagtctcttacttgaaacaagcaagaaatagacaaaatatatgaaataatgaaaaaagtcattgaatatcaggcaatgaagggcagagatatccgagagaagggaagtaagtaaggtgagccctactgtcatccagcttatttccttgagaatattttcaggcttaatgcagggaggagaaactcaagcagagcctagtggactttttgagttgaggagataaagttgagatgctgggcaggccaaggtaactagaattcacgggacagtgtaccagaggggagagaacgtcatagaggcagaactgcagaaataacagaaggttcctttcaagtatgtagctgagtatttatcagtgtgtatatgttaggaaactacctgatgccagggaaagagccatctgacaaaatgagcggtaacagtgtctggtactcacacagggacaggagtagtacctcgtcccagcaaccagactgagaaaagccttataatttcttgaacaatggaaaaacagagaacttttactcagtagcagggaatacttagccacaaactgaacattgctttagtcctgcataacaaatcttaaaaacaaaaccttaaaaaaatatcaaactttttctaagtaacttatctgcatcccaaacaaagctcaagaatatgtatagggatatagacatatccagcaagatcaaattagcaatttcttgactgtaataataaattagcagctaggcaaggatggggggaaaaatgacctataatgaggaggtgaatcaatcagttaaaaccaatccagaattgacccagatgttagaattaacatcatctctactaaaaatacaaaaaattagccaggcatggtggcgtgtgtctatagtctcagctacttgggaggctgaggtggaaggattgcttgagcctagatggttgagacttcagtgagccatgatcatgccactgcactccagccagggtgacagagtgagaccttgtcttaaaaagagaaaataagaggctaggtaaaaaaaagaataggcagctcatgcctattatcccagctctttgggaggatgaggcaggagaatcacttgagcccaggagtttgaggctgcagtgcaccctgattgtgccactgcactccagcctgggtgacagagtgagagtccgtctcaaaaaataaaatagtagtacatataaagcatagtgagataaggctgccaaaaaactaatgcaagttttgcctaaagaaggtaatattgctcctgtactctatgagtacttcaaatgcagctaatatgatgaatgatttggaaaccatgtcatgagaacccaggagaactgtgaacatttcccttgtcaggagaagacttcatggcggcggctatggttgccttctgataattgaaggatccctagtggaataaggaacgaatttattgcagacattgtaagcaagaacaactggtaaatgttataggttagtacatacagtttctactcatgaaaaagaaataaccttataacagtagatagatcgagatgacttatagtaatgagcttccttccagtcactgaaggtattcaagcagtggcggtatacctgaaaaatacctttgttgggacagtggtttaattttattacttccaaagtccctcatgactcatgagatgatataattccttgacttttgccaatgagttctgttcctgctgtgactaactgaaaaggaacaacatgtaaagaaaacatagcacttggtgtcactgtcagaggaaagttaggatgcttgatgtgatgggaaggagttaatgcataccagggttttgcatggacaatctaaagagaagttgtgcgtgtgtgtacatccatacatatacacataggtcgcgtatataatgcctgtgtgtgtatgtggatatatgtgagtgtgtgtacataaatatgtatgtatatgtggatatatgtgtaataaataaatatacatgttataacttaggtctaatttctgccacatgtacattttcacttttggtgtagaatactatacttttctataaaatagtttttaccatattattttaagcaatcatttactattttttccattaactgtttataccgtctctagaaagagtgctgacctttgctttgacttcctgaccgcagtgctcttactcactgccatctcacttgcttctctgaagaacaggaaattgtcagaatgataccaatcattttaactcaatacaggtttaaccttttgtcacagtttgtgtacttattgaataatgctatattcacaaaatttctctgtcttaggtacctattttgtcacctaagcaaagactaataagaaaatattacaggaataatttttattatggggaaatttggtaccctagaatataatttccccagtttttttttagtaagcagacttttattaagcataaattggtcttgtgtttttctccttaaaattgaggatggaaggggaatggaaattgcttataaaaggggcaaatttgacactgctgtgtatctgtatatagtcttctggttttaactttttaaaaatcttcctcattcatttcttcttgattaatatttattttctttttgaacaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaaggtgagggctgcaagtgttttctaagggttgaaacatcagaataaaggtatggtggcaagtcctccttctgctaggctggctggcaaggccctatgtcttgacctaggtggtagttacaagggtatttatttgccttataataattcactaaactatgtatttgagtagatttttatgtgtgtgctttaatttacaataaaaaagttaaaaagaaacatgcatctgccatccctgtccttgactgcgctgccccaactgtcatctccttccctctaagacgaacccaccatcctgactgttaaatacttccttatgtttctttatatgtttatcatccagatgggcattccaagacactataccaagactaaggtcttgtccatttataaaaatctattatttccattaagtctcttaatgtacaggtttctctctatccctttcctttcttcaacactgatctgttgaaagaacctgggccatttgacctgtagttggtcatagctggggttttgctaattggactcatgttcctcatacttctttatttactggaaattggcagctggctccagaagaatgatcagattccggtttgattcctttgacaaaactataggtcagtgctgtgttctcttctcagtagccatttaatattagtaggcatgtactatgtgtttctttttgcagccattggtccacattacccctctgttgctttttgtttcttgttatcagtattgcaggactctggcttttgatgttttgtttctacttgcatgtattttgatgtttgggaagatattttatcacctagttttgttgcagattttgtctgtgagtttttaattttgctgcataattgtcgtttctgtttttatgtgggaatgggtaaactgaaaaatcagcttttgctgccgggcgaggtggctcacgcctgtaaccccagcactttgggaggccgaggcgggtggatcatgagttcaggagttcgagaccagcctgaccaacatggtgaaaccccgtctctactaaaaatacaaaaaattagctgggagaggtggcgggcgtctgtaatcccagctacttgggaggcggaggcaggagaatcatttgaacccaggaggcggaggttgcagtgagccaagattacaccactgcactctagcctgggtgacagagcgagactgcgtctcaaaaaaaaaataaaataaaaaaaataaaaagcttttgcagtttgcagtcttctcaagatgttttctttctttctttcttattttttttttttgaggcggagtctcgctctgttgcccaggctggagtgcagtggcgcaatctcggcttaccgcaatctccgcctctcctgcctcagcctcctgagtagctgggactacaggctgcgccaccatgcctggctaatttttgtatttttagtagagacggagtttcactatgttggccagactagtctcgaactcctgacctcgtgatccacccgcctcggcctcccaaagtgctgggattacaggcgtgagccacagcacctggccaagacattttctttagtttacgaagcccctttcagtttttggttctttgtgtcttcaaatttgggttgatttagaatgtttataaaagttagtagcactggggccaggtgcagtgtatcacacctgtaatcccagcactttgggaggccgaggcaggcggatcagttgaggtcaggagttcgaaaccagcctagacaacatggtgaaaccctgtctctactaaaaatataaaaattagccaggtgtggtggtatgcacctgcaatcccagctacttgggaggctgaggcacgggaatcacttgaacctgggaggcggaggtttcagtgagctgagatcgcgccactgcagtccagcctgggagacagagcaagactgtctcaaaaaaaaaaaaaaaagttagtagcactgttactaaaaaccgacagatgggaagtttttaatactacatttgttaccgtcatacctttcatgacgagaaaattaaaaatgttcaattatattacctttgttcatccaaccttgttttctgtttctattaaaggtacctcttagcataaataaagtttgaaaaagttcctctcctgagagaactggattctgatattctgtctttttatctgaatgctcttttatgggtgtgtttcatatggaaatttatcgagttttgcacttacgatatgttcacttttctgagtgatgcttcaaaaataagtttacattaaatttttaagagcagccccaaatttgagtacaatgagattcattaagaagtcatgtttggccaggcgtagtggctcacgcctgtaatcccaacactttgggaaactgaggtgggtggatcacgaggtcaggagttcaagaccatcctggccaagatggtgaaacccgatctctactaaaaatacaaaaattagctgggtgcaatggcaggcacctgtaatcccagctactctggaggctgaggcaggagaatcgcttgaacccaggaggtggaggttgcagtgagccgagattgcaccacagcactccagcctgggtgacagagtgagactctgtctcaaaaaaaaaaaaaaaaaaaaaaaagaagtcatgttcaacttttgcaatacttttgtgattttctaatttcttaggcattcacataaaaaaggatgctaaaataacagaatgtgatagatgggtccagatcatatacataatgtattaaaatgtttgacaacttctgtctattgaggtttaatacaagcctagctttcagtccaaatacaggttttctgacatcattttctaccacttttctcagagttcccgattttgaaatgctgggctcactcagaagtggcagccccttgtgctttggagaatgaggatatctgccaatggaacaagatgaagtataaatcagtaagctaatgttttatgttgttttttagatcatgtgcctcatttaaagctctttctgtaatgttcctgccacatttaagagattagcatttttttttttttttaggcggagtctcgctctgtcacccaggctggagtgcagtggcacaatctcggctcactgcagcctccgcctaccaggttcaagtgattctcctgcctcagcctcccaagtagctgggattctaggtgcccgccaccacacccagctaatttttgtagttttggtagaggcagggtttcaccctgttggccaggctggtctcaaactcctgactttaggtgatccgcctatcttggcctcccagagtgctgggattacaggcatgagccaccgtgcccagctgggattagcattttctaatatagaaagctgttttttcttacagcaaagggttactacaaagcactgctgttttttgttggggaactttcattgaacatacagttgggaagatggatgactctgcaatcttatgcagtgtagagttgtttttgagtaggttgccattgccatatggtacctgaaaatttttctcaaactctaaaatacatctggagacctgcatttgattgattatgtcaatgaagagtatgcttagtgtttatgatttattgatttagcaaattagtgtgtattgctacaagataagtagtgacccttttaaaacattttgaattcagttgtccttatttatttatttatttattttgagacagagtctcgctctgttgcccaggctggagtgcagtggtgcaatcttggctcactgcaacctccgcctccctgttcaatcagttctcctgtctcagcctcccgagtagctgggactataggcgcctgccaccatgcccggctaatttttgtatttttagtagagacggggtttcaccttgttggtcaggctggtctcaaactcctgacttcaggtgatccacccccgtcagcctcccaaagtgctgggattacaggcgtgagccaccacacctgacttcagttgcctttaaaattctgtaacttgccataagaggtcataataatttaacactttaaatatagcttttaactatatgtatatattatttatatatatatatatatatatatatatatatatatatatattttattttattttatttttttttttattttatttttttttttgagacggagtctcgctctgttgcccaggctggagtgcagtggcacgatctcggctcaccacaacctccgcctcccgggttcaagtcattctcctgcctcagcctcctgagtagctgggactataggcacgtgccaccatgcctggataatttttgtatttttagtagagacagggtttcactgtgttggccaggctggtctcaaactcctgacctcatgatccgcctgcctcagcctcccaaagtgctgggattacaggcatgagccactgcacccggccaactttatatatatttcatcttcatatataccagaaaaataggtggccattactaaggtggtattccatcccaaggattgttgaagatgtcatttttttgaatgacggttttcagatagcactttgttgcagattgggttggttacttgtattttttggggtgtgaaatcataattcaggtatttacaaaaagaaaaagtattcccaagttacgtacattttaatgttttttaaaacttatttttaaagtataaactttcccagtgtttttcattgaactttatcttcaaaaccaaatagaaaatagaaactgagttgaatgtaggagcttttccattgctagtcatagtaaaggccacatccagctgtacaatatgggaataacaaggctttaaaagctatctggggagagaaaggcaaatgggaatgaaagaataatttagttttttgttgttttaatgtttttcctctaagtcttcaatttagagagaattctgtattctaatttgaaacatggtaagaggaagtaaatgtttatattgattacagaggtgacactgggatatagcttttcttaaaataatatactttatgtaaaaagcagaaaaatcagaactaatgagatttaacaaattattgtgggaattgagtctgattctgtaacattaaatgaaatgttagattcaaaagtcattcaaaccaataatattacatgtagtgtagcactggctgaaatatatttaaaagaaaaaggaaataaaaatatccaattaaaaatcaaagaaatagtggtctcaccttatgacatttattttattttactatttttatttatttatttatttatttgagacagagtcttcctctgtctcccaggctggagtacagtggcacgatctcagctcactgcaaacctccgcctcccgggttcaagtgattgttctgtcttagcctccctagtagctgggactacaggcacctgccaccacacctggctaatttttgtatttttagtagagatggtttagtagagatgttggccaggctggttttgaactcctgacctcaagcgatctgcccgccttggcctcccgaagtgctgggattacaggcatgagctaccacaccgggcccatgacatgcattttcaatgtctaacttctctctctctctccataggtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactacagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaataattggaatcatcaggtaatttttttaaacaaaggttcttcatttactgttatgattggaaaaaaattagaaaataaagtaagtgccataggctaattaaaaaataaaaccttggccgggcgcggtggcttacgcctataatcccagcactttgggaggccgagacgggcagatcacgaggtcaggagattgagaccatcctggctaacacggtgaaaccccatctctactaaaaatacaaaaaaatgagccgggtatggtggtgcatacctgtagtcccagctactcgggaggctgaggcaggagaatggcatgaacccggaaggcagagcttgcagtgagccgagatcacgccactgcactccagcctgggcgacagagtgagactctgtctcaaaaaaaaaaaaaaaaaaaaaaaaaaaaaagtaaataaaaccttagggcaagcatgttccaaaacagaagacatcaaaccagggtgtgttggcattatttattttatgtagagtattgagatgtgataaacctttgtatatgccatcactgctccatttcctaaagtattttggtgttttcatgggactacatcttgtataatttgacatgtatgacctgactagtcctaacagttctttttaaacgtgtatttgagacttaaatattggaaaaggtaacccagtgccataaagcagaaacagtgacctttaaaatgactaaaatttcaacccagtatagtttcatacctatttcatgctttctcgtaagaaagaatttcatgttttagaaacatttctttcactatgggattaataatatgacactgaaatggaattatatatgtcagctacaattcaggcattgttttgggatatggttagattgacaggcaacgttttggaatatggttagacggggagggaacacggtactgtttaacatcttaagagtatgtgggggtatgtgtatacagaatgtttttgtttttgctcatcacaaccaggtttcatcagtatttaaaatatttaagattgtggcttggaatgtggttcagccatttactcacttatacaaatattcagaagtgtaataaaaatgtgaatgaagaaaactttgatataactcttcttgcttagataaatggttgcagatgacatcacttttagtataacagaacatttctggttttgtttgtattatcttgtaaacatggccaacatggtgaaaccccatctctactaaaaatacaaaaaattagccgggagtggtggcatgcggctgtaatcccagctactcgggaggccgaggcaggagaatcacttgaacccgggaggcagaggttgcagtgagccgagatcgtaccactgcaccccagcctgggcgacagagtgagactccgtcacaaaaaaaaaaaaaaaagggaaagaaaaagaaagaaatataccttttaaggagttcctttagtgtgtctctgttggtagcttgtttatgtttgatgatatatttatttcatcctcactcatctgatggataatttaggtagttgtacacttttttttttttttttttttttgagacagagtcttgctctgtcgtccaggctggagtgcagtggtgtgatccctgctcactgcaacctctgcttcctgggttcaagtgattctcctgcctcagcctaccaagtagctgggactacaggcgcacaccaccacaccctgctattttttatatttttagcagagacagggttttgccgttgttggccaggctggtcttgaactcctgatctcaggtgatctgcccacctcagcctcctaaagtgctgggattacaggtgtgagccactgtgcccagccggtagctgtacacttctaagcttggttattttctcttggtactttgaaaatataccattattgactggcacccgttttgctgttgtgaaatctgctatgaatgtaatagttgtttgtacagaatgtcttttctctctggttgctttatctctggtattctgcggtttcattttcatgtgtttgaaatttctttacttatcctgcttggtattcagtttgcttcctgaatctgaagattcctgtctttaatcaattctggaaatttttcagccattatctcatcattatctgcctctcttggtttttctcttttctctcctggaattctcattaggagtatggtagagaccttaacaatctatccccatgtctcttaagcttgctttcatttttcctgtctctaggctgttctcagtaatttcttttggtctgtcttccagtttactaattttctcttcaattgtgtgtaatctgctatttaaccaaacattggctttggtttcagttattctttgtttctagaaattctacttaattcttttgttgttgttgtttttgttttgagacggagttttgctcttgttgcccaggctggagtgcaatggcatgttcttggcttactgcaacctccacctcccaggttcaagtgattctcctgcctcagcctcctgagtaggtgggactacaggtgcccaccaccacgcctggctaatttttgcatttttagtagagactggggtttcaccatgttggccaggctggtctcgaactcctgacctcgggtgatctgcccacctcggcctcccaaactgctgggattacaggtgtgagccaccgcgcctggcctacttatttcattttcaaagctgtttggtcgttaaaaaaaaaaagcatcttgtttcttgctcgtgttttctagctcctgtcttactttctttaatcatttaaataggcgtactgtatattctgtagccatcaattccagcagctaaagtctgtgtgggtttcattatgttctttgtagtttctattgactcactcatcgctgcttatttcctcaggtgtattgtatttcgggtgctcatgtttggcttcggaaatcctgtttatctgtgaaatcctttgagaccgaggttgagggtacacctgtgcagtcaggatttgtatttgtttcttccaggccccccagaactccagcctgggaccactttcttgacaaatttgaactttaaaaccttagtgagggaaaattctaaagggttattaattctaaagggaaaattttcttctgccctgcaagcccactgcaggccaaagtaaacaaatgtcctgtgtgtctccctgggctagcatagggttttttttccccccagtctgttcttggagggtatagcgccttgaatttccagtcctatgcaggatcacagtcctgacttcttgtataggcccaagtccttgtctttagtttcctgtgcacctattaaaactctagagatttctgagataagtaggtgccctcaacacaaccatggcttcactgccctgcttaccactctggtgtcctgccccttcttcaggttgagtgtgaaatttggaagactgtcagaaacattctattttcattcttgcaagttatgcctttgaaaggatgtcttatttatccagtgtttctgtgtgtttaataatcagagcatttttcaggttatctcttactgtgccatgttgctccttgattcctttctctcctgtacccactgcatcaattgagttttttgctctacattgatagagaagcacaattcctctttctttccactgccttcctactttatttcccttctattcttgcatctctatactccattatccacattgcagtctagtgatcttaaagtgtaagccaggtaacatcgctttcctgcttaaaaaagccttttaatggttttttgtaatatagactttttaccatggcattcaggatctttcatgacctgaatcttgtctgctgtagtgttttcttaatagtaccgccttcttgttctaggccccagctacacaggccttcttaactgaccgtagcaagcccttttctttcttctcctgcctgtattgcttttctctgggtgcttcttattgctgtctctttctgttcttgccttaagtgtcacctccttaacgaggccttctccgaccaccctatccaaagtaacctcgccaagttttttcttataccaggtgtgactactttaattactgcgtcctcatataagctccacaaaggcttggtgaatcgtgttcacccttgcatttcttttgtgttttttgttttgtttttgaggcatgacgactctgtcacgctgaagtgcagtggcccgatcttggctcactgcagcctcctcctcctgggttcaagcgattctcctgccttagtctcccgagtagctgggactacagatgcgtgccaccatgcccagctaatttttgtatttttagtagaaacggggtttcatcgtgttggccaggctggtctcgaactcccgacctcaggtgatccgcctgcctcagcctcccaaagtgctgggattacaggcgtgagccaccgcacctgaaccacccttgtatttctgatgcttaacagtgtctagtccatatcagacactcaaatatttgtagaataagtgaaacattgatgaactcctccgtggataaaatagggaagtcttaatttgcaaggaggtgatacttaatttagcagcaaaattttagttaagaatttgtaagcaaaaaagcaaaatggataacggatgaattcccagaaacaaatgtcgcggagcagatgtgtataacagcaatcgtctgtcagcgtcttccgtcggcagagacctgcttggagacaatgctgaattaaatgagggactggctgctcctctcaatacaaagactacccaaggaataaaagcaacgtctatcaccgaactactactcccagcggcccccgcgcgggcctgcccatgggaggtggcgctcgtctccgccccggggagctccggcttcggggcgggaggggttctgggttctggccccgccccgccccgctccccgccgtcttcctcccccagggttgtggccacgcgcagcggcggcggttgttccgcttcccctccggcccgggccgtcgccattgccgaaggctccctcccctcccctccctggcgtgcgcaggactccgccgccgctgggcctagcggtagcagcggctgctccagcgcggcgtctcttcccgccccgcttccccttccctcccctcccctccccgcaccgcgcgctagcccggggcggctccgcagcccgccgggagctctgaccgaggcgcctcgctggggcggggaccttgccttgcccggggtaagtgcacacaggccggccggcgcgggacgcaggccgggtctcttcctcctccttccttctccgtggcctggcgggcgggagcggcccgggacggccgacctgccccgcgcggggccggggagccgccacctgcgtgctgggagccgcagctcctggggcggtggctcattgtctgctccccagggccgttttcttcgctggctttagccagaaatgggaagctcgctgggctgcggaggtctgactcttcctggacccagccctgctctgaacctcgcggcaccacggtctctgccgactctcggtcttccctcccctcgcgtttcaccctcttcctttgctccgttttcttaatgctggaccagactctccggttttgttccttgatttttcctctcactgattctcagcccctgcttgctcgctctctgttcacccgtttcactgctcaggaatattgtcgcgagtagcttgactgttttctcagctccagcctgtaacctcttttccacattccacattggtaaaaacgtagagcgtcccgggcgcttgagggccaccgcttacgaactgatctttcggagcttctcctcgctcctgtttgagcttcagcctaggggtgaaatttgcttctttagataacttaggtgaagttaagattggtttttcaccatgtttggctctcttggaaacacacgcacgcacaaacacaaaacgttgccactcaaccttttaactaattctttaaagataagtcatccaagaacagaagcgtgtcatcgtcagtgggtgtgaggttgtacccatccttgtatcttaattttagtagtactctccctgggcagtgtgagcgtgatttgttgtcccttgataaataacgaactccggttgatatcattatctcacttctgcgttacaggcgatgtgtcctttctttgttttcttttttaacctttataaaaagacaaaatggttaggcctaaaattaaactacgaagagctgtgttttggatcaaggttgtgcacgtcacgttttttcccctgctgtgttcgactcttccgctcttataagtaggcaggatattgaaatgtacaagaatttgctctggggattttgtttttgtagggttgtccaatagaataacactcagtaaagttacattgggatgaaggcagtgaatagtaatttttaaagcaggttaaaacttgtcaactttgccagaaggtctgtggcttctgtaaagcccactcatgctcgtgtatatatgaagagcctttttcatgttctgttaggagtatggatttcaggcaactttttcactgtgtcatcctcggctattaaatctttcgagctacttattagccaagcacattgattgacacttattacggaaagtgaacctgtaatagatgtaggtcttaaaccaactttccgatttggtaacaggttgacctaaattcagtgtattttgtgttttcactaagtagcccattgttacctttccctccagcaaggctctgaaaaaagtggctccaatactcagcttcaatactgtcatcatttcttaaatagtagtatcagttgtccttaacttaatggatgttttattggcctgagggattaaggtgtagaaaggttggagttttgttggagtttgaaacttggtctgtagatgttggcttctctgccagtttcttctaatcagcagatatttttatgaaggaagagttcctgggtatttcacttcccttagggccttggtttatggtttactctcattcagagagagatactattctggactccgtgctatttaatactaaccttgcaaacccaaattcaaaattaagtttatagttcgagtatacaggcgatagggctctctgatctttatgatagacaggttcccaagtagatgcggttaacaattaatatttcttttttttttttttttttgagacggagtttcagttgcccaggctggagtgcaatggtgcgatcaccgcaacctccgcctcctgggttcaagcgattctcctgtctcagcctgctgagtagctgggattacaggcacgcgccaccacgcgcggctaattttgtatttttagtagagatggggtttcaccgtgttggttaggctggtctcgaactcccgacctcaggtcatctgcccgcctcagcctcccaaaatgctgggataggcgtgagccacggcacaccaccaacagtttctatttcaattatactttttaagagagactagaacttgttcaggtagctaaagataaactttcaattatacttttctaatatttaagaacttcaagtagccaaggataaaatgagtaggaattgttagattcttccttttatccatcaaaatcgattattattataataatatttgagtatatttcttttggctttctgacttttacacttttggttaaaatttgaaactgggtcttcttcgccgggcgcggtggctcacgcctgtaatcccagcactttgggaggccgaggcgggcggatcacgaggtcaggagatcaagaccatcctggctaacacagtgaaaccccgtctctactaaaaatacaacaaaaaattagccgggcttggtggcaggcgcctgtagtcccagctactcgggaggctgaggccggagaatggcgtgatgaacccgggaggcggagcttgcagtgagtcgagatcgcgccactgcactcccgcctgggctacagagcgagactccgtctcattaaaaaagaaaaagaaaaagaaactgggtcaacttcaagactttaagtcgtaaaggtttccatcagtttggtataagagttgagtttccagactaatcagagggagggtgttaattgcaaattgtgtgtccaagctcttcctagtatcctttttgtgccttaacagagcagaataggaaaggaaaaaaatccctcattgcccccaaaaaataaaatactggttgttttcttctgtgatcagagttgagtttcatcacttcttcccttctagggtcacctgcctggttaagggtagtcagtctgaacattcattcaggatttcagtgttccagcctactatctctgagtttctttagtacttactccatgtatcccatgtggttaggagctagagtcctgcgtttgaattcttgctgttctactttaccctgggcaagatatacattcttttcaagacttgcttttctcacctgtaagatggggataataataataataccaatttcacagggatatttagatcaaatgagggaatgcaggtaaaggattctgtaattataggtcttaataaacgttagttaatagtctgttcttacatgctgtagagtcgatactcctaaacttagaattaaaactgccttctaggccgggtgcggtggctcacacctgtaatcacaacacattaggaggctgaggtgggccgatcacttgaggtcaggagttcaagaccagcctggccaacatggtgaaacctatattctctactattctttagtagagaatttagtattctctactaaaaataaaaatattagctgggcgtggtggcgggcgcctgtaatcccagctactcaggaggctgaggcaggagaactgcttgaacccaggaggcagaggctgcagtgagctgagattgcgccactgcacttcagcctgggtgacagagtgagactccgtctcaaaaacaaacaaacaaacaaacaaaaaactgccttctaaaagaacgaagtttctgagaccgtaactaaaaataaaaattacttttggatgaataaaatgtaatttttcaggagaaaaaatatgtaatagtttcaccactgaaataaaacatagggtttttgaacacaaatttctcagatttaaaaatatgcatatttcctgtataaaagttgaaaagtgggcagtggctggtggtgcctgtagtcctagctacttgggaggctgaggatcctttgagtccaggaatttgaggtcagccaggacaatacagggggaccccatctcttaaatcagacaaaaataaaagtagaaaaaaatattaaataagaaatttggaaagtggtaaaaacttttaagacaaaattaccttagtctcagctggcagaaccattgtaacaaactggaacagtggttttgttccttattttaaatttaaattctaaaagcagtacatatttattataaaaggttcaaacaagtcaattaaatatttaaagagtgaaaattctttgggagactgaggcaggaggatcacctgagctcaagagttggaggtatagtgagctatgattgcaccattgcattccagcctgggtgacagagcaagaccctgtcttataaaattcttaaaaagtgaaaattactttctctttttagtcccattccttagaagtacctacccgctgttaatagttttacttactgagttagaaataagtagtaccttttgtgtgtcggatactttttatgttgattttaaaataaaaaatctgatcattaagtattgttttccatatcatgacatatagtggcacctctactttttaagtcattagatattatgctgtatggtagtactttaattatttgtgatcatttatgttatttctaactttgagcaactaaaactagagccttaatgaacttatacgtatgtctttgtgcacatgcatatgtagataagtatttccattaaaacgacttgtaagtgtgcatttaaatttcttttttcttttttttttgaattgcattccaaaaagacttgtaatgtatatttccttattgagttgtagaagctcttcacatgtaatagatattaatctattgccttctgtttaagatcttcctcattccacctttacaaaaaacattcttatgtgttttcttctggtacttttaataattattgtgtttcaatcttttttttttttttgtgacagagtctcactctgtcactcaggctggagtgcagtgttggatctcagctcactgcaacttccgcctcccgggttcaagtgattcccctgcctcagcctcccgagtagctgggattacaggcaccataccatcgcacccaactgattttttttttttttttttttttgtagagacggggttttgctatgttggccaggctggtctcaaactcctgacctcaggtgatctgcctgccttggcttcccgaagtgttgggattacaggcgtgagccaccgtgcccagcccattgtgtttcaatcttaatctttctggaattttttcatgcctggtggggataaaagagttttaaaatagttttgctacagaaataaaatacaggtataaaaatatttggccgggtgcagtggcttacgcctgtaatcccagcactttgggaggcctaggtgggtggatcacctgatgtcagcagttggaaacagcctaaccaacgtggtgaaaccttgtgtctactgaaaacacaaaaaattagctgggtgtggtggtgcacacctgtagttccagctactccggaggctgaggcaggagaattgtctgagcccgggaggcggaggttgcaatgacctgagatcaagccactgcactccagcctgggcaacagaacgagactccatctctaagtaaaaaaaaaaaaagaagaagtagtaactagatttttctgttcattggtatttttattatcttactggacttcagtaaacgtctttattttgttttccaggttcattgttttatctgagaataatagtaacttcagtcacttttctatggttacaatatttaaccttttttttttttctttttctttcttttttaaagacggggtttcaccgtattagccaggatggtctcgatctcctgacctcgtgatccgcctgcctcagcctcccaaagtgttggacaggcatgagccaccgtgcccagcccttaaccctgttttaggtctttattacattggcctgaagttccaagacttggttaaacaagagacgtgtcgttgtcttgaaatgactctggtattaatatttttacagttagggatgatggcagctgttggatttagagaaagattattattttattctgtttctgctttacaaaaaataggaatggcttctgaattttatgagatgctattgtaacatttagatgatgatatggttttcttcttttaactattgctgaggatatgtaatagtaaatttgctattaatcaaaggtatcacaaggtatatatcgtgaataaccaaaatcccactcatattagtcctgcgtacggaatttattgaaaggttagaggagaatctcatataaatttagattaataagaataggccgggcacagtggctcatgcctgttatcccagcactttgggaggccgaggcaggtggatcagctgaggtttggagtttgagaccagcctgaccaacatggagaaacctgtgtctactaaaaatagaaaattagccaggtgtggtggcaggtgcctgtagtcccagctactcgggaggctgaggcaggagaatcgcttgaacccgggaggcggaggttgcagtgagccgagatcgtgccattgcactccagcctgggcaacaaaagtgaaactctgtctcattaaaaaaaaaaaaaaaaaggataggcctttatgataacttctgtagttaacttctataacctattcaggaatccttattcatgagtcacttttgataattcgtatttcctagatcatttcttttagattttcaaatctgttactatataggtgtgtataatcttttgtcattaagatctgtggtattcatttccttttttttattagtgatttcactatttttctgaatttgccaaatgtttgtctacttagtggttttttttactaaccagctttgagatttacttattgtattggtttttttttgtttgttttctgaatgcctgatttctacttttctctttattttgctctcctgctttttttttttgttgttaacaatgttaacattaagttaatgttaatgttattaattcttaatgaattcttagttcctttaatgtgttttcgatgagcggtaatcgctcctcggatagacctcattggctacgataccgccactgtgcaaagctagttcattttaatgtcttttaataataaaaacctttaatgttcttaatttgcttttgaatgcagcgttggctgcacattctaatttacatggacaatgttcttctgctcagtattttccaaatagctggtggttctagttttgatttcctctttgactcaggaggtatttaggataattctattcactcatattttctttcattgttgtcagcttctataatcttttaaaatatcttttaaacttattgagtgtttcttgtgacttaaaacataatccattttggaaaatgttctatgaaaacttagaacattttctgttggtaatatacagagttttatacataacctattgattaaatttaatgactaagattatttgtatgaattaccagtttttataaatagttcttactaaatataggacttagtctttattagtcctagtaagaactatagtcgttattaataattcttattaatgtaaaaatcttcctaatctgccaaagacaaagaggtagcattgtttctgagaagcttgttctcacgttgggacctttagatttttatttcttctgcctgaatgtcactgaggccatatttgaaagagatctttcatgatcacctctgcctacccccactccgcatctaacttcctgcccttcagtgtgtttattttcctttatagcacttccatctgaagtttctttttcatttatttggttttctttaatatactattctgttttacagagctttgaacaaataggtatgaaataagtatgtgttggttgagtgtcactctcttatttctaatgatttttagaaatttttattcattttaattaatagactttgcagcattttaggttcacagcaaaactgagcctaaggtacagagttcccatataccccatgctcctcatgcccctcttctccaagcctcctgctcatcaacatcctgcatcactgtggtatatttggcacagtcagtgaaccagcattcacacatcatcactgcccaaagcccacagtttacgttagggtttgctcgtatggtattgtacattcagtgggttttgacaaatgtataacaacatgtctccaccagtatcataccgactggtttccgcaccttaaaactctctgctccacctgttcctcccacttttactgcaacccctggcaaccgctgatccttttactacctccatcgcaatgccttttccagaatgtcccgtagttggaattatatagcgtgtagccttttcaacttggcttctttcacttagcagtatgcatctgaggttcttccgtgtcttttcatggcttgatagctcatttcattttagcactgaataatattccattgtctggatgtacattcacctattgaaggaccaggtttggtgattatgaataaagctgctgtaaacattgatgtgtggagttttttattgtggtgtaaaatacatgtaacagaacttaccatcttaaccattttgaagtatacagttcagtggtactaaatacatttatagtgtgcaattatcaccaccatccatctccgaaactttccatcctgcaaaactgaaattctatacccattgaaccataactcctcattctcctttctgtctgcatgattttggctactcttatgtaccttatgtaagtggaatcatattttgtgtttttgtgacttatttcacttatcctcaagcttcatctgtgttgtagcatgtcagaagttcttttcttttttttttgggtgaatagtattcccatgtgtgtatttaccttattctgcttgtccatttattcatcagtagacacttggattgcttccgtaatttaggtactgagattaatgctactacgaacatgggtgtacaaatacctctttgagaccttgttttcagttatttcgggtacatacccagaatggaattgctgggtcatatgataattctgtgtttcattttttgaggaactaccgtattgctttccacagcgcctgtatcacttcacgtttccaccagcagcgcacagcagttcagtttctctacatcctttttaacacaaccgttgttgtttttaatagtagccatcctaatgggtattaggtggtatcatgttagttttgatttgcatttctctagcagttagtgatgttgagcattttttcatgtacttattgaccatttgtatatcttctttgaaaaaatgtctattcaagtgctcatgtgtaggttttcgggtggacataagttttcagctgatttgggtgaataccaaggagcatgatggctggagtgtatggtaagaatgtatttcattttgtaagaaactgttcaactttcttccaaagtggctgtaccattttgcattcccaccagcaatggatgtgggggttcctgttgcttcacatcttttccagcatgtcatgttatcattgttttggattttacccattccaataggtagtagtgtttcattgttttctgttttttttttgagatagagtcttgctctgttgcctgggctggaatgtagtggcacgatgagaactcactgcagcctcgagctcctaggctgaagcgatcttctcacctcagcctccagagtagccaggactacagatacgctaccttacctggctatttcttttttttttttttgaaacagagtttcgctcttgtcgcccaggctgtggtgcaatggcatgatctgggctcactgcaacctccgcctcctgggttcaagtaattctcatgccttagcctcccaaatagctgggattataggcgcctgccaccacgcctggctaattttttgtattttttttgtagagatgggatttcaccatattggccaggttggtctcgaactcctgagctcaggtgatccatccacctctgcctcccaaagtgctgggattacaggcgtgagccaccgtgcctggcctatacctggctaatttttaaaatctttttgtagagacggttcactctgttgcgcaggctggtagatacttcttttgcagatattttttttctaagtctgtggtttaagttctcattctcccaactctgatgatttctgtcatgttttgattcagtattatttggtacgtgtgtaaattctacactgctcaagatcttcattatgaattgtacctcatccatgaaaatgattgtcctgtacgatcatgatttaacatttttgcatcttatattttgcttgtcttaaattcctgttgtactttgttttttgttcaataaattattcaacattatctttccttgctgttttttgttgtgtctttttaaaattgcgtgtagtttatttttgctttattccaaagtgaatgcttaaaacatattaatgcttaaagcattaaaaatgaatgcttaaaacctaaaataaagtttaaaaaaaaaaaaaaccaaaacatgtttattataataaatgctttctggtatgtttctgttattttatttaatgctttctgttttttaatgattaattgttgctttttttaattgttgtaaaatacatgtaacataaaattaccatcttaaacgttcttaagtgtacagttctttggcattaagtactcacgttgtggtacaactttccctaccatctgtcttcagaatttttttcatcttccccaactgaaactcggtactcattaaacattaactcctcattccctacctccagcccccagtagcctatctctaatctgttttctgtctcaatgaacttgcctcttctggatatttcttataactggaatcgtgcaatgtttgtccttttgtgtctcgctcattatttcatgtagcgcagtattttcagggtttatccattttgtagcatatagtataggttgagcatcgctaatctgaaaatccaaaatccgaaatgctccaaattccagcactttctgagtgctgacatgacatcacaagtggaaaattccatatgtaagtacttaatgcaaaccatgtttcgtgcacaaaattatttaaaatattggccaagcatagtggctcactcctgtaatcctagcactttgggagggcaaggtgggtagattgcttgaggccaggaattcaagaccagcctggccaacatgctaaaaccccgtctctactaaaaatagaaaaattagccagcgtggtggcacgcacctgtaatcccagctactcgggaggctgaggcatgagaatctcttgagcccagagggcggaggttgcagtgagcccagatcacaccactgcagtccagcctgggtgacagagcaagactgtccccccaaaaaacacacaaatttatttatatacatatatatatatatatatataattcaggctatatataaaaggcatttatgaaacacaaatgaatttcttttttttttttttttttttgagaccgtttcactcttgttgcccaggttggagtacaatggcgcagtctcagctcactgcaacctcctcctcccaggttcaagtgattctcctgcctcagtctcctgagtagctgggattacaggcgcatgccaccactctcagctaatttttgtattttgagtagagataggatttcaccatgttggccaggctggtcttgaactcttgacctcaggtgttctgcctgcctcggcctcccaaagtgctgggattacaggtgtgagccaccacacccagccacaagtgaatttcatatttagatttgggtctcatccccaacatatctcattatgtgtatgcaaatattccagtattagaactctgagacagttctagccccaagcattttgcattttggataagggatactcaacctgtagtacttaattcctttttaagggtgagtaatactccattctatgtattataccacttttgtttatctgttcacctatcaatgttttctttttttgctttgtaaattgtatttggtttgcttttatctcagatatttggaatgtatacatcctgtttttaaagtatattagcttaagtgaattcaagtctaaatctaaattgaaaaaaaattttctgatctgtaagcctgaaaaagaaaattgttttgactcttcctatatctgaagattataagatttttttctcttaaccctttctcactttatcctcctttcacctccgtggtgagcttgggacacagaatattgttaatgtattttttgtatatttcatgtttctaattccatcttcttttggtaattttgttttatttatttgtttgtttgtttgtttgtttgagacagagtttcactctgttgcccaggctggagtgcaatggcgcaatctcagctcactgcaagcacctcttccctggttcaagcaattttcctgacctcagcctcccgaatagctgggattacaggcgtgtaccaccacgcctggctaatttttatatttttagtagagacagggttttgtcgtgttggtctcaaactcctggcctcaagtgatccgtctgccttggcctcccaaagggctggtagtaaaagcatgagccaccacgtctggcctatttatttttgagacaaggtctcgctcttgtcccaagctcaccatggaggtgaaaagagggtaacgtgagaatgggttaagagaaaaaaaaattttttttttttttgagacggagtctccctgtgtcacccaggctggagtgcagtggtgccgatggctcactgcaacttccgcctcccgagttcaggcctgaatagctgggattacaggcacccaccaccacgcctggctaatttttgtatttttagtagagacgaggtttcatcatgtgggccaggatggtctcgatctcctgacctcgtgatccgcccgcctcagcctcccaaagtgctgggattgcaggtgtgagccaccgcgccgggcctgagaaaaaaatcttataatcttcagatataagaaggttgcccagtttggagtgcagtggtgcaacctcagcttgctgcagtctttcaggcagtcctcccatctcagccgcctgagtagctgggactacaggcacatgccaccacacccgcctaatttctgggctcacgtgatcctatcttcctgccccagcctccctaagtgctgggattgcaggtgagagccaccacacctggcctaattatttcttttatctcgctaattacatttagtattaacacaagttattgaaaccttgtttatgtgaattcattgctcattgccagctttctgttttacatttaaattcattagtcatgtataccatctagtgtacattttcagctagtattttcactaggagtacctggaagccacatttaatgatttagattgctaacttccctcagaaattctgttgatgttgttctatcgccttgcattaatcattttgtttttttcctgtgcctggatggtggtaggaattttcctttttctttttttaaaaatattttgacagattctgtcttgtacatgttcactaatgttgcctgaaacattagttccttatgatctttgtacttggtgctttttaaaaaatttccaataatacttttggtgattacttttgtttcaattgttctgtttccttccttgaaaacacatgtaattattaggttggctcaccatttctgtcccctatgtgaactgctcaaaagtttgcccttttttaccactcgtttgatttttctttttcacttctaatgttggctttatttctgctattgcaatcttaatttcttagtatccttttaaaatttatctcacttttcttaaattatcttatctcatcctggtttcttctctccatatactcctgttttgtgtcatttgctaaattgtgactggaagttcctgaagtaatttaccttgtaagttaggttctgcttttgtgtgaagggtaatcttccttgtggttttcttttgctattaggatcagtgctggatttcttactgcctacttaccattgaacagtaactgttatgtcctgtctcatgtgcatttgtcagagatgtgtgtgtgttttccttgcctctccaggggactggagttctgatgaaaccgcttctcagatgtatttctgagggataaatacacagctcccggcctgatttccagtgatgaacagacattcctcttcatatggtattctgggctagggtagtaggatcttaccctaccctgtttctgtctttgtgagtctgaactgatgatgtatgagagtggccctcatttctagcatgtgctgctgttacaggttttctgattctgatcttacacccacaacataacactctccttgttacttcactaaacctcccaggaagcagtgtgtccattcgggttttcctgcccttacacagccccgctggaaccttacctgcacacgggcgcagacacacacttcctggtttgctttctggaatttgcgcctggtaatctccctgaatgtatgttgagagatcacagaagataaggaactgtggctgccacaaaaactgcctctgtgtagcaaggagtggctgaccaattcttgattctgctttgattcttcaaagccgactctgagtctccaaataaagcgatggctagtagggagagacaagatatcttcatagttcttttaggcagatgattgaactttgttttatgaggcagagcatggctgggtcacgagtctttttgcagtacagttgaccttaaagctaattgaaatccttcaaagatctcatataaattgtattggtggagatttgggacagactacgttggagatttctgatttgatagcattatttactagagtaaacctgttccaattttttgaaacttaggtaatcacttaagtagtaacatcagtcttgaccttcatcttttaataaaagattttacctcagattgatagattttcactttggtagtaggagaatggtatcttgttccattttgcatctgtttgataaatctagtgaggctgaaaatttttcctatgtctatggaccctccctccccatttttccattttgaattgctatttggggttcatggccaaaattaggaaaaactagacttcagagtgtttacgcatttcttcttccgacttttttttttttttttttgagatggagtttggctcttgctgcccaggctggagtgcagtggcacaatctcggccctctgtaacctctacttcccgggttcaagtgactctcctgccttagcctcctgagtagctgggattataggtatgtgccaccacgcctggctaattttgtatttttagtagagatggggtttctccacgttggtcaggctggtctcgaattcctgacctcaggtgatccgcctgcctcagcctcccaaagtgttgggattacaggcgtgagccactgcacccagacttcttctttttttttttgagacggagtctcgctttgttgccagcctggagtacagcggcatgatcttggctcactgcaacctccgcctcctgggttcaggcgattctgctgcctcagcctccttagtagctggggttacaggcgagcaccaccatgcctggctaatctttgtattttcaatagagacggggtttcactgtgttggtctggctggtgttgaactcttgacctcatgatccgtctgccttggcctcccaaagtgcagggattacaggtgtgagccaccgcacccggccccttccaactttttaagtaatctttcttgttgctgacttgttgtctccctgttccctaccgtcaggcagttttgaagcattttctgagcctcgccacttgacttcctttacgctttgtcattgtttcagttttttaatgtggtgattgagtgaaagccaaggggaagaagaaaaagagaaaaaagggtcacatttgaattacaaaatgcctttacactccctgtgtcctctgtatatagataccttcctctctttctttgcctgacaaattccttttcatccttcaaaaagcaattctgggttttttttgcctaattactctcatctaaacaggagctccgggtccccctttccagtgcgttccactgggccctgtcagcagcttaactcatttcagagtagttgttatttgtgagctccaaactgagacttaactcttttaggcacttaataaatatttgaatgaatgaataaattaggagtattagtaacaaaatgcttgggctgggcgtggtggctcatgcctgtaatcccagcactttgggaggccgagctgggaggatcacaaggtcaggagttcaagaccagcctgcccaatatggtgaaaccttgtccgtactaaaaatacaaaaattagctgggcgtgatggcacgcgcctgtagtcccagctactcgggaggctgaggcagaagaatcgcttgaacccgggaggaggagattgtagtgagctgagattgtgccactgcactctagcctgggtgacagagcaagattccatctcaaaaaagaaagaaagaaacaaaatgcttattccttggtgctgcaatgaaatagcactcagcataaatttaactttctcagcaaggcagttttacttgctgcataaagggtgctcctcgcagatggaacaatggtgagagcacacctgaacaagggaggggaaggggttcttattcctgacacaggtagcccctattgttgtgtcattcccctgttggctagggttggactgcactgtctaagctaattccgattggctattttaaagagaccagggggtatgagccagagtggcaggctgagtagtttagtgggaaggacggttaggaacaggtaactcaaggtgacttaggtcagagcaggtgaccaggggtgactcaggtcaaagcaggtgactgggatgagtcaggacagagcaggtgactgggggaacagatgtgaactactgatgaaaactggtggaaaaggttgtttagtgaaactacgctgaagttaaactttaaaatggagggcaatactggttctttgaagagaaatctagaactcactgtatccaacaggagagatttacaaagagtttctgttattttttccatccacgtcatttccctgcttagtaacttctagtgtgaaaatatcaaaagcaggtatctctgagaagtggacttaggcttattcttcttttcttttagaccttattctggtttgaggtttttgtgatcatcatgtactacttttattatataagaataaaaaaaaattaaccccaaacccctcaaatttccaggcgcttcctgttgcccagaccctgcaccattctggccccactcagcctagttttatttcccactgcttgccagctgtgccctgtgatctccttgctgtctcatgagctacgtggtacttatgttcctgttgcctggaatcccgtcttctggtcaggaagatgatctgcgataaataccgagaatactcgcgttagatactgaatagtgagagtttagactcacgacctggggtgtcatcttgaacatacggtgcttaagggatgaggtttctgggtcagttttattggttgtgatgaacaagataaatggagcatttgtcttagcttctagaatagtgaccttaaaagagatagaacagtgaatgtatcttcaaacttgcctgggtctccactagcctaaagaagaaaaaaccctttaattctgatgctgtcacagatgaaatcctttcattcactgatttattcattcaagaaataatgactcatcacctactctgggctaaacacagtgtccagtgtgatggtgatgtaatggtcaacaagatagatactcactgggtccttgcctgtggagtttatacgtagttagagaagacagacattaaaagaagaaatccagtgtgatgaatgttgagataaaaggaaataaaccaatacttgtggcagtgaagaggtatcagaggtttcctgagagaatgacatttaagctagtacttgaagtaggtgtttgccaggtggaggtggtgggcagaaagtagagtcatcagttcattctggtttgtccacggctttcctggttttagcacgacacgtcccgtgtccggggaggtcatgtgcgaaagcttcagatggcaattaaagaaacagtaagaatagaaaaaacttaaagcctgaagagggaaagactaaagtgagatgagtctagaaagttagacaggagcctgatgatgcacgcactgttgggctttacctaagaaccatgagaaggttttaagtgggaggatgaagtgatagtatttttattttattttattttagtttattttattttgagaaagtgtctcgctctactgcccagggtggagtgtaccctggcatgatctcagctcacagcagcctccacttcctggttcgggcgattctcatgcctcagcctcctgagtagctgggacagcaggcactcatgatcacgcctggctaaattttatatttttttagtagagacacagtttcaccatgttgcccaggctggtcttgaactcctgacctcaagtgatctgcccacctcagtgtgccaaagtgctggcattacaggcatgagccaccacacccgtccaaggatgttaatttcttaaaaagggaaaaacttacacatttttattctcgtatttttctgtcactggatagaaacattactagcagagtaaataatccagatgcctgtcttcagcctttttgtcagacatgaagagtaagcatagaaggtaggaggcatggctgtgaggtcgttgaagtgatcttttcctgaacacagcaaatactataaatggtttttgtcaccattgaagtagtcccattgagagactgcctgattatcccagtgatgcttccactcttcagattatttctagaactcttctttttgcattgccctgggagcctctggcatattcttcagagtttcttcttcaccagaggcaaacttttcatccttgcctgtgcctctgtttcaggtcagtttctcttgctctctgcatctatgtttggcccaattggtttctttcttttccttaaaaattccttaaattttaaaaaaacagatattcatatacagtaaaattcaccctttaaggtatacagttaagtggttttttttgtttttttttttttttttttttttttttttttttttttttgagatagagtcttgctctgtcacccaggctggaggctggagtacagtggcgtgatctcggcccactgcaacctctgcctcccaggttcaagcaattcttctgcctcagcctccagagtagttgggactacaggcacgcaccaccacgcccagctaatttttgtatttttagtagagatggggtttcaccatactggccaggctggtcttgaactcctgagctcgtgatctgcccgcctcagcctcccaaagtgccgggattacaggcgtgagtcactgtgcccagccagttaagtgggttttttaagtgtgctcacaaagttatacagccgtccccactatctaattacagaatatttgcaccacctcagagagaaatactgcactgaatagcagtgactccttatttcatctccccgccggccccaaataccactaatctattttttgtctcatgaatggaatgatacaatatgtggtcttttgtgactggtttctttcatttaacacagtgttttcaaggtccatccatgctgtggcatctctcagcacttcattccttttacagtcaaatggtattccattgtatgggtgaaagagacagggtcttctatattgtccaggctagtcttgaactcctgggctcaagtgatcctcctgcctcagcctcttaagtagctgggatggtgcacacctgggttattttcagttttttgtttgtttgtttgttttgagacagcgtcttgcactgtcgcccaggctggagcacactggcgcgatctcagctcactacaacctccgtctcccgggttcaagcaattctcctgcctcagcctcctgagtagctgggattgtaggtgcccaccaccacacccagctaatttctgtatttttagtagagacagtatttctccatgttggccaggctggtctcgaactcctgagctcaggtgaaccgccggcctcagcctcccaaagtgctgggattacaggtgtgagccaccaagcctggactctgagtatgatttcttacctcattgttcatatttctacagtgataagtaggcatcatccatgtgcagccgcattatgggcctgtaaccatgaccggtctgtgagtttgagcagtttgaatgcataaggatgcattcttatgctatccaaattatttgtgctttgctggtgaagattctgaaacaaggtgtgtcattagaaagtgtttacttgtttataacggccttaaactactgaaggtgtataggatatttatgagtcgtgattcaaagtgtgagtttaaacgtttgttggtgcctccgtgttaaaagcattatgttagatagtgtcagataggtacagagatgtatggaaagtgttacctgccagccagtttataatcttgtagaaaaaagaaaagttagggctgagcacagtggctcaagcctgtaatcccagcactttgggaggctgaggcggatggagatcaggagttcaagaccagcctgaccaacatggagaaaccctgtctctactaaaaatacaaaattagccgggtgtggttgtgcatacctgtaatcccggctactcggtaaggctgaggcaggagaaccgctttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcggggggctgacccccacctccctcccggatggggcggctggccgggcggggggctgacccccccccacctccctcccggacggggtggctgccggacggagacgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtcttggccgggcagaggcgctcctcacatcccagatggggcggcggggcagaggcgtcccccacatctcagacgatgggcgcccgggcagagacgctcctcacttcctagatgggatggtggccgggcgcagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaacgagactccgtctgcaatcccggcacctcgggaggccgaggctggcggatcactcgcggttaggggctggagaccggcccggccaacacagcgaaacctcgtctccaccaaaaccagtcaggcgtggcggcgcatgcctgcaatcgcaggcactcggcaggctgaggcaggagaatcagacagggaggttgcagtgagctgagatggcagcagtacagtccagcttcggctccgcatgagagggagaccgtggggagagggagagggagagggagagaggagaaccgctttaaccggggaggcggaggttgcagtgagccgagatcgtgccattgcactccagcctgggcaacgagagtgaaactccgtctcaaaaaaaaaaaaaagaagaaaagttagaagccaggtgactgaatttcaaggaagtgtgcaagtaccatatggatggatgggactgtatcattctgggtccaatcaggagagagaagccatacagtaatttgaacatgaaaaaacataattgactgactataacagggtaattgagtaatgagggattagccagtaaaaaaatagagctctaaagaacattggaatagcaaaagtaagaagcagctacttcccctagggctgagatagaccccccaccccctgcctgggaaagagctattccttttcccagagctgagatccagaccttattggagagagcgtggttgtaaatcactgaatggcagagatgtttctgccatttaatggttctttgttggccatagttgttggacatctgccctttagggtgccaaggagaattattaactctgatacaaaactgctcaaaaagagtatgtggggtggctccctgttgcagtagactcagtgctgctggccaccttcccctattggagtctgatgctggaggagctgcctgcccatcaggagtcttgtgacaactggaaccaggaagcaaaactccttttcttctgtgatgtctctccagcgccctatatcgacaaagcttagcatcgtgtcccggcaaaggaaaaatgcttgaaggcctcagatccgttttcggaatggacagaaatgatgaatttggaatggagaggcactagatcagtaactggcaggagaatggtattaactgctgcgggagctcagagacggagcagaggtcacatgacagtaaaagaagtatttgagaaagagcttagaagatgagtagatttttaaattgaagattgcttacgttttcatggcaaaatagtatctgcattttagaaaaaatagaatatagacaagtattattgtctattttctatagaaagaaaggaaaggcactcagatcactgtctacaaagagatccagtgttaattgcttgataaaaggtgtctggccaggctctgtcacccaggctggagtgcagtggtgtggcacgatcacggctcactgcaagctctgcctcctgggttcatgccattctcctgcctcagcctccagagtagctgggaccacaggcgcccaccaccacgcccggctatttttttttttttttgtatttttagtagagatggggtttcaccgtgttagccaggatggtcttgatctcctgacctcaggtgatccacctgcctccgaaagtgctgggattacaggcgtgagccaccgcgcccggcctgctgctgcttttgtatctttgcagaaaacaattggcttttaggtgtaataatgctaaactttataaacagacactgggaaaaacttcctacttttggtatttcaactgtgaagtttatttgcataacttctttatgataagtttgtcaaataaacattttagcgctcttcaagtgacctttaggaagagattttctgatggaacatcgtatcttagaagtccattttttcttgccaggcgcagtggctcacacctataatcccagcactttgggagaccaagacgggcagatcacttgaggtcaggagttcaagaccagcctggccaacatggtgtgaagccgcatctctactaaaaatacaaaaaattagccaggcatggtggcgggtgtctgtaatcccagctactcgggaggctgaggcaggagaatcacttgaacctgggaggcggaggttgcagtgagccgagattgtgccactgcactccagcctgggtgacagagcgagactctgtctcaaaaaaaaataaataaataaatacagatagaagtcaactttaaagctaatacccaatttctaatttaatttaatttaattttttaaaatagcgtcttgccacgttgcccaggctggtctctaactagtgggctcaggcagtcctcccgcctcaccctcccaaaatgttgggattacagctgtgagtcactgcaccgaccccaaattttcttttcttttctttctttttttttttttttttttgagacggagtcttgctctattgcccaggctggagtgcagtggtgcgatctcggctcactgcaaattccgcctcccgggttcacgccattctcctgcctcagcctcctgagtagctgggacactacaggcacccgccaccacgcccagctaattttttgtatttttagtagagacgaggtttcaccgtgttagccaggatggtctcgatcttctgacctcgtgatccacctgcctcggcctcccaaagtgctgggattacaggcatgagccaccgtgcccggccttttttttttttttttttttttgagacagggtctcgctctgtcacccagactggagtgcagtggcgtgatctcagctcactgcaacctttgcctcccgagttcaagcgattctcttgcctcagcctcctgagtagctgggattacaggcacacaccaccatgctcatctaatttttttgcatttttagtagagacggggttttgccatgttggccaggctgggctcgaactcctggcctcaagcaatcccccacctccgcctcctgagtaactgggattacaggtgcgagccaccgcatccagcctgccaaattttctaaagtagttttgccagtttatactcctgccagctgtatataagaattctctttgtgccatattcctgataacacttgatttgaatcagccttcttgttttttgccaatgtagaaggtgtaaaatggtatctgctagaggccttaatttacatttcattaatgtctgaggttggacatattcttatgtatgtgttcattatttgtcatcacttgtgagaatagataatacaggtattactccattatattggtggttaaataaagggactaaaaggaagagtgatttggctttcagtatgcaacttgataagtggcagtagtttatttgcctagactggctaacattgtttatttgaaaaacacattttgagtttctgtgatgtatataacactttgctaggtgctccttgagaataaaaagagctataaaattagtatcttctttttttttttttttagacggagtcttgctctgttgcccaggctggagtgcagtggcatgatctcggctcactgcaagctccacctcccggggtcaagcgattctacctcagtctcctgagtagctgggattacaagtgagcaccaccatgcccacctagtttttgtacttttagtagagatgaggtttcaccatgctggccaggttggtctcgaactcctgatctcatgatccgcccgcctcgacctcccaaagtgctgggattacagacatgagccaccatgcctggcctcttttttaaatttttatttttatattttcttctcaaaacttagtaccttctcacaaagagtagagttcagtagaggaaatatgatacatcatggtagctgacaatagaggcataacctataaataatagagctaataacccggtcataatctggttaatgagtgtttgctaactgtgtaatacatataatacaaaaagttaccattatagataccataatctctaaagatgtaagaacagaaccagtgccaatttacattcaattctgttccgtattttggtcttcatttaattgtaaatgcaaataaggtgcatatgtcgtctacaaagcaaaaaagtacaaggattttcttaagtgatcagtggatggctatcttactacaagcagtattgttcattcttcataagctggtgattttatataatttacggagttc
